United States Patent 11,866,727 (MATERIALS AND METHODS FOR TREATMENT OF GLYCOGEN STORAGE DISEASE TYPE 1A) - sequence listing, part 3

SEQ ID NO: 38880 - DNA, 20 bp, Artificial Sequence
  chemically synthesized
aggcaacaaatctgttcaaa

SEQ ID NO: 38881 - DNA, 20 bp, Artificial Sequence
  chemically synthesized
aggctccttaggacacctgg

SEQ ID NO: 38882 - DNA, 20 bp, Artificial Sequence
  chemically synthesized
tccatctctggcacaaaatg

SEQ ID NO: 38883 - DNA, 20 bp, Artificial Sequence
  chemically synthesized
ggctaataaaatgaagatag

SEQ ID NO: 38884 - DNA, 20 bp, Artificial Sequence
  chemically synthesized
gatgacacactgcagagaac

SEQ ID NO: 38885 - DNA, 20 bp, Artificial Sequence
  chemically synthesized
atccagtagaaaggcagatg

SEQ ID NO: 38886 - DNA, 20 bp, Artificial Sequence
  chemically synthesized
caaggaggaggatgcacgct

SEQ ID NO: 38887 - DNA, 20 bp, Artificial Sequence
  chemically synthesized
aatatgctctatgctggaaa

SEQ ID NO: 38888 - DNA, 20 bp, Artificial Sequence
  chemically synthesized
atatccatgtcttcaccccg

SEQ ID NO: 38889 - DNA, 20 bp, Artificial Sequence
  chemically synthesized
actctcttttccaggaagag

SEQ ID NO: 38890 - DNA, 20 bp, Artificial Sequence
  chemically synthesized
aaacacacaataaattaata

SEQ ID NO: 38891 - DNA, 20 bp, Artificial Sequence
  chemically synthesized
gttcagttaaacattttgaa

SEQ ID NO: 38892 - DNA, 20 bp, Artificial Sequence
  chemically synthesized
cctgtaactgtgtcatttta

SEQ ID NO: 38893 - DNA, 20 bp, Artificial Sequence
  chemically synthesized
caatttttctttttttaacc

SEQ ID NO: 38894 - DNA, 20 bp, Artificial Sequence
  chemically synthesized
tgatgatttttccacaatcc

SEQ ID NO: 38895 - DNA, 20 bp, Artificial Sequence
  chemically synthesized
tttccacaatccttttgttt

SEQ ID NO: 38896 - DNA, 20 bp, Artificial Sequence
  chemically synthesized
ctccagggctcatatggcaa

SEQ ID NO: 38897 - DNA, 20 bp, Artificial Sequence
  chemically synthesized
atatggcaatggggatttaa

SEQ ID NO: 38898 - DNA, 20 bp, Artificial Sequence
  chemically synthesized
cttagcaatttgtgaataga

SEQ ID NO: 38899 - DNA, 20 bp, Artificial Sequence
  chemically synthesized
tttgtgaatagaagatgttt

SEQ ID NO: 38900 - DNA, 20 bp, Artificial Sequence
  chemically synthesized
gataacacgtccacagaaag

SEQ ID NO: 38901 - DNA, 20 bp, Artificial Sequence
  chemically synthesized
cagaaagcctggctttccaa

SEQ ID NO: 38902 - DNA, 20 bp, Artificial Sequence
  chemically synthesized
atcagagaatgtgcccccca

SEQ ID NO: 38903 - DNA, 20 bp, Artificial Sequence
  chemically synthesized
atatgttaatcctgtggcag

SEQ ID NO: 38904 - DNA, 20 bp, Artificial Sequence
  chemically synthesized
aagttcacagtgatctacat

SEQ ID NO: 38905 - DNA, 20 bp, Artificial Sequence
  chemically synthesized
accaatttccccaaaaaact

SEQ ID NO: 38906 - DNA, 20 bp, Artificial Sequence
  chemically synthesized
ttttctttgatattttcttg

SEQ ID NO: 38907 - DNA, 20 bp, Artificial Sequence
  chemically synthesized
atggcttccactaaattcaa

SEQ ID NO: 38908 - DNA, 20 bp, Artificial Sequence
  chemically synthesized
taaaattttatctggtaatt

SEQ ID NO: 38909 - DNA, 20 bp, Artificial Sequence
  chemically synthesized
gcaagttcatctaactatgt

SEQ ID NO: 38910 - DNA, 20 bp, Artificial Sequence
  chemically synthesized
gatggaactcctgagttcac

SEQ ID NO: 38911 - DNA, 20 bp, Artificial Sequence
  chemically synthesized
actacaaaactctcaccctc

SEQ ID NO: 38912 - DNA, 20 bp, Artificial Sequence
  chemically synthesized
tgctgcatttcttcccctaa

SEQ ID NO: 38913 - DNA, 20 bp, Artificial Sequence
  chemically synthesized
accagacttctctcttctta

SEQ ID NO: 38914 - DNA, 20 bp, Artificial Sequence
  chemically synthesized
tgctcttcagttacattgga

SEQ ID NO: 38915 - DNA, 20 bp, Artificial Sequence
  chemically synthesized
ttcagttacattggaatgtg

SEQ ID NO: 38916 - DNA, 20 bp, Artificial Sequence
  chemically synthesized
gatgaaaaagtgagaagagc

SEQ ID NO: 38917 - DNA, 20 bp, Artificial Sequence
  chemically synthesized
cctagattttttcttggaaa

SEQ ID NO: 38918 - DNA, 20 bp, Artificial Sequence
  chemically synthesized
cttggaaatctggcttaaat

SEQ ID NO: 38919 - DNA, 20 bp, Artificial Sequence
  chemically synthesized
aaatccaggtttctttattt

SEQ ID NO: 38920 - DNA, 20 bp, Artificial Sequence
  chemically synthesized
atttggtcacgagacaaata

SEQ ID NO: 38921 - DNA, 20 bp, Artificial Sequence
  chemically synthesized
aataacatgattttcctaag

SEQ ID NO: 38922 - DNA, 20 bp, Artificial Sequence
  chemically synthesized
attttcctaagtctagattt

SEQ ID NO: 38923 - DNA, 20 bp, Artificial Sequence
  chemically synthesized
acatattcaaagagttattt

SEQ ID NO: 38924 - DNA, 20 bp, Artificial Sequence
  chemically synthesized
atgaaactgagaaccaagcg

SEQ ID NO: 38925 - DNA, 20 bp, Artificial Sequence
  chemically synthesized
ccatcatgtaggcacactct

SEQ ID NO: 38926 - DNA, 20 bp, Artificial Sequence
  chemically synthesized
taagaatttttcaatcatat

SEQ ID NO: 38927 - DNA, 20 bp, Artificial Sequence
  chemically synthesized
atttaaaaaaactatgtctt

SEQ ID NO: 38928 - DNA, 20 bp, Artificial Sequence
  chemically synthesized
accagatagtcaaattaagt

SEQ ID NO: 38929 - DNA, 20 bp, Artificial Sequence
  chemically synthesized
cacccctagaccttcatctt

SEQ ID NO: 38930 - DNA, 20 bp, Artificial Sequence
  chemically synthesized
ccttcatctttcctgattag

SEQ ID NO: 38931 - DNA, 20 bp, Artificial Sequence
  chemically synthesized
ctgcacatccatagcctccc

SEQ ID NO: 38932 - DNA, 20 bp, Artificial Sequence
  chemically synthesized
tagacacaaccctttcaggt

SEQ ID NO: 38933 - DNA, 20 bp, Artificial Sequence
  chemically synthesized
tatttattcctagtgaactc

SEQ ID NO: 38934 - DNA, 20 bp, Artificial Sequence
  chemically synthesized
cagatggatcacctgaggcc

SEQ ID NO: 38935 - DNA, 20 bp, Artificial Sequence
  chemically synthesized
taagtaggctgaggcactag

SEQ ID NO: 38936 - DNA, 20 bp, Artificial Sequence
  chemically synthesized
atccttcctattctagtagt

SEQ ID NO: 38937 - DNA, 20 bp, Artificial Sequence
  chemically synthesized
gacaggtggatcacaaggtc

SEQ ID NO: 38938 - DNA, 20 bp, Artificial Sequence
  chemically synthesized
caagatggttaggaggctcc

SEQ ID NO: 38939 - DNA, 20 bp, Artificial Sequence
  chemically synthesized
atacatttgggacagatcta

SEQ ID NO: 38940 - DNA, 20 bp, Artificial Sequence
  chemically synthesized
acacttagactggggtcttc

SEQ ID NO: 38941 - DNA, 20 bp, Artificial Sequence
  chemically synthesized
aaatgcccagcacagagctc

SEQ ID NO: 38942 - DNA, 20 bp, Artificial Sequence
  chemically synthesized
ctcttccattcagaaactca

SEQ ID NO: 38943 - DNA, 20 bp, Artificial Sequence
  chemically synthesized
tcattctcaatcacagggag

SEQ ID NO: 38944 - DNA, 20 bp, Artificial Sequence
  chemically synthesized
aaagccagccccaaaggtac

SEQ ID NO: 38945 - DNA, 20 bp, Artificial Sequence
  chemically synthesized
aagagtctatgttccaaaaa

SEQ ID NO: 38946 - DNA, 20 bp, Artificial Sequence
  chemically synthesized
aaaaacctggatttaacaat

SEQ ID NO: 38947 - DNA, 20 bp, Artificial Sequence
  chemically synthesized
taacaatctgagctttgtca

SEQ ID NO: 38948 - DNA, 20 bp, Artificial Sequence
  chemically synthesized
catggtgctttgcggttggt

SEQ ID NO: 38949 - DNA, 20 bp, Artificial Sequence
  chemically synthesized
tgttgtttctttaccttttt

SEQ ID NO: 38950 - DNA, 20 bp, Artificial Sequence
  chemically synthesized
gcttttaaaaccataaagaa

SEQ ID NO: 38951 - DNA, 20 bp, Artificial Sequence
  chemically synthesized
agtctgagaaatgcaattgc

SEQ ID NO: 38952 - DNA, 20 bp, Artificial Sequence
  chemically synthesized
tttatattttcagacttttt

SEQ ID NO: 38953 - DNA, 20 bp, Artificial Sequence
  chemically synthesized
tcatatcacaaaatttcaca

SEQ ID NO: 38954 - DNA, 20 bp, Artificial Sequence
  chemically synthesized
ttttcactcaacattacata

SEQ ID NO: 38955 - DNA, 20 bp, Artificial Sequence
  chemically synthesized
ctaatattttaaaggagagc

SEQ ID NO: 38956 - DNA, 20 bp, Artificial Sequence
  chemically synthesized
gagctactgattaatgagca

SEQ ID NO: 38957 - DNA, 20 bp, Artificial Sequence
  chemically synthesized
aagcattatcctttccaggc

SEQ ID NO: 38958 - DNA, 20 bp, Artificial Sequence
  chemically synthesized
ggtctgcggagtcactgccc

SEQ ID NO: 38959 - DNA, 20 bp, Artificial Sequence
  chemically synthesized
cccgtgcgcgttggcccccc

SEQ ID NO: 38960 - DNA, 20 bp, Artificial Sequence
  chemically synthesized
aatctaacaggttgaaattg

SEQ ID NO: 38961 - DNA, 20 bp, Artificial Sequence
  chemically synthesized
tctttgacaatttgggagag

SEQ ID NO: 38962 - DNA, 20 bp, Artificial Sequence
  chemically synthesized
gagagtgaagattctcctgg

SEQ ID NO: 38963 - DNA, 20 bp, Artificial Sequence
  chemically synthesized
gtgtttattcttttgtgaaa

SEQ ID NO: 38964 - DNA, 20 bp, Artificial Sequence
  chemically synthesized
tgcaaaattgccagaggaaa

SEQ ID NO: 38965 - DNA, 20 bp, Artificial Sequence
  chemically synthesized
ttccagatggacacacccag

SEQ ID NO: 38966 - DNA, 20 bp, Artificial Sequence
  chemically synthesized
ttcagtgttctcacaaataa

SEQ ID NO: 38967 - DNA, 20 bp, Artificial Sequence
  chemically synthesized
cagttttctaattttgcaag

SEQ ID NO: 38968 - DNA, 20 bp, Artificial Sequence
  chemically synthesized
cattagaattttgcaaaaat

SEQ ID NO: 38969 - DNA, 20 bp, Artificial Sequence
  chemically synthesized
gttgacatgagcagcatgga

SEQ ID NO: 38970 - DNA, 20 bp, Artificial Sequence
  chemically synthesized
tctgggcagagctgcatgat

SEQ ID NO: 38971 - DNA, 20 bp, Artificial Sequence
  chemically synthesized
caggtaggccacaggtgaca

SEQ ID NO: 38972 - DNA, 20 bp, Artificial Sequence
  chemically synthesized
gtccagcggcaggatcagtc

SEQ ID NO: 38973 - DNA, 20 bp, Artificial Sequence
  chemically synthesized
aattgatgaacaggcctgag

SEQ ID NO: 38974 - DNA, 20 bp, Artificial Sequence
  chemically synthesized
gctaatggtggtggtaatga

SEQ ID NO: 38975 - DNA, 20 bp, Artificial Sequence
  chemically synthesized
tcatcagtagacatcatata

SEQ ID NO: 38976 - DNA, 20 bp, Artificial Sequence
  chemically synthesized
tagctggcccagagcctact

SEQ ID NO: 38977 - DNA, 20 bp, Artificial Sequence
  chemically synthesized
tttctaaccaccatccccca

SEQ ID NO: 38978 - DNA, 20 bp, Artificial Sequence
  chemically synthesized
cacctgcaggtccactgaga

SEQ ID NO: 38979 - DNA, 20 bp, Artificial Sequence
  chemically synthesized
tcagcctctgagagggaggt

SEQ ID NO: 38980 - DNA, 20 bp, Artificial Sequence
  chemically synthesized
aagttttcctgctctcccct

SEQ ID NO: 38981 - DNA, 20 bp, Artificial Sequence
  chemically synthesized
tccctgacttggatcaaatg

SEQ ID NO: 38982 - DNA, 20 bp, Artificial Sequence
  chemically synthesized
gtttggaggtgttgaggcca

SEQ ID NO: 38983 - DNA, 20 bp, Artificial Sequence
  chemically synthesized
ctccccaaggccccatcagg

SEQ ID NO: 38984 - DNA, 20 bp, Artificial Sequence
  chemically synthesized
aactttcctggcaacttgcg

SEQ ID NO: 38985 - DNA, 20 bp, Artificial Sequence
  chemically synthesized
gtaggttttcaccattatca

SEQ ID NO: 38986 - DNA, 20 bp, Artificial Sequence
  chemically synthesized
gatgtttgccttgctcaaat

SEQ ID NO: 38987 - DNA, 20 bp, Artificial Sequence
  chemically synthesized
caggtgatgcaccctctgcc

SEQ ID NO: 38988 - DNA, 20 bp, Artificial Sequence
  chemically synthesized
acttccatcatgcagctctg

SEQ ID NO: 38989 - DNA, 20 bp, Artificial Sequence
  chemically synthesized
catgtcaactccagatgcag

SEQ ID NO: 38990 - DNA, 20 bp, Artificial Sequence
  chemically synthesized
cctgtgccatgctcgcaaag

SEQ ID NO: 38991 - DNA, 20 bp, Artificial Sequence
  chemically synthesized
ttgcaaaattctaatgaaag

SEQ ID NO: 38992 - DNA, 20 bp, Artificial Sequence
  chemically synthesized
tgggcttgcaaaattagaaa

SEQ ID NO: 38993 - DNA, 20 bp, Artificial Sequence
  chemically synthesized
gaatttggcaaagaaaataa

SEQ ID NO: 38994 - DNA, 20 bp, Artificial Sequence
  chemically synthesized
aatcaggacaatttcaacct

SEQ ID NO: 38995 - DNA, 20 bp, Artificial Sequence
  chemically synthesized
acactcatacaagtgtggtg

SEQ ID NO: 38996 - DNA, 20 bp, Artificial Sequence
  chemically synthesized
tcatacaagtgtggtgaagt

SEQ ID NO: 38997 - DNA, 20 bp, Artificial Sequence
  chemically synthesized
actagacaacctccttacac

SEQ ID NO: 38998 - DNA, 20 bp, Artificial Sequence
  chemically synthesized
agagcaggagtgatggaact

SEQ ID NO: 38999 - DNA, 20 bp, Artificial Sequence
  chemically synthesized
gaagtgagatacaccacatt

SEQ ID NO: 39000 - DNA, 20 bp, Artificial Sequence
  chemically synthesized
aagcttgtgcctggaaagga

SEQ ID NO: 39001 - DNA, 20 bp, Artificial Sequence
  chemically synthesized
tacatttaaacattattctt

SEQ ID NO: 39002 - DNA, 20 bp, Artificial Sequence
  chemically synthesized
cgcaaagcaccatgacaaag

SEQ ID NO: 39003 - DNA, 20 bp, Artificial Sequence
  chemically synthesized
caaagctcagattgttaaat

SEQ ID NO: 39004 - DNA, 20 bp, Artificial Sequence
  chemically synthesized
ttggaacatagactcttata

SEQ ID NO: 39005 - DNA, 20 bp, Artificial Sequence
  chemically synthesized
tcaccactgctctgttcttc

SEQ ID NO: 39006 - DNA, 20 bp, Artificial Sequence
  chemically synthesized
taaacacaggtacctttggg

SEQ ID NO: 39007 - DNA, 20 bp, Artificial Sequence
  chemically synthesized
tctcaaggaagcccagctcc

SEQ ID NO: 39008 - DNA, 20 bp, Artificial Sequence
  chemically synthesized
gaatgaagtgtgcaatcgct

SEQ ID NO: 39009 - DNA, 20 bp, Artificial Sequence
  chemically synthesized
tcccaaagtagcgaattcaa

SEQ ID NO: 39010 - DNA, 20 bp, Artificial Sequence
  chemically synthesized
gatcatccaaggggacttct

SEQ ID NO: 39011 - DNA, 20 bp, Artificial Sequence
  chemically synthesized
ccggtggccagggactaaag

SEQ ID NO: 39012 - DNA, 20 bp, Artificial Sequence
  chemically synthesized
cagagttggcgtgtctcccc

SEQ ID NO: 39013 - DNA, 20 bp, Artificial Sequence
  chemically synthesized
ctccccaattgatttacaac

SEQ ID NO: 39014 - DNA, 20 bp, Artificial Sequence
  chemically synthesized
atttacaactggggcttgga

SEQ ID NO: 39015 - DNA, 20 bp, Artificial Sequence
  chemically synthesized
tttccacttaattctaccac

SEQ ID NO: 39016 - DNA, 20 bp, Artificial Sequence
  chemically synthesized
tacttcatgagaacgaaaat

SEQ ID NO: 39017 - DNA, 20 bp, Artificial Sequence
  chemically synthesized
gcaccatgaattcatttgcg

SEQ ID NO: 39018 - DNA, 20 bp, Artificial Sequence
  chemically synthesized
catttgcggaaagattgata

SEQ ID NO: 39019 - DNA, 20 bp, Artificial Sequence
  chemically synthesized
accccggttgaagtgcactg

SEQ ID NO: 39020 - DNA, 20 bp, Artificial Sequence
  chemically synthesized
tactccagcctccctagtag

SEQ ID NO: 39021 - DNA, 20 bp, Artificial Sequence
  chemically synthesized
ttttgtatttttagtagaga

SEQ ID NO: 39022 - DNA, 20 bp, Artificial Sequence
  chemically synthesized
tgtcttggcctcccaaagtg

SEQ ID NO: 39023 - DNA, 20 bp, Artificial Sequence
  chemically synthesized
ttgagccaccgcactcgacc

SEQ ID NO: 39024 - DNA, 20 bp, Artificial Sequence
  chemically synthesized
agccacaactactagaatag

SEQ ID NO: 39025 - DNA, 20 bp, Artificial Sequence
  chemically synthesized
ttttgtattttttgtagaga

SEQ ID NO: 39026 - DNA, 20 bp, Artificial Sequence
  chemically synthesized
acagggttttggcatgttgc

SEQ ID NO: 39027 - DNA, 20 bp, Artificial Sequence
  chemically synthesized
tgccgtggcctcccaaaatg

SEQ ID NO: 39028 - DNA, 20 bp, Artificial Sequence
  chemically synthesized
tgagccaccaccccctcctg

SEQ ID NO: 39029 - DNA, 20 bp, Artificial Sequence
  chemically synthesized
aaataaattttgaagataat

SEQ ID NO: 39030 - DNA, 20 bp, Artificial Sequence
  chemically synthesized
cacttatgttgtcatttcgg

SEQ ID NO: 39031 - DNA, 20 bp, Artificial Sequence
  chemically synthesized
tggagatgttaacatttata

SEQ ID NO: 39032 - DNA, 20 bp, Artificial Sequence
  chemically synthesized
tcgtacagcactgcctgttg

SEQ ID NO: 39033 - DNA, 20 bp, Artificial Sequence
  chemically synthesized
ccagcaaatatgagctactt

SEQ ID NO: 39034 - DNA, 20 bp, Artificial Sequence
  chemically synthesized
gtggagcagctgagggggga

SEQ ID NO: 39035 - DNA, 20 bp, Artificial Sequence
  chemically synthesized
ataagactctatattcaagg

SEQ ID NO: 39036 - DNA, 20 bp, Artificial Sequence
  chemically synthesized
tcattaacttaatttgacta

SEQ ID NO: 39037 - DNA, 20 bp, Artificial Sequence
  chemically synthesized
tttgactatctggtttgtgg

SEQ ID NO: 39038 - DNA, 20 bp, Artificial Sequence
  chemically synthesized
tcatgtaagtcaacaatgtc

SEQ ID NO: 39039 - DNA, 20 bp, Artificial Sequence
  chemically synthesized
atttctgaaatcaggtaaga

SEQ ID NO: 39040 - DNA, 20 bp, Artificial Sequence
  chemically synthesized
tgtagtaaaaatacatatgc

SEQ ID NO: 39041 - DNA, 20 bp, Artificial Sequence
  chemically synthesized
ttatgtgcaattcatttaat

SEQ ID NO: 39042 - DNA, 20 bp, Artificial Sequence
  chemically synthesized
ttcccagttcaaaatcttgt

SEQ ID NO: 39043 - DNA, 20 bp, Artificial Sequence
  chemically synthesized
attgaaaaattcttaaaaaa

SEQ ID NO: 39044 - DNA, 20 bp, Artificial Sequence
  chemically synthesized
gaatgggcagaaaaaataat

SEQ ID NO: 39045 - DNA, 20 bp, Artificial Sequence
  chemically synthesized
atgcaaaggatggctaagct

SEQ ID NO: 39046 - DNA, 20 bp, Artificial Sequence
  chemically synthesized
gctaagctcttcgcttggtt

SEQ ID NO: 39047 - DNA, 20 bp, Artificial Sequence
  chemically synthesized
acaatgaaataactctttga

SEQ ID NO: 39048 - DNA, 20 bp, Artificial Sequence
  chemically synthesized
tctctttgttatggcctgag

SEQ ID NO: 39049 - DNA, 20 bp, Artificial Sequence
  chemically synthesized
aaggctttccatcggtatac

SEQ ID NO: 39050 - DNA, 20 bp, Artificial Sequence
  chemically synthesized
tgccagatgatatacgcata

SEQ ID NO: 39051 - DNA, 20 bp, Artificial Sequence
  chemically synthesized
catacacacatacacaccgt

SEQ ID NO: 39052 - DNA, 20 bp, Artificial Sequence
  chemically synthesized
agtgtgtgtcctttacaaat

SEQ ID NO: 39053 - DNA, 20 bp, Artificial Sequence
  chemically synthesized
aaatcaaggaaataaagaaa

SEQ ID NO: 39054 - DNA, 20 bp, Artificial Sequence
  chemically synthesized
ataaagaaacctggatttaa

SEQ ID NO: 39055 - DNA, 20 bp, Artificial Sequence
  chemically synthesized
atgtaactgaagagcaggtt

SEQ ID NO: 39056 - DNA, 20 bp, Artificial Sequence
  chemically synthesized
agagaagtctggtataaaga

SEQ ID NO: 39057 - DNA, 20 bp, Artificial Sequence
  chemically synthesized
agtctggtataaagaaagtg

SEQ ID NO: 39058 - DNA, 20 bp, Artificial Sequence
  chemically synthesized
gaaagtgatttgcttccaaa

SEQ ID NO: 39059 - DNA, 20 bp, Artificial Sequence
  chemically synthesized
aaggcaacagaggaggcgag

SEQ ID NO: 39060 - DNA, 20 bp, Artificial Sequence
  chemically synthesized
gcaaggattcaggggtccat

SEQ ID NO: 39061 - DNA, 20 bp, Artificial Sequence
  chemically synthesized
gaggcaaatctctggagggt

SEQ ID NO: 39062 - DNA, 20 bp, Artificial Sequence
  chemically synthesized
gggtgagagttttgtagtgg

SEQ ID NO: 39063 - DNA, 20 bp, Artificial Sequence
  chemically synthesized
gagttttgtagtgggcatgc

SEQ ID NO: 39064 - DNA, 20 bp, Artificial Sequence
  chemically synthesized
gagtctgatgaaagggaggt

SEQ ID NO: 39065 - DNA, 20 bp, Artificial Sequence
  chemically synthesized
caaagaaaatacagagcagg

SEQ ID NO: 39066 - DNA, 20 bp, Artificial Sequence
  chemically synthesized
gagcaggagaagattaagca

SEQ ID NO: 39067 - DNA, 20 bp, Artificial Sequence
  chemically synthesized
ctagaacaaacttctctgcc

SEQ ID NO: 39068 - DNA, 20 bp, Artificial Sequence
  chemically synthesized
ttctctgccacaggattaac

SEQ ID NO: 39069 - DNA, 20 bp, Artificial Sequence
  chemically synthesized
tgataagctcttttggaaag

SEQ ID NO: 39070 - DNA, 20 bp, Artificial Sequence
  chemically synthesized
tggaatgcccggggagagga

SEQ ID NO: 39071 - DNA, 20 bp, Artificial Sequence
  chemically synthesized
ataaaagtatttttcctatt

SEQ ID NO: 39072 - DNA, 20 bp, Artificial Sequence
  chemically synthesized
agtatttttcctattaaaag

SEQ ID NO: 39073 - DNA, 20 bp, Artificial Sequence
  chemically synthesized
ttcctattaaaagatttgtt

SEQ ID NO: 39074 - DNA, 20 bp, Artificial Sequence
  chemically synthesized
ggaggtgaatcagagaaaca

SEQ ID NO: 39075 - DNA, 20 bp, Artificial Sequence
  chemically synthesized
catcaggttaaaaaaagaaa

SEQ ID NO: 39076 - DNA, 20 bp, Artificial Sequence
  chemically synthesized
gttaaaaaaagaaaaattga

SEQ ID NO: 39077 - DNA, 20 bp, Artificial Sequence
  chemically synthesized
agttaaagggggaaataaat

SEQ ID NO: 39078 - DNA, 20 bp, Artificial Sequence
  chemically synthesized
catttcaaaaacactcttca

SEQ ID NO: 39079 - DNA, 20 bp, Artificial Sequence
  chemically synthesized
aagcaccttattaatttatt

SEQ ID NO: 39080 - DNA, 20 bp, Artificial Sequence
  chemically synthesized
gatattttgatatatctatc

SEQ ID NO: 39081 - DNA, 20 bp, Artificial Sequence
  chemically synthesized
atatctatcaagtgcttttt

SEQ ID NO: 39082 - DNA, 20 bp, Artificial Sequence
  chemically synthesized
agccaatgcctgttcaataa

SEQ ID NO: 39083 - DNA, 20 bp, Artificial Sequence
  chemically synthesized
cctgtattccctagaagtct

SEQ ID NO: 39084 - DNA, 20 bp, Artificial Sequence
  chemically synthesized
aagtctcgctgctttcagag

SEQ ID NO: 39085 - DNA, 20 bp, Artificial Sequence
  chemically synthesized
caaagtggtcaaggttgtcc

SEQ ID NO: 39086 - DNA, 20 bp, Artificial Sequence
  chemically synthesized
gtcctgttgcttaattccat

SEQ ID NO: 39087 - DNA, 20 bp, Artificial Sequence
  chemically synthesized
cagagatggagctggcatct

SEQ ID NO: 39088 - DNA, 20 bp, Artificial Sequence
  chemically synthesized
tttgccacaaccaggcagaa

SEQ ID NO: 39089 - DNA, 20 bp, Artificial Sequence
  chemically synthesized
caggcagaaagcagcttttg

SEQ ID NO: 39090 - DNA, 20 bp, Artificial Sequence
  chemically synthesized
cttttgaacagatttgttgc

SEQ ID NO: 39091 - DNA, 20 bp, Artificial Sequence
  chemically synthesized
tgggcagtattggtcccagg

SEQ ID NO: 39092 - DNA, 20 bp, Artificial Sequence
  chemically synthesized
aaaaatggccttctttgtgg

SEQ ID NO: 39093 - DNA, 20 bp, Artificial Sequence
  chemically synthesized
cttcatatcctccatttttt

SEQ ID NO: 39094 - DNA, 20 bp, Artificial Sequence
  chemically synthesized
taaaggagggaccattcaga

SEQ ID NO: 39095 - DNA, 20 bp, Artificial Sequence
  chemically synthesized
ctccaaggttcatttctaca

SEQ ID NO: 39096 - DNA, 20 bp, Artificial Sequence
  chemically synthesized
gacatggcaatcaagagcaa

SEQ ID NO: 39097 - DNA, 20 bp, Artificial Sequence
  chemically synthesized
caaacatgatttattcttat

SEQ ID NO: 39098 - DNA, 20 bp, Artificial Sequence
  chemically synthesized
gtctggagaatctgaaaccc

SEQ ID NO: 39099 - DNA, 20 bp, Artificial Sequence
  chemically synthesized
tgtacttcttgtattcttaa

SEQ ID NO: 39100 - DNA, 20 bp, Artificial Sequence
  chemically synthesized
atcactgcaaacctctataa

SEQ ID NO: 39101 - DNA, 20 bp, Artificial Sequence
  chemically synthesized
ctacgcattgacttatcttc

SEQ ID NO: 39102 - DNA, 20 bp, Artificial Sequence
  chemically synthesized
cgttgtactttcttccttac

SEQ ID NO: 39103 - DNA, 20 bp, Artificial Sequence
  chemically synthesized
ccactgtttatctcaaactc

SEQ ID NO: 39104 - DNA, 20 bp, Artificial Sequence
  chemically synthesized
tatgggctcaggagggagcg

SEQ ID NO: 39105 - DNA, 20 bp, Artificial Sequence
  chemically synthesized
gccttatggaaaagtggcca

SEQ ID NO: 39106 - DNA, 20 bp, Artificial Sequence
  chemically synthesized
cattttagtcagtgttggct

SEQ ID NO: 39107 - DNA, 20 bp, Artificial Sequence
  chemically synthesized
cagtaccaccgttaatgccc

SEQ ID NO: 39108 - DNA, 20 bp, Artificial Sequence
  chemically synthesized
gcacacagcagggaaagaat

SEQ ID NO: 39109 - DNA, 20 bp, Artificial Sequence
  chemically synthesized
aattccagtttctctttctt

SEQ ID NO: 39110 - DNA, 20 bp, Artificial Sequence
  chemically synthesized
actcttcaccaggcaaggct

SEQ ID NO: 39111 - DNA, 20 bp, Artificial Sequence
  chemically synthesized
acatttccactggctgcact

SEQ ID NO: 39112 - DNA, 20 bp, Artificial Sequence
  chemically synthesized
agggaaggaaaaaagatcct

SEQ ID NO: 39113 - DNA, 20 bp, Artificial Sequence
  chemically synthesized
gaaaaatgtaaaaaggctag

SEQ ID NO: 39114 - DNA, 20 bp, Artificial Sequence
  chemically synthesized
ttggactgtcttccttgctc

SEQ ID NO: 39115 - DNA, 20 bp, Artificial Sequence
  chemically synthesized
ctctagagaaccccgactaa

SEQ ID NO: 39116 - DNA, 20 bp, Artificial Sequence
  chemically synthesized
attaaggatggaattctttc

SEQ ID NO: 39117 - DNA, 20 bp, Artificial Sequence
  chemically synthesized
gttttgggacttctggtgtt

SEQ ID NO: 39118 - DNA, 20 bp, Artificial Sequence
  chemically synthesized
cttctggtgttggctgatta

SEQ ID NO: 39119 - DNA, 20 bp, Artificial Sequence
  chemically synthesized
cactgatagtacttggcctg

SEQ ID NO: 39120 - DNA, 20 bp, Artificial Sequence
  chemically synthesized
aaaataaatgcatttgacac

SEQ ID NO: 39121 - DNA, 20 bp, Artificial Sequence
  chemically synthesized
ttcatcacttatgagaggca

SEQ ID NO: 39122 - DNA, 20 bp, Artificial Sequence
  chemically synthesized
ccaaggaacataatgaagtt

SEQ ID NO: 39123 - DNA, 20 bp, Artificial Sequence
  chemically synthesized
gatactgagccacaaatctg

SEQ ID NO: 39124 - DNA, 20 bp, Artificial Sequence
  chemically synthesized
ctgctaagattgccctgaat

SEQ ID NO: 39125 - DNA, 20 bp, Artificial Sequence
  chemically synthesized
ggtgcatgcacagccttgcc

SEQ ID NO: 39126 - DNA, 20 bp, Artificial Sequence
  chemically synthesized
ccctgatgaagctgaggaca

SEQ ID NO: 39127 - DNA, 20 bp, Artificial Sequence
  chemically synthesized
gaaacttttttgccagaaga

SEQ ID NO: 39128 - DNA, 20 bp, Artificial Sequence
  chemically synthesized
gtctgaggatgtaaaccctg

SEQ ID NO: 39129 - DNA, 20 bp, Artificial Sequence
  chemically synthesized
gcagctgccaggcaagataa

SEQ ID NO: 39130 - DNA, 20 bp, Artificial Sequence
  chemically synthesized
gaggcacccctaatgcccct

SEQ ID NO: 39131 - DNA, 20 bp, Artificial Sequence
  chemically synthesized
ggtgcattatactctaaaag

SEQ ID NO: 39132 - DNA, 20 bp, Artificial Sequence
  chemically synthesized
ttatactctaaaagaactgc

SEQ ID NO: 39133 - DNA, 20 bp, Artificial Sequence
  chemically synthesized
agttggatcaagctgaattt

SEQ ID NO: 39134 - DNA, 20 bp, Artificial Sequence
  chemically synthesized
attggtttggccctactaag

SEQ ID NO: 39135 - DNA, 20 bp, Artificial Sequence
  chemically synthesized
ggcgggcagatcacgagatc

SEQ ID NO: 39136 - DNA, 20 bp, Artificial Sequence
  chemically synthesized
ttgggaggctgaggcaagag

SEQ ID NO: 39137 - DNA, 20 bp, Artificial Sequence
  chemically synthesized
aactgcttgaacctgtgagg

SEQ ID NO: 39138 - DNA, 20 bp, Artificial Sequence
  chemically synthesized
aaaaaaaaaaaaaaagttat

SEQ ID NO: 39139 - DNA, 20 bp, Artificial Sequence
  chemically synthesized
aaaaaaagttataatagttt

SEQ ID NO: 39140 - DNA, 20 bp, Artificial Sequence
  chemically synthesized
atttgcttggttagctgaaa

SEQ ID NO: 39141 - DNA, 20 bp, Artificial Sequence
  chemically synthesized
tgttagtgagctggaaatgc

SEQ ID NO: 39142 - DNA, 20 bp, Artificial Sequence
  chemically synthesized
taatgtagaggaagtgatcc

SEQ ID NO: 39143 - DNA, 20 bp, Artificial Sequence
  chemically synthesized
ggaagtgatccaaaggctta

SEQ ID NO: 39144 - DNA, 20 bp, Artificial Sequence
  chemically synthesized
tagggagattaggatggtgg

SEQ ID NO: 39145 - DNA, 20 bp, Artificial Sequence
  chemically synthesized
ccagaagatacacccttggc

SEQ ID NO: 39146 - DNA, 20 bp, Artificial Sequence
  chemically synthesized
ccttggccgaagctttgtga

SEQ ID NO: 39147 - DNA, 20 bp, Artificial Sequence
  chemically synthesized
gggaaacctactgtattcct

SEQ ID NO: 39148 - DNA, 20 bp, Artificial Sequence
  chemically synthesized
ggacactggctctgagctga

SEQ ID NO: 39149 - DNA, 20 bp, Artificial Sequence
  chemically synthesized
tgtggttccccagttaaagt

SEQ ID NO: 39150 - DNA, 20 bp, Artificial Sequence
  chemically synthesized
tatggaggttaggtaattaa

SEQ ID NO: 39151 - DNA, 20 bp, Artificial Sequence
  chemically synthesized
tcccatccctggagggactg

SEQ ID NO: 39152 - DNA, 20 bp, Artificial Sequence
  chemically synthesized
ggacttgaaagacgcagggg

SEQ ID NO: 39153 - DNA, 20 bp, Artificial Sequence
  chemically synthesized
gatggatcttggaaaatgat

SEQ ID NO: 39154 - DNA, 20 bp, Artificial Sequence
  chemically synthesized
gaaaatgatggtggattatt

SEQ ID NO: 39155 - DNA, 20 bp, Artificial Sequence
  chemically synthesized
attgcagctgctctaccagt

SEQ ID NO: 39156 - DNA, 20 bp, Artificial Sequence
  chemically synthesized
tgctctaccagttgtggttt

SEQ ID NO: 39157 - DNA, 20 bp, Artificial Sequence
  chemically synthesized
ctggtgcctggtatgcagcc

SEQ ID NO: 39158 - DNA, 20 bp, Artificial Sequence
  chemically synthesized
atgcagccattggcttggca

SEQ ID NO: 39159 - DNA, 20 bp, Artificial Sequence
  chemically synthesized
cctcaggggtgtatcaactc

SEQ ID NO: 39160 - DNA, 20 bp, Artificial Sequence
  chemically synthesized
atcttatttggagagacctt

SEQ ID NO: 39161 - DNA, 20 bp, Artificial Sequence
  chemically synthesized
ccattacattcatgacatta

SEQ ID NO: 39162 - DNA, 20 bp, Artificial Sequence
  chemically synthesized
ctaaggtgaagcataacttg

SEQ ID NO: 39163 - DNA, 20 bp, Artificial Sequence
  chemically synthesized
cacaatgcctggtgggccta

SEQ ID NO: 39164 - DNA, 20 bp, Artificial Sequence
  chemically synthesized
gattttggaggcaacacatt

SEQ ID NO: 39165 - DNA, 20 bp, Artificial Sequence
  chemically synthesized
atcgagtgacctgaaaggct

SEQ ID NO: 39166 - DNA, 20 bp, Artificial Sequence
  chemically synthesized
acatgaccccgcagatccaa

SEQ ID NO: 39167 - DNA, 20 bp, Artificial Sequence
  chemically synthesized
gtgtcagtggcagataggga

SEQ ID NO: 39168 - DNA, 20 bp, Artificial Sequence
  chemically synthesized
gtgaatcacagtggagacct

SEQ ID NO: 39169 - DNA, 20 bp, Artificial Sequence
  chemically synthesized
agacagctattggtctgtta

SEQ ID NO: 39170 - DNA, 20 bp, Artificial Sequence
  chemically synthesized
attgggctttggtggtaact

SEQ ID NO: 39171 - DNA, 20 bp, Artificial Sequence
  chemically synthesized
gaacctgcctatcatgaact

SEQ ID NO: 39172 - DNA, 20 bp, Artificial Sequence
  chemically synthesized
ttgaagtggtgtgtatgtga

SEQ ID NO: 39173 - DNA, 20 bp, Artificial Sequence
  chemically synthesized
tttttcctttatcatgtgac

SEQ ID NO: 39174 - DNA, 20 bp, Artificial Sequence
  chemically synthesized
gttaaccttatgtaataact

SEQ ID NO: 39175 - DNA, 20 bp, Artificial Sequence
  chemically synthesized
ttatgtaataacttttggtt

SEQ ID NO: 39176 - DNA, 20 bp, Artificial Sequence
  chemically synthesized
aacttttggtttggggattg

SEQ ID NO: 39177 - DNA, 20 bp, Artificial Sequence
  chemically synthesized
accttattattgtctttatt

SEQ ID NO: 39178 - DNA, 20 bp, Artificial Sequence
  chemically synthesized
tgtctttatttgaagattat

SEQ ID NO: 39179 - DNA, 20 bp, Artificial Sequence
  chemically synthesized
tgtgatggttaatactgtca

SEQ ID NO: 39180 - DNA, 20 bp, Artificial Sequence
  chemically synthesized
tggttaatactgtcaacttg

SEQ ID NO: 39181 - DNA, 20 bp, Artificial Sequence
  chemically synthesized
gtctgtgagggtgtggcaaa

SEQ ID NO: 39182 - DNA, 22 bp, Artificial Sequence
  chemically synthesized
ccagcccactgactcaaatgtt

SEQ ID NO: 39183 - DNA, 22 bp, Artificial Sequence
  chemically synthesized
actcaaatgttaatctcctttt

SEQ ID NO: 39184 - DNA, 22 bp, Artificial Sequence
  chemically synthesized
aaatgttaatctccttttgcca

SEQ ID NO: 39185 - DNA, 22 bp, Artificial Sequence
  chemically synthesized
atctccttttgccacaccctca

SEQ ID NO: 39186 - DNA, 22 bp, Artificial Sequence
  chemically synthesized
cttttgccacaccctcacagac

SEQ ID NO: 39187 - DNA, 22 bp, Artificial Sequence
  chemically synthesized
ttgccacaccctcacagacata

SEQ ID NO: 39188 - DNA, 22 bp, Artificial Sequence
  chemically synthesized
tgccacaccctcacagacataa

SEQ ID NO: 39189 - DNA, 22 bp, Artificial Sequence
  chemically synthesized
gccacaccctcacagacataac

SEQ ID NO: 39190 - DNA, 22 bp, Artificial Sequence
  chemically synthesized
ccacaccctcacagacataacc

SEQ ID NO: 39191 - DNA, 22 bp, Artificial Sequence
  chemically synthesized
acagacataaccgagattaata

SEQ ID NO: 39192 - DNA, 22 bp, Artificial Sequence
  chemically synthesized
atactttgcatctttcaatcca

SEQ ID NO: 39193 - DNA, 22 bp, Artificial Sequence
  chemically synthesized
tgcatctttcaatccaatcaag

SEQ ID NO: 39194 - DNA, 22 bp, Artificial Sequence
  chemically synthesized
gcatctttcaatccaatcaagt

SEQ ID NO: 39195 - DNA, 22 bp, Artificial Sequence
  chemically synthesized
catctttcaatccaatcaagtt

SEQ ID NO: 39196 - DNA, 22 bp, Artificial Sequence
  chemically synthesized
tcaatccaatcaagttgacagt

SEQ ID NO: 39197 - DNA, 22 bp, Artificial Sequence
  chemically synthesized
caatccaatcaagttgacagta

SEQ ID NO: 39198 - DNA, 22 bp, Artificial Sequence
  chemically synthesized
aatccaatcaagttgacagtat

SEQ ID NO: 39199 - DNA, 22 bp, Artificial Sequence
  chemically synthesized
acagtattaaccatcacaagtc

SEQ ID NO: 39200 - DNA, 22 bp, Artificial Sequence
  chemically synthesized
accatcacaagtccaactcctt

SEQ ID NO: 39201 - DNA, 22 bp, Artificial Sequence
  chemically synthesized
cttgtcaacttgaacccataca

SEQ ID NO: 39202 - DNA, 22 bp, Artificial Sequence
  chemically synthesized
gtcaacttgaacccatacacac

SEQ ID NO: 39203 - DNA, 22 bp, Artificial Sequence
  chemically synthesized
tcaacttgaacccatacacaca

SEQ ID NO: 39204 - DNA, 22 bp, Artificial Sequence
  chemically synthesized
gaacccatacacacatcctgaa

SEQ ID NO: 39205 - DNA, 22 bp, Artificial Sequence
  chemically synthesized
aacccatacacacatcctgaaa

SEQ ID NO: 39206 - DNA, 22 bp, Artificial Sequence
  chemically synthesized
aaatcatacataatcttcaaat

SEQ ID NO: 39207 - DNA, 22 bp, Artificial Sequence
  chemically synthesized
caaataaagacaataataaggt

SEQ ID NO: 39208 - DNA, 22 bp, Artificial Sequence
  chemically synthesized
aaataaagacaataataaggtc

SEQ ID NO: 39209 - DNA, 22 bp, Artificial Sequence
  chemically synthesized
tgcctaatataatacaactatc

SEQ ID NO: 39210 - DNA, 22 bp, Artificial Sequence
  chemically synthesized
atataatacaactatcctcata

SEQ ID NO: 39211 - DNA, 22 bp, Artificial Sequence
  chemically synthesized
tcctcatacaaccagaaacgca

SEQ ID NO: 39212 - DNA, 22 bp, Artificial Sequence
  chemically synthesized
atacaaccagaaacgcaccaat

SEQ ID NO: 39213 - DNA, 22 bp, Artificial Sequence
  chemically synthesized
ttacataaggttaacaatattt

SEQ ID NO: 39214 - DNA, 22 bp, Artificial Sequence
  chemically synthesized
cataaggttaacaatatttaaa

SEQ ID NO: 39215 - DNA, 22 bp, Artificial Sequence
  chemically synthesized
acaatatttaaatgctgatatg

SEQ ID NO: 39216 - DNA, 22 bp, Artificial Sequence
  chemically synthesized
aaatgctgatatgaacaacact

SEQ ID NO: 39217 - DNA, 22 bp, Artificial Sequence
  chemically synthesized
aatgctgatatgaacaacactt

SEQ ID NO: 39218 - DNA, 22 bp, Artificial Sequence
  chemically synthesized
atatgaacaacacttaaatgct

SEQ ID NO: 39219 - DNA, 22 bp, Artificial Sequence
  chemically synthesized
aaatgcttaaatgctgatgtga

SEQ ID NO: 39220 - DNA, 22 bp, Artificial Sequence
  chemically synthesized
aatgcttaaatgctgatgtgaa

SEQ ID NO: 39221 - DNA, 22 bp, Artificial Sequence
  chemically synthesized
aaatgctgatgtgaagtccata

SEQ ID NO: 39222 - DNA, 22 bp, Artificial Sequence
  chemically synthesized
aatgctgatgtgaagtccataa

SEQ ID NO: 39223 - DNA, 22 bp, Artificial Sequence
  chemically synthesized
atgtgaagtccataaatctaag

SEQ ID NO: 39224 - DNA, 22 bp, Artificial Sequence
  chemically synthesized
aggtcacatgataaaggaaaaa

SEQ ID NO: 39225 - DNA, 22 bp, Artificial Sequence
  chemically synthesized
tcttagcacaagtgtacacatg

SEQ ID NO: 39226 - DNA, 22 bp, Artificial Sequence
  chemically synthesized
cttagcacaagtgtacacatgc

SEQ ID NO: 39227 - DNA, 22 bp, Artificial Sequence
  chemically synthesized
ttagcacaagtgtacacatgca

SEQ ID NO: 39228 - DNA, 22 bp, Artificial Sequence
  chemically synthesized
agcacaagtgtacacatgcatt

SEQ ID NO: 39229 - DNA, 22 bp, Artificial Sequence
  chemically synthesized
gcacaagtgtacacatgcattt

SEQ ID NO: 39230 - DNA, 22 bp, Artificial Sequence
  chemically synthesized
agaaagtggatatagtgctgca

SEQ ID NO: 39231 - DNA, 22 bp, Artificial Sequence
  chemically synthesized
gaaagtggatatagtgctgcag

SEQ ID NO: 39232 - DNA, 22 bp, Artificial Sequence
  chemically synthesized
cagctgtccactttcgggtggt

SEQ ID NO: 39233 - DNA, 22 bp, Artificial Sequence
  chemically synthesized
tccactttcgggtggtgcctgc

SEQ ID NO: 39234 - DNA, 22 bp, Artificial Sequence
  chemically synthesized
tcgggtggtgcctgcatatcgt

SEQ ID NO: 39235 - DNA, 22 bp, Artificial Sequence
  chemically synthesized
cgggtggtgcctgcatatcgtg

SEQ ID NO: 39236 - DNA, 22 bp, Artificial Sequence
  chemically synthesized
gggtggtgcctgcatatcgtgc

SEQ ID NO: 39237 - DNA, 22 bp, Artificial Sequence
  chemically synthesized
catatcgtgcagaaccatctat

SEQ ID NO: 39238 - DNA, 22 bp, Artificial Sequence
  chemically synthesized
tgaaccagtccttagtcttccc

SEQ ID NO: 39239 - DNA, 22 bp, Artificial Sequence
  chemically synthesized
agtcttcccttcctctgtcaac

SEQ ID NO: 39240 - DNA, 22 bp, Artificial Sequence
  chemically synthesized
gtcttcccttcctctgtcaact

SEQ ID NO: 39241 - DNA, 22 bp, Artificial Sequence
  chemically synthesized
cccttcctctgtcaactgatca

SEQ ID NO: 39242 - DNA, 22 bp, Artificial Sequence
  chemically synthesized
ccttcctctgtcaactgatcat

SEQ ID NO: 39243 - DNA, 22 bp, Artificial Sequence
  chemically synthesized
cctctgtcaactgatcataggg

SEQ ID NO: 39244 - DNA, 22 bp, Artificial Sequence
  chemically synthesized
ctctgtcaactgatcataggga

SEQ ID NO: 39245 - DNA, 22 bp, Artificial Sequence
  chemically synthesized
tgtcaactgatcatagggaact

SEQ ID NO: 39246 - DNA, 22 bp, Artificial Sequence
  chemically synthesized
tcaactgatcatagggaactcc

SEQ ID NO: 39247 - DNA, 22 bp, Artificial Sequence
  chemically synthesized
atcatagggaactccccatgag

SEQ ID NO: 39248 - DNA, 22 bp, Artificial Sequence
  chemically synthesized
cccatgaggccattggtgcagg

SEQ ID NO: 39249 - DNA, 22 bp, Artificial Sequence
  chemically synthesized
gtgcaggctgggggagggaagg

SEQ ID NO: 39250 - DNA, 22 bp, Artificial Sequence
  chemically synthesized
ggggagggaaggcagggtggca

SEQ ID NO: 39251 - DNA, 22 bp, Artificial Sequence
  chemically synthesized
gagccacttccttatgtaactt

SEQ ID NO: 39252 - DNA, 22 bp, Artificial Sequence
  chemically synthesized
agccacttccttatgtaactta

SEQ ID NO: 39253 - DNA, 22 bp, Artificial Sequence
  chemically synthesized
ccttatgtaacttacttgtgcc

SEQ ID NO: 39254 - DNA, 22 bp, Artificial Sequence
  chemically synthesized
cttatgtaacttacttgtgcct

SEQ ID NO: 39255 - DNA, 22 bp, Artificial Sequence
  chemically synthesized
atgtaacttacttgtgccttca

SEQ ID NO: 39256 - DNA, 22 bp, Artificial Sequence
  chemically synthesized
tgtaacttacttgtgccttcag

SEQ ID NO: 39257 - DNA, 22 bp, Artificial Sequence
  chemically synthesized
acttgtgccttcaggacctgct

SEQ ID NO: 39258 - DNA, 22 bp, Artificial Sequence
  chemically synthesized
cttgtgccttcaggacctgctc

SEQ ID NO: 39259 - DNA, 22 bp, Artificial Sequence
  chemically synthesized
gtgccttcaggacctgctcaag

SEQ ID NO: 39260 - DNA, 22 bp, Artificial Sequence
  chemically synthesized
tgccttcaggacctgctcaagc

SEQ ID NO: 39261 - DNA, 22 bp, Artificial Sequence
  chemically synthesized
caggacctgctcaagcccgatc

SEQ ID NO: 39262 - DNA, 22 bp, Artificial Sequence
  chemically synthesized
aggacctgctcaagcccgatca

SEQ ID NO: 39263 - DNA, 22 bp, Artificial Sequence
  chemically synthesized
ctcaagcccgatcacatacaca

SEQ ID NO: 39264 - DNA, 22 bp, Artificial Sequence
  chemically synthesized
aagcccgatcacatacacacca

SEQ ID NO: 39265 - DNA, 22 bp, Artificial Sequence
  chemically synthesized
caatttgatgatgaaatgccgc

SEQ ID NO: 39266 - DNA, 22 bp, Artificial Sequence
  chemically synthesized
aatttgatgatgaaatgccgct

SEQ ID NO: 39267 - DNA, 22 bp, Artificial Sequence
  chemically synthesized
gatgatgaaatgccgctgtgct

SEQ ID NO: 39268 - DNA, 22 bp, Artificial Sequence
  chemically synthesized
atgatgaaatgccgctgtgctg

SEQ ID NO: 39269 - DNA, 22 bp, Artificial Sequence
  chemically synthesized
tgctgacccacttcatggctag

SEQ ID NO: 39270 - DNA, 22 bp, Artificial Sequence
  chemically synthesized
acccacttcatggctagatggg

SEQ ID NO: 39271 - DNA, 22 bp, Artificial Sequence
  chemically synthesized
catggctagatgggtcagaaag

SEQ ID NO: 39272 - DNA, 22 bp, Artificial Sequence
  chemically synthesized
atggctagatgggtcagaaagc

SEQ ID NO: 39273 - DNA, 22 bp, Artificial Sequence
  chemically synthesized
gatgggtcagaaagcaaccagt

SEQ ID NO: 39274 - DNA, 22 bp, Artificial Sequence
  chemically synthesized
atgataggcaggttcaggtagc

SEQ ID NO: 39275 - DNA, 22 bp, Artificial Sequence
  chemically synthesized
aggtagcatggtgactttatga

SEQ ID NO: 39276 - DNA, 22 bp, Artificial Sequence
  chemically synthesized
tatgacccacagtcaaacgttc

SEQ ID NO: 39277 - DNA, 22 bp, Artificial Sequence
  chemically synthesized
atgacccacagtcaaacgttca

SEQ ID NO: 39278 - DNA, 22 bp, Artificial Sequence
  chemically synthesized
tgacccacagtcaaacgttcag

SEQ ID NO: 39279 - DNA, 22 bp, Artificial Sequence
  chemically synthesized
agttaccaccaaagcccaataa

SEQ ID NO: 39280 - DNA, 22 bp, Artificial Sequence
  chemically synthesized
ccaccaaagcccaataacagac

SEQ ID NO: 39281 - DNA, 22 bp, Artificial Sequence
  chemically synthesized
tctctcaaaaggagagtagtta

SEQ ID NO: 39282 - DNA, 22 bp, Artificial Sequence
  chemically synthesized
tcaaaaggagagtagttatctg

SEQ ID NO: 39283 - DNA, 22 bp, Artificial Sequence
  chemically synthesized
aaaaggagagtagttatctgca

SEQ ID NO: 39284 - DNA, 22 bp, Artificial Sequence
  chemically synthesized
tctgcagaagtggcagggcctt

SEQ ID NO: 39285 - DNA, 22 bp, Artificial Sequence
  chemically synthesized
cagaagtggcagggccttgctc

SEQ ID NO: 39286 - DNA, 22 bp, Artificial Sequence
  chemically synthesized
gctccaaaatcctagaggtctc

SEQ ID NO: 39287 - DNA, 22 bp, Artificial Sequence
  chemically synthesized
ctccaaaatcctagaggtctcc

SEQ ID NO: 39288 - DNA, 22 bp, Artificial Sequence
  chemically synthesized
caaaatcctagaggtctccact

SEQ ID NO: 39289 - DNA, 22 bp, Artificial Sequence
  chemically synthesized
gaggtctccactgtgattcacc

SEQ ID NO: 39290 - DNA, 22 bp, Artificial Sequence
  chemically synthesized
cactgtgattcacctatggggg

SEQ ID NO: 39291 - DNA, 22 bp, Artificial Sequence
  chemically synthesized
tgattcacctatgggggcctgc

SEQ ID NO: 39292 - DNA, 22 bp, Artificial Sequence
  chemically synthesized
acctatgggggcctgccaaagg

SEQ ID NO: 39293 - DNA, 22 bp, Artificial Sequence
  chemically synthesized
tgggggcctgccaaaggctcca

SEQ ID NO: 39294 - DNA, 22 bp, Artificial Sequence
  chemically synthesized
ccaaaggctccaaacagcatcc

SEQ ID NO: 39295 - DNA, 22 bp, Artificial Sequence
  chemically synthesized
caaacagcatccctatctgcca

SEQ ID NO: 39296 - DNA, 22 bp, Artificial Sequence
  chemically synthesized
tctgccactgacacctcaagca

SEQ ID NO: 39297 - DNA, 22 bp, Artificial Sequence
  chemically synthesized
ccactgacacctcaagcaccat

SEQ ID NO: 39298 - DNA, 22 bp, Artificial Sequence
  chemically synthesized
acacctcaagcaccattggatc

SEQ ID NO: 39299 - DNA, 22 bp, Artificial Sequence
  chemically synthesized
aagcaccattggatctgcgggg

SEQ ID NO: 39300 - DNA, 22 bp, Artificial Sequence
  chemically synthesized
gatctgcggggtcatgtggccc

SEQ ID NO: 39301 - DNA, 22 bp, Artificial Sequence
  chemically synthesized
cggggtcatgtggcccaaatgg

SEQ ID NO: 39302 - DNA, 22 bp, Artificial Sequence
  chemically synthesized
tcacagcagcctggacctgttt

SEQ ID NO: 39303 - DNA, 22 bp, Artificial Sequence
  chemically synthesized
cacagcagcctggacctgtttc

SEQ ID NO: 39304 - DNA, 22 bp, Artificial Sequence
  chemically synthesized
acagcagcctggacctgtttca

SEQ ID NO: 39305 - DNA, 22 bp, Artificial Sequence
  chemically synthesized
gacctgtttcagagccttcttt

SEQ ID NO: 39306 - DNA, 22 bp, Artificial Sequence
  chemically synthesized
tttcagagccttcttttgttct

SEQ ID NO: 39307 - DNA, 22 bp, Artificial Sequence
  chemically synthesized
cagagccttcttttgttctaga

SEQ ID NO: 39308 - DNA, 22 bp, Artificial Sequence
  chemically synthesized
agagccttcttttgttctagac

SEQ ID NO: 39309 - DNA, 22 bp, Artificial Sequence
  chemically synthesized
cttttgttctagactgcactta

SEQ ID NO: 39310 - DNA, 22 bp, Artificial Sequence
  chemically synthesized
ttttgttctagactgcacttaa

SEQ ID NO: 39311 - DNA, 22 bp, Artificial Sequence
  chemically synthesized
ttgttctagactgcacttaaat

SEQ ID NO: 39312 - DNA, 22 bp, Artificial Sequence
  chemically synthesized
tgttctagactgcacttaaatc

SEQ ID NO: 39313 - DNA, 22 bp, Artificial Sequence
  chemically synthesized
gttctagactgcacttaaatct

SEQ ID NO: 39314 - DNA, 22 bp, Artificial Sequence
  chemically synthesized
ttctagactgcacttaaatctg

SEQ ID NO: 39315 - DNA, 22 bp, Artificial Sequence
  chemically synthesized
tagactgcacttaaatctggca

SEQ ID NO: 39316 - DNA, 22 bp, Artificial Sequence
  chemically synthesized
gactgcacttaaatctggcagc

SEQ ID NO: 39317 - DNA, 22 bp, Artificial Sequence
  chemically synthesized
cacttaaatctggcagcctttc

SEQ ID NO: 39318 - DNA, 22 bp, Artificial Sequence
  chemically synthesized
aaatctggcagcctttcaggtc

SEQ ID NO: 39319 - DNA, 22 bp, Artificial Sequence
  chemically synthesized
aatctggcagcctttcaggtca

SEQ ID NO: 39320 - DNA, 22 bp, Artificial Sequence
  chemically synthesized
gcagcctttcaggtcactcgat

SEQ ID NO: 39321 - DNA, 22 bp, Artificial Sequence
  chemically synthesized
tcaggtcactcgataaatgggc

SEQ ID NO: 39322 - DNA, 22 bp, Artificial Sequence
  chemically synthesized
caggtcactcgataaatgggcc

SEQ ID NO: 39323 - DNA, 22 bp, Artificial Sequence
  chemically synthesized
aggtcactcgataaatgggcca

SEQ ID NO: 39324 - DNA, 22 bp, Artificial Sequence
  chemically synthesized
gataaatgggccagagtaacac

SEQ ID NO: 39325 - DNA, 22 bp, Artificial Sequence
  chemically synthesized
cctccaaaatccaaataggccc

SEQ ID NO: 39326 - DNA, 22 bp, Artificial Sequence
  chemically synthesized
caaaatccaaataggcccacca

SEQ ID NO: 39327 - DNA, 22 bp, Artificial Sequence
  chemically synthesized
tgcctctttcttggttgtaaga

SEQ ID NO: 39328 - DNA, 22 bp, Artificial Sequence
  chemically synthesized
tttcttggttgtaagaggggcc

SEQ ID NO: 39329 - DNA, 22 bp, Artificial Sequence
  chemically synthesized
tcttggttgtaagaggggccaa

SEQ ID NO: 39330 - DNA, 22 bp, Artificial Sequence
  chemically synthesized
cttggttgtaagaggggccaaa

SEQ ID NO: 39331 - DNA, 22 bp, Artificial Sequence
  chemically synthesized
ttggttgtaagaggggccaaac

SEQ ID NO: 39332 - DNA, 22 bp, Artificial Sequence
  chemically synthesized
ggttgtaagaggggccaaacgc

SEQ ID NO: 39333 - DNA, 22 bp, Artificial Sequence
  chemically synthesized
gttgtaagaggggccaaacgca

SEQ ID NO: 39334 - DNA, 22 bp, Artificial Sequence
  chemically synthesized
taagaggggccaaacgcagcaa

SEQ ID NO: 39335 - DNA, 22 bp, Artificial Sequence
  chemically synthesized
tgcttcaccttagaaggaatat

SEQ ID NO: 39336 - DNA, 22 bp, Artificial Sequence
  chemically synthesized
caccttagaaggaatatctcca

SEQ ID NO: 39337 - DNA, 22 bp, Artificial Sequence
  chemically synthesized
accttagaaggaatatctccat

SEQ ID NO: 39338 - DNA, 22 bp, Artificial Sequence
  chemically synthesized
agaaggaatatctccataggtc

SEQ ID NO: 39339 - DNA, 22 bp, Artificial Sequence
  chemically synthesized
gaaggaatatctccataggtct

SEQ ID NO: 39340 - DNA, 22 bp, Artificial Sequence
  chemically synthesized
cataggtctcatgccactggaa

SEQ ID NO: 39341 - DNA, 22 bp, Artificial Sequence
  chemically synthesized
atgccactggaaccctagaaat

SEQ ID NO: 39342 - DNA, 22 bp, Artificial Sequence
  chemically synthesized
gaaccctagaaattttaccgag

SEQ ID NO: 39343 - DNA, 22 bp, Artificial Sequence
  chemically synthesized
gaaattttaccgaggtagaaag

SEQ ID NO: 39344 - DNA, 22 bp, Artificial Sequence
  chemically synthesized
taccgaggtagaaagtccctaa

SEQ ID NO: 39345 - DNA, 22 bp, Artificial Sequence
  chemically synthesized
accgaggtagaaagtccctaaa

SEQ ID NO: 39346 - DNA, 22 bp, Artificial Sequence
  chemically synthesized
ccgaggtagaaagtccctaaat

SEQ ID NO: 39347 - DNA, 22 bp, Artificial Sequence
  chemically synthesized
aattttagctggatttatttcc

SEQ ID NO: 39348 - DNA, 22 bp, Artificial Sequence
  chemically synthesized
tagctggatttatttcccatcc

SEQ ID NO: 39349 - DNA, 22 bp, Artificial Sequence
  chemically synthesized
agctggatttatttcccatcct

SEQ ID NO: 39350 - DNA, 22 bp, Artificial Sequence
  chemically synthesized
gctggatttatttcccatcctc

SEQ ID NO: 39351 - DNA, 22 bp, Artificial Sequence
  chemically synthesized
gatttatttcccatcctctggc

SEQ ID NO: 39352 - DNA, 22 bp, Artificial Sequence
  chemically synthesized
atttcccatcctctggcataca

SEQ ID NO: 39353 - DNA, 22 bp, Artificial Sequence
  chemically synthesized
tttcccatcctctggcatacaa

SEQ ID NO: 39354 - DNA, 22 bp, Artificial Sequence
  chemically synthesized
cccatcctctggcatacaaatg

SEQ ID NO: 39355 - DNA, 22 bp, Artificial Sequence
  chemically synthesized
ccatcctctggcatacaaatgt

SEQ ID NO: 39356 - DNA, 22 bp, Artificial Sequence
  chemically synthesized
tggcatacaaatgtctcaccaa

SEQ ID NO: 39357 - DNA, 22 bp, Artificial Sequence
  chemically synthesized
gcatacaaatgtctcaccaata

SEQ ID NO: 39358 - DNA, 22 bp, Artificial Sequence
  chemically synthesized
accaataagttcagtgtgtttg

SEQ ID NO: 39359 - DNA, 22 bp, Artificial Sequence
  chemically synthesized
agtgtgtttgctacttcttgct

SEQ ID NO: 39360 - DNA, 22 bp, Artificial Sequence
  chemically synthesized
gctacttcttgctcactgtatc

SEQ ID NO: 39361 - DNA, 22 bp, Artificial Sequence
  chemically synthesized
ctacttcttgctcactgtatcc

SEQ ID NO: 39362 - DNA, 22 bp, Artificial Sequence
  chemically synthesized
cttcttgctcactgtatccaat

SEQ ID NO: 39363 - DNA, 22 bp, Artificial Sequence
  chemically synthesized
cttgctcactgtatccaatcat

SEQ ID NO: 39364 - DNA, 22 bp, Artificial Sequence
  chemically synthesized
ttgctcactgtatccaatcatc

SEQ ID NO: 39365 - DNA, 22 bp, Artificial Sequence
  chemically synthesized
gctcactgtatccaatcatcat

SEQ ID NO: 39366 - DNA, 22 bp, Artificial Sequence
  chemically synthesized
ctcactgtatccaatcatcata

SEQ ID NO: 39367 - DNA, 22 bp, Artificial Sequence
  chemically synthesized
actgtatccaatcatcataatg

SEQ ID NO: 39368 - DNA, 22 bp, Artificial Sequence
  chemically synthesized
tatccaatcatcataatgtcat

SEQ ID NO: 39369 - DNA, 22 bp, Artificial Sequence
  chemically synthesized
tatctcgtggaagtgaaaagcg

SEQ ID NO: 39370 - DNA, 22 bp, Artificial Sequence
  chemically synthesized
gtggaagtgaaaagcgagcaag

SEQ ID NO: 39371 - DNA, 22 bp, Artificial Sequence
  chemically synthesized
tccaaataagattatgacacaa

SEQ ID NO: 39372 - DNA, 22 bp, Artificial Sequence
  chemically synthesized
caaataagattatgacacaaag

SEQ ID NO: 39373 - DNA, 22 bp, Artificial Sequence
  chemically synthesized
tgacacaaagctggagagttga

SEQ ID NO: 39374 - DNA, 22 bp, Artificial Sequence
  chemically synthesized
gagagttgatacacccctgagg

SEQ ID NO: 39375 - DNA, 22 bp, Artificial Sequence
  chemically synthesized
atacacccctgaggtagggtgg

SEQ ID NO: 39376 - DNA, 22 bp, Artificial Sequence
  chemically synthesized
aggtagggtggtaaaggtataa

SEQ ID NO: 39377 - DNA, 22 bp, Artificial Sequence
  chemically synthesized
gccttgtcagctgaaggcaaat

SEQ ID NO: 39378 - DNA, 22 bp, Artificial Sequence
  chemically synthesized
gtcagctgaaggcaaattgctt

SEQ ID NO: 39379 - DNA, 22 bp, Artificial Sequence
  chemically synthesized
tcagctgaaggcaaattgcttc

SEQ ID NO: 39380 - DNA, 22 bp, Artificial Sequence
  chemically synthesized
aaggcaaattgcttctggtggg

SEQ ID NO: 39381 - DNA, 22 bp, Artificial Sequence
  chemically synthesized
cttctggtgggtcttatggaca

SEQ ID NO: 39382 - DNA, 22 bp, Artificial Sequence
  chemically synthesized
ctggtgggtcttatggacagga

SEQ ID NO: 39383 - DNA, 22 bp, Artificial Sequence
  chemically synthesized
tggtgggtcttatggacaggaa

SEQ ID NO: 39384 - DNA, 22 bp, Artificial Sequence
  chemically synthesized
gtgggtcttatggacaggaatg

SEQ ID NO: 39385 - DNA, 22 bp, Artificial Sequence
  chemically synthesized
atggacaggaatggagaaaaag

SEQ ID NO: 39386 - DNA, 22 bp, Artificial Sequence
  chemically synthesized
tggacaggaatggagaaaaagc

SEQ ID NO: 39387 - DNA, 22 bp, Artificial Sequence
  chemically synthesized
gccaagccaatggctgcatacc

SEQ ID NO: 39388 - DNA, 22 bp, Artificial Sequence
  chemically synthesized
ccaagccaatggctgcatacca

SEQ ID NO: 39389 - DNA, 22 bp, Artificial Sequence
  chemically synthesized
cataccaggcaccaggagatgt

SEQ ID NO: 39390 - DNA, 22 bp, Artificial Sequence
  chemically synthesized
atttgctcaagcaacaaaacca

SEQ ID NO: 39391 - DNA, 22 bp, Artificial Sequence
  chemically synthesized
gctcaagcaacaaaaccacaac

SEQ ID NO: 39392 - DNA, 22 bp, Artificial Sequence
  chemically synthesized
ctcaagcaacaaaaccacaact

SEQ ID NO: 39393 - DNA, 22 bp, Artificial Sequence
  chemically synthesized
aagcaacaaaaccacaactggt

SEQ ID NO: 39394 - DNA, 22 bp, Artificial Sequence
  chemically synthesized
gtagagcagctgcaattggagt

SEQ ID NO: 39395 - DNA, 22 bp, Artificial Sequence
  chemically synthesized
caattggagtcaccacttggtt

SEQ ID NO: 39396 - DNA, 22 bp, Artificial Sequence
  chemically synthesized
gagtcaccacttggttaagctt

SEQ ID NO: 39397 - DNA, 22 bp, Artificial Sequence
  chemically synthesized
ggttaagcttaaaataatccac

SEQ ID NO: 39398 - DNA, 22 bp, Artificial Sequence
  chemically synthesized
gttaagcttaaaataatccacc

SEQ ID NO: 39399 - DNA, 22 bp, Artificial Sequence
  chemically synthesized
agcttaaaataatccaccatca

SEQ ID NO: 39400 - DNA, 22 bp, Artificial Sequence
  chemically synthesized
aaaataatccaccatcattttc

SEQ ID NO: 39401 - DNA, 22 bp, Artificial Sequence
  chemically synthesized
aaataatccaccatcattttcc

SEQ ID NO: 39402 - DNA, 22 bp, Artificial Sequence
  chemically synthesized
tccaagatccatctgtcctctg

SEQ ID NO: 39403 - DNA, 22 bp, Artificial Sequence
  chemically synthesized
ccaagatccatctgtcctctgc

SEQ ID NO: 39404 - DNA, 22 bp, Artificial Sequence
  chemically synthesized
caagatccatctgtcctctgca

SEQ ID NO: 39405 - DNA, 22 bp, Artificial Sequence
  chemically synthesized
tcctctgcacaggtcaaatggg

SEQ ID NO: 39406 - DNA, 22 bp, Artificial Sequence
  chemically synthesized
tgcacaggtcaaatgggagagt

SEQ ID NO: 39407 - DNA, 22 bp, Artificial Sequence
  chemically synthesized
cacaggtcaaatgggagagttg

SEQ ID NO: 39408 - DNA, 22 bp, Artificial Sequence
  chemically synthesized
aacagggatgtggtgggaatca

SEQ ID NO: 39409 - DNA, 22 bp, Artificial Sequence
  chemically synthesized
cgtctttcaagtccttgatggt

SEQ ID NO: 39410 - DNA, 22 bp, Artificial Sequence
  chemically synthesized
tcaagtccttgatggtgacact

SEQ ID NO: 39411 - DNA, 22 bp, Artificial Sequence
  chemically synthesized
caagtccttgatggtgacacta

SEQ ID NO: 39412 - DNA, 22 bp, Artificial Sequence
  chemically synthesized
aagtccttgatggtgacactaa

SEQ ID NO: 39413 - DNA, 22 bp, Artificial Sequence
  chemically synthesized
gatggtgacactaatcacttca

SEQ ID NO: 39414 - DNA, 22 bp, Artificial Sequence
  chemically synthesized
atggtgacactaatcacttcag

SEQ ID NO: 39415 - DNA, 22 bp, Artificial Sequence
  chemically synthesized
atcacttcagtccctccaggga

SEQ ID NO: 39416 - DNA, 22 bp, Artificial Sequence
  chemically synthesized
cagtccctccagggatgggata

SEQ ID NO: 39417 - DNA, 22 bp, Artificial Sequence
  chemically synthesized
agtccctccagggatgggatat

SEQ ID NO: 39418 - DNA, 22 bp, Artificial Sequence
  chemically synthesized
cagggatgggatattgtttttg

SEQ ID NO: 39419 - DNA, 22 bp, Artificial Sequence
  chemically synthesized
tttttgatttttttatttttct

SEQ ID NO: 39420 - DNA, 22 bp, Artificial Sequence
  chemically synthesized
ttgatttttttatttttctagg

SEQ ID NO: 39421 - DNA, 22 bp, Artificial Sequence
  chemically synthesized
tgatttttttatttttctaggt

SEQ ID NO: 39422 - DNA, 22 bp, Artificial Sequence
  chemically synthesized
gatttttttatttttctaggta

SEQ ID NO: 39423 - DNA, 22 bp, Artificial Sequence
  chemically synthesized
atttttttatttttctaggtag

SEQ ID NO: 39424 - DNA, 22 bp, Artificial Sequence
  chemically synthesized
ttttatttttctaggtagagac

SEQ ID NO: 39425 - DNA, 22 bp, Artificial Sequence
  chemically synthesized
tttatttttctaggtagagaca

SEQ ID NO: 39426 - DNA, 22 bp, Artificial Sequence
  chemically synthesized
ttatttttctaggtagagacag

SEQ ID NO: 39427 - DNA, 22 bp, Artificial Sequence
  chemically synthesized
tatttttctaggtagagacagc

SEQ ID NO: 39428 - DNA, 22 bp, Artificial Sequence
  chemically synthesized
atttttctaggtagagacagct

SEQ ID NO: 39429 - DNA, 22 bp, Artificial Sequence
  chemically synthesized
tttttctaggtagagacagctc

SEQ ID NO: 39430 - DNA, 22 bp, Artificial Sequence
  chemically synthesized
ttctaggtagagacagctctaa

SEQ ID NO: 39431 - DNA, 22 bp, Artificial Sequence
  chemically synthesized
tctaggtagagacagctctaat

SEQ ID NO: 39432 - DNA, 22 bp, Artificial Sequence
  chemically synthesized
ctaggtagagacagctctaatg

SEQ ID NO: 39433 - DNA, 22 bp, Artificial Sequence
  chemically synthesized
taggtagagacagctctaatgg

SEQ ID NO: 39434 - DNA, 22 bp, Artificial Sequence
  chemically synthesized
ggtagagacagctctaatggct

SEQ ID NO: 39435 - DNA, 22 bp, Artificial Sequence
  chemically synthesized
taatggcttctgtttggccttt

SEQ ID NO: 39436 - DNA, 22 bp, Artificial Sequence
  chemically synthesized
atggcttctgtttggcctttcc

SEQ ID NO: 39437 - DNA, 22 bp, Artificial Sequence
  chemically synthesized
ctgtttggcctttcccaccata

SEQ ID NO: 39438 - DNA, 22 bp, Artificial Sequence
  chemically synthesized
tgtttggcctttcccaccataa

SEQ ID NO: 39439 - DNA, 22 bp, Artificial Sequence
  chemically synthesized
tttggcctttcccaccataata

SEQ ID NO: 39440 - DNA, 22 bp, Artificial Sequence
  chemically synthesized
ggcctttcccaccataatagcc

SEQ ID NO: 39441 - DNA, 22 bp, Artificial Sequence
  chemically synthesized
gcctttcccaccataatagccc

SEQ ID NO: 39442 - DNA, 22 bp, Artificial Sequence
  chemically synthesized
tcccaccataatagccctcatc

SEQ ID NO: 39443 - DNA, 22 bp, Artificial Sequence
  chemically synthesized
cccaccataatagccctcatcc

SEQ ID NO: 39444 - DNA, 22 bp, Artificial Sequence
  chemically synthesized
ccaccataatagccctcatcct

SEQ ID NO: 39445 - DNA, 22 bp, Artificial Sequence
  chemically synthesized
atcctaccagtcagggagccaa

SEQ ID NO: 39446 - DNA, 22 bp, Artificial Sequence
  chemically synthesized
ccagtcagggagccaatgtggc

SEQ ID NO: 39447 - DNA, 22 bp, Artificial Sequence
  chemically synthesized
ctgccagctaataagtatgtct

SEQ ID NO: 39448 - DNA, 22 bp, Artificial Sequence
  chemically synthesized
tgccagctaataagtatgtcta

SEQ ID NO: 39449 - DNA, 22 bp, Artificial Sequence
  chemically synthesized
ccagctaataagtatgtctata

SEQ ID NO: 39450 - DNA, 22 bp, Artificial Sequence
  chemically synthesized
ataagtatgtctatacaaatta

SEQ ID NO: 39451 - DNA, 22 bp, Artificial Sequence
  chemically synthesized
tacaaattatgcattttggcac

SEQ ID NO: 39452 - DNA, 22 bp, Artificial Sequence
  chemically synthesized
tgcattttggcactgggaaaat

SEQ ID NO: 39453 - DNA, 22 bp, Artificial Sequence
  chemically synthesized
tggcactgggaaaatgaccaga

SEQ ID NO: 39454 - DNA, 22 bp, Artificial Sequence
  chemically synthesized
ggcactgggaaaatgaccagag

SEQ ID NO: 39455 - DNA, 22 bp, Artificial Sequence
  chemically synthesized
gcactgggaaaatgaccagagg

SEQ ID NO: 39456 - DNA, 22 bp, Artificial Sequence
  chemically synthesized
ggaaaatgaccagaggataagt

SEQ ID NO: 39457 - DNA, 22 bp, Artificial Sequence
  chemically synthesized
gaaccactgtaagtcagaaatg

SEQ ID NO: 39458 - DNA, 22 bp, Artificial Sequence
  chemically synthesized
taagtcagaaatgagctaaaac

SEQ ID NO: 39459 - DNA, 22 bp, Artificial Sequence
  chemically synthesized
aaactccattaattacctaacc

SEQ ID NO: 39460 - DNA, 22 bp, Artificial Sequence
  chemically synthesized
cattaattacctaacctccata

SEQ ID NO: 39461 - DNA, 22 bp, Artificial Sequence
  chemically synthesized
attacctaacctccataagccc

SEQ ID NO: 39462 - DNA, 22 bp, Artificial Sequence
  chemically synthesized
cctaacctccataagcccctac

SEQ ID NO: 39463 - DNA, 22 bp, Artificial Sequence
  chemically synthesized
acctccataagcccctacttta

SEQ ID NO: 39464 - DNA, 22 bp, Artificial Sequence
  chemically synthesized
cataagcccctactttaactgg

SEQ ID NO: 39465 - DNA, 22 bp, Artificial Sequence
  chemically synthesized
ctttaactggggaaccacaata

SEQ ID NO: 39466 - DNA, 22 bp, Artificial Sequence
  chemically synthesized
taactggggaaccacaataacg

SEQ ID NO: 39467 - DNA, 22 bp, Artificial Sequence
  chemically synthesized
aactggggaaccacaataacgt

SEQ ID NO: 39468 - DNA, 22 bp, Artificial Sequence
  chemically synthesized
actggggaaccacaataacgtt

SEQ ID NO: 39469 - DNA, 22 bp, Artificial Sequence
  chemically synthesized
gggaaccacaataacgttttgg

SEQ ID NO: 39470 - DNA, 22 bp, Artificial Sequence
  chemically synthesized
tgggtaccctggaatcaacgtc

SEQ ID NO: 39471 - DNA, 22 bp, Artificial Sequence
  chemically synthesized
gggtaccctggaatcaacgtca

SEQ ID NO: 39472 - DNA, 22 bp, Artificial Sequence
  chemically synthesized
ggtaccctggaatcaacgtcag

SEQ ID NO: 39473 - DNA, 22 bp, Artificial Sequence
  chemically synthesized
gaatcaacgtcagctcagagcc

SEQ ID NO: 39474 - DNA, 22 bp, Artificial Sequence
  chemically synthesized
agagccagtgtccagtactttc

SEQ ID NO: 39475 - DNA, 22 bp, Artificial Sequence
  chemically synthesized
tctgaaatgtctcattacttcc

SEQ ID NO: 39476 - DNA, 22 bp, Artificial Sequence
  chemically synthesized
ctgaaatgtctcattacttccc

SEQ ID NO: 39477 - DNA, 22 bp, Artificial Sequence
  chemically synthesized
tgaaatgtctcattacttccct

SEQ ID NO: 39478 - DNA, 22 bp, Artificial Sequence
  chemically synthesized
aaatgtctcattacttcccttt

SEQ ID NO: 39479 - DNA, 22 bp, Artificial Sequence
  chemically synthesized
attacttccctttctccagtac

SEQ ID NO: 39480 - DNA, 22 bp, Artificial Sequence
  chemically synthesized
cttccctttctccagtacacac

SEQ ID NO: 39481 - DNA, 22 bp, Artificial Sequence
  chemically synthesized
ccctttctccagtacacacagt

SEQ ID NO: 39482 - DNA, 22 bp, Artificial Sequence
  chemically synthesized
cctttctccagtacacacagtt

SEQ ID NO: 39483 - DNA, 22 bp, Artificial Sequence
  chemically synthesized
tctccagtacacacagttaccc

SEQ ID NO: 39484 - DNA, 22 bp, Artificial Sequence
  chemically synthesized
ctccagtacacacagttaccct

SEQ ID NO: 39485 - DNA, 22 bp, Artificial Sequence
  chemically synthesized
tccagtacacacagttaccctg

SEQ ID NO: 39486 - DNA, 22 bp, Artificial Sequence
  chemically synthesized
cagtacacacagttaccctggt

SEQ ID NO: 39487 - DNA, 22 bp, Artificial Sequence
  chemically synthesized
ccctggtaaaaggccagaggtc

SEQ ID NO: 39488 - DNA, 22 bp, Artificial Sequence
  chemically synthesized
gtaaaaggccagaggtctcctt

SEQ ID NO: 39489 - DNA, 22 bp, Artificial Sequence
  chemically synthesized
cttagggaaggatgggagaaag

SEQ ID NO: 39490 - DNA, 22 bp, Artificial Sequence
  chemically synthesized
agggaaggatgggagaaagagt

SEQ ID NO: 39491 - DNA, 22 bp, Artificial Sequence
  chemically synthesized
gggaaggatgggagaaagagta

SEQ ID NO: 39492 - DNA, 22 bp, Artificial Sequence
  chemically synthesized
tcagtagcctagtggtgtcctt

SEQ ID NO: 39493 - DNA, 22 bp, Artificial Sequence
  chemically synthesized
gtggtgtccttcctcaagggga

SEQ ID NO: 39494 - DNA, 22 bp, Artificial Sequence
  chemically synthesized
cctcaaggggatccagcctccc

SEQ ID NO: 39495 - DNA, 22 bp, Artificial Sequence
  chemically synthesized
ctcaaggggatccagcctcccc

SEQ ID NO: 39496 - DNA, 22 bp, Artificial Sequence
  chemically synthesized
aaggggatccagcctccccttc

SEQ ID NO: 39497 - DNA, 22 bp, Artificial Sequence
  chemically synthesized
cccttcattcagtgggttctgg

SEQ ID NO: 39498 - DNA, 22 bp, Artificial Sequence
  chemically synthesized
cattcagtgggttctggaactg

SEQ ID NO: 39499 - DNA, 22 bp, Artificial Sequence
  chemically synthesized
attcagtgggttctggaactgt

SEQ ID NO: 39500 - DNA, 22 bp, Artificial Sequence
  chemically synthesized
agtgggttctggaactgtaaca

SEQ ID NO: 39501 - DNA, 22 bp, Artificial Sequence
  chemically synthesized
tggaactgtaacaggttcgagt

SEQ ID NO: 39502 - DNA, 22 bp, Artificial Sequence
  chemically synthesized
gaactgtaacaggttcgagtct

SEQ ID NO: 39503 - DNA, 22 bp, Artificial Sequence
  chemically synthesized
taacaggttcgagtctggaaat

SEQ ID NO: 39504 - DNA, 22 bp, Artificial Sequence
  chemically synthesized
gagtctggaaattgattgaggg

SEQ ID NO: 39505 - DNA, 22 bp, Artificial Sequence
  chemically synthesized
gaaattgattgagggcccatga

SEQ ID NO: 39506 - DNA, 22 bp, Artificial Sequence
  chemically synthesized
attgagggcccatgattctctg

SEQ ID NO: 39507 - DNA, 22 bp, Artificial Sequence
  chemically synthesized
agggcccatgattctctgtttt

SEQ ID NO: 39508 - DNA, 22 bp, Artificial Sequence
  chemically synthesized
tctgtttttataattcagatta

SEQ ID NO: 39509 - DNA, 22 bp, Artificial Sequence
  chemically synthesized
tgtttttataattcagattagt

SEQ ID NO: 39510 - DNA, 22 bp, Artificial Sequence
  chemically synthesized
tttttataattcagattagtct

SEQ ID NO: 39511 - DNA, 22 bp, Artificial Sequence
  chemically synthesized
ttataattcagattagtcttta

SEQ ID NO: 39512 - DNA, 22 bp, Artificial Sequence
  chemically synthesized
tataattcagattagtctttag

SEQ ID NO: 39513 - DNA, 22 bp, Artificial Sequence
  chemically synthesized
ataattcagattagtctttagt

SEQ ID NO: 39514 - DNA, 22 bp, Artificial Sequence
  chemically synthesized
taattcagattagtctttagtc

SEQ ID NO: 39515 - DNA, 22 bp, Artificial Sequence
  chemically synthesized
agattagtctttagtccattct

SEQ ID NO: 39516 - DNA, 22 bp, Artificial Sequence
  chemically synthesized
gtctttagtccattctacctgg

SEQ ID NO: 39517 - DNA, 22 bp, Artificial Sequence
  chemically synthesized
tagtccattctacctggcagtt

SEQ ID NO: 39518 - DNA, 22 bp, Artificial Sequence
  chemically synthesized
agtccattctacctggcagttt

SEQ ID NO: 39519 - DNA, 22 bp, Artificial Sequence
  chemically synthesized
gtccattctacctggcagtttt

SEQ ID NO: 39520 - DNA, 22 bp, Artificial Sequence
  chemically synthesized
tacctggcagttttttgtttat

SEQ ID NO: 39521 - DNA, 22 bp, Artificial Sequence
  chemically synthesized
cctggcagttttttgtttatat

SEQ ID NO: 39522 - DNA, 22 bp, Artificial Sequence
  chemically synthesized
gcagttttttgtttatataaat

SEQ ID NO: 39523 - DNA, 22 bp, Artificial Sequence
  chemically synthesized
tttgtttatataaatcaagtag

SEQ ID NO: 39524 - DNA, 22 bp, Artificial Sequence
  chemically synthesized
ttgtttatataaatcaagtagg

SEQ ID NO: 39525 - DNA, 22 bp, Artificial Sequence
  chemically synthesized
tgtttatataaatcaagtagga

SEQ ID NO: 39526 - DNA, 22 bp, Artificial Sequence
  chemically synthesized
gtttatataaatcaagtaggaa

SEQ ID NO: 39527 - DNA, 22 bp, Artificial Sequence
  chemically synthesized
tttatataaatcaagtaggaat

SEQ ID NO: 39528 - DNA, 22 bp, Artificial Sequence
  chemically synthesized
atataaatcaagtaggaataca

SEQ ID NO: 39529 - DNA, 22 bp, Artificial Sequence
  chemically synthesized
tataaatcaagtaggaatacag

SEQ ID NO: 39530 - DNA, 22 bp, Artificial Sequence
  chemically synthesized
cccatcaatttcacttctagga

SEQ ID NO: 39531 - DNA, 22 bp, Artificial Sequence
  chemically synthesized
ccatcaatttcacttctaggaa

SEQ ID NO: 39532 - DNA, 22 bp, Artificial Sequence
  chemically synthesized
cacttctaggaacaccatgatt

SEQ ID NO: 39533 - DNA, 22 bp, Artificial Sequence
  chemically synthesized
acttctaggaacaccatgatta

SEQ ID NO: 39534 - DNA, 22 bp, Artificial Sequence
  chemically synthesized
ctaggaacaccatgattaatta

SEQ ID NO: 39535 - DNA, 22 bp, Artificial Sequence
  chemically synthesized
taggaacaccatgattaattag

SEQ ID NO: 39536 - DNA, 22 bp, Artificial Sequence
  chemically synthesized
ggaacaccatgattaattagcc

SEQ ID NO: 39537 - DNA, 22 bp, Artificial Sequence
  chemically synthesized
attagccaatgccagagctcta

SEQ ID NO: 39538 - DNA, 22 bp, Artificial Sequence
  chemically synthesized
gccaatgccagagctctacatg

SEQ ID NO: 39539 - DNA, 22 bp, Artificial Sequence
  chemically synthesized
tacatgagtcagactattctga

SEQ ID NO: 39540 - DNA, 22 bp, Artificial Sequence
  chemically synthesized
catgagtcagactattctgatg

SEQ ID NO: 39541 - DNA, 22 bp, Artificial Sequence
  chemically synthesized
ttctgatggctgctttgcctct

SEQ ID NO: 39542 - DNA, 22 bp, Artificial Sequence
  chemically synthesized
tgatggctgctttgcctctgct

SEQ ID NO: 39543 - DNA, 22 bp, Artificial Sequence
  chemically synthesized
atggctgctttgcctctgctgt

SEQ ID NO: 39544 - DNA, 22 bp, Artificial Sequence
  chemically synthesized
ctttgcctctgctgtctattat

SEQ ID NO: 39545 - DNA, 22 bp, Artificial Sequence
  chemically synthesized
tgcctctgctgtctattatggt

SEQ ID NO: 39546 - DNA, 22 bp, Artificial Sequence
  chemically synthesized
gcctctgctgtctattatggta

SEQ ID NO: 39547 - DNA, 22 bp, Artificial Sequence
  chemically synthesized
cctctgctgtctattatggtag

SEQ ID NO: 39548 - DNA, 22 bp, Artificial Sequence
  chemically synthesized
tgctgtctattatggtagttat

SEQ ID NO: 39549 - DNA, 22 bp, Artificial Sequence
  chemically synthesized
ctgtctattatggtagttatgc

SEQ ID NO: 39550 - DNA, 22 bp, Artificial Sequence
  chemically synthesized
tctattatggtagttatgccca

SEQ ID NO: 39551 - DNA, 22 bp, Artificial Sequence
  chemically synthesized
ttatggtagttatgcccacctt

SEQ ID NO: 39552 - DNA, 22 bp, Artificial Sequence
  chemically synthesized
tggtagttatgcccaccttgcc

SEQ ID NO: 39553 - DNA, 22 bp, Artificial Sequence
  chemically synthesized
tgcccaccttgcctttgatggt

SEQ ID NO: 39554 - DNA, 22 bp, Artificial Sequence
  chemically synthesized
gcctttgatggttcagtgccaa

SEQ ID NO: 39555 - DNA, 22 bp, Artificial Sequence
  chemically synthesized
cctttgatggttcagtgccaac

SEQ ID NO: 39556 - DNA, 22 bp, Artificial Sequence
  chemically synthesized
tgatggttcagtgccaacactt

SEQ ID NO: 39557 - DNA, 22 bp, Artificial Sequence
  chemically synthesized
gatggttcagtgccaacacttg

SEQ ID NO: 39558 - DNA, 22 bp, Artificial Sequence
  chemically synthesized
atggttcagtgccaacacttgg

SEQ ID NO: 39559 - DNA, 22 bp, Artificial Sequence
  chemically synthesized
agtgccaacacttggcccctgc

SEQ ID NO: 39560 - DNA, 22 bp, Artificial Sequence
  chemically synthesized
ggcccctgccacctcaggatcc

SEQ ID NO: 39561 - DNA, 22 bp, Artificial Sequence
  chemically synthesized
gcccctgccacctcaggatcca

SEQ ID NO: 39562 - DNA, 22 bp, Artificial Sequence
  chemically synthesized
ccacctcaggatccaattattc

SEQ ID NO: 39563 - DNA, 22 bp, Artificial Sequence
  chemically synthesized
aggatccaattattcccattgt

SEQ ID NO: 39564 - DNA, 22 bp, Artificial Sequence
  chemically synthesized
ttcccattgtatttaaattttg

SEQ ID NO: 39565 - DNA, 22 bp, Artificial Sequence
  chemically synthesized
ccattgtatttaaattttgtag

SEQ ID NO: 39566 - DNA, 22 bp, Artificial Sequence
  chemically synthesized
tatttaaattttgtagttgagt

SEQ ID NO: 39567 - DNA, 22 bp, Artificial Sequence
  chemically synthesized
aaattttgtagttgagtgactg

SEQ ID NO: 39568 - DNA, 22 bp, Artificial Sequence
  chemically synthesized
aattttgtagttgagtgactgt

SEQ ID NO: 39569 - DNA, 22 bp, Artificial Sequence
  chemically synthesized
tgtagttgagtgactgtggttc

SEQ ID NO: 39570 - DNA, 22 bp, Artificial Sequence
  chemically synthesized
gtagttgagtgactgtggttcc

SEQ ID NO: 39571 - DNA, 22 bp, Artificial Sequence
  chemically synthesized
tagttgagtgactgtggttcct

SEQ ID NO: 39572 - DNA, 22 bp, Artificial Sequence
  chemically synthesized
agtgactgtggttcctactgtt

SEQ ID NO: 39573 - DNA, 22 bp, Artificial Sequence
  chemically synthesized
tggttcctactgttagatctga

SEQ ID NO: 39574 - DNA, 22 bp, Artificial Sequence
  chemically synthesized
ctactgttagatctgacataca

SEQ ID NO: 39575 - DNA, 22 bp, Artificial Sequence
  chemically synthesized
ctgttagatctgacatacagag

SEQ ID NO: 39576 - DNA, 22 bp, Artificial Sequence
  chemically synthesized
ttagatctgacatacagagaag

SEQ ID NO: 39577 - DNA, 22 bp, Artificial Sequence
  chemically synthesized
gatctgacatacagagaagagc

SEQ ID NO: 39578 - DNA, 22 bp, Artificial Sequence
  chemically synthesized
acatacagagaagagcaattac

SEQ ID NO: 39579 - DNA, 22 bp, Artificial Sequence
  chemically synthesized
cgggctcttcaaaaatacaggt

SEQ ID NO: 39580 - DNA, 22 bp, Artificial Sequence
  chemically synthesized
ttcaaaaatacaggtgctgctc

SEQ ID NO: 39581 - DNA, 22 bp, Artificial Sequence
  chemically synthesized
caaaaatacaggtgctgctctc

SEQ ID NO: 39582 - DNA, 22 bp, Artificial Sequence
  chemically synthesized
aaaaatacaggtgctgctctca

SEQ ID NO: 39583 - DNA, 22 bp, Artificial Sequence
  chemically synthesized
ctctcacaaatctatttcacaa

SEQ ID NO: 39584 - DNA, 22 bp, Artificial Sequence
  chemically synthesized
tcacaaatctatttcacaaagc

SEQ ID NO: 39585 - DNA, 22 bp, Artificial Sequence
  chemically synthesized
acaaatctatttcacaaagctt

SEQ ID NO: 39586 - DNA, 22 bp, Artificial Sequence
  chemically synthesized
tttcacaaagcttcggccaagg

SEQ ID NO: 39587 - DNA, 22 bp, Artificial Sequence
  chemically synthesized
cacaaagcttcggccaagggtg

SEQ ID NO: 39588 - DNA, 22 bp, Artificial Sequence
  chemically synthesized
acaaagcttcggccaagggtgt

SEQ ID NO: 39589 - DNA, 22 bp, Artificial Sequence
  chemically synthesized
cggccaagggtgtatcttctgg

SEQ ID NO: 39590 - DNA, 22 bp, Artificial Sequence
  chemically synthesized
ggccaagggtgtatcttctgga

SEQ ID NO: 39591 - DNA, 22 bp, Artificial Sequence
  chemically synthesized
ctggaccctcccagctgggatg

SEQ ID NO: 39592 - DNA, 22 bp, Artificial Sequence
  chemically synthesized
tggaccctcccagctgggatga

SEQ ID NO: 39593 - DNA, 22 bp, Artificial Sequence
  chemically synthesized
gaccctcccagctgggatgagt

SEQ ID NO: 39594 - DNA, 22 bp, Artificial Sequence
  chemically synthesized
ccagctgggatgagtaggtcta

SEQ ID NO: 39595 - DNA, 22 bp, Artificial Sequence
  chemically synthesized
ggatgagtaggtctaaagtgac

SEQ ID NO: 39596 - DNA, 22 bp, Artificial Sequence
  chemically synthesized
aagtgactaatccactccacca

SEQ ID NO: 39597 - DNA, 22 bp, Artificial Sequence
  chemically synthesized
atccactccaccatcctaatct

SEQ ID NO: 39598 - DNA, 22 bp, Artificial Sequence
  chemically synthesized
caccatcctaatctccctaagc

SEQ ID NO: 39599 - DNA, 22 bp, Artificial Sequence
  chemically synthesized
atctccctaagcctttggatca

SEQ ID NO: 39600 - DNA, 22 bp, Artificial Sequence
  chemically synthesized
cctaagcctttggatcacttcc

SEQ ID NO: 39601 - DNA, 22 bp, Artificial Sequence
  chemically synthesized
agcctttggatcacttcctcta

SEQ ID NO: 39602 - DNA, 22 bp, Artificial Sequence
  chemically synthesized
tggatcacttcctctacattaa

SEQ ID NO: 39603 - DNA, 22 bp, Artificial Sequence
  chemically synthesized
ggatcacttcctctacattaaa

SEQ ID NO: 39604 - DNA, 22 bp, Artificial Sequence
  chemically synthesized
gatcacttcctctacattaaac

SEQ ID NO: 39605 - DNA, 22 bp, Artificial Sequence
  chemically synthesized
cctctacattaaaccaaggcat

SEQ ID NO: 39606 - DNA, 22 bp, Artificial Sequence
  chemically synthesized
ctctacattaaaccaaggcatt

SEQ ID NO: 39607 - DNA, 22 bp, Artificial Sequence
  chemically synthesized
tacattaaaccaaggcatttcc

SEQ ID NO: 39608 - DNA, 22 bp, Artificial Sequence
  chemically synthesized
cattaaaccaaggcatttccag

SEQ ID NO: 39609 - DNA, 22 bp, Artificial Sequence
  chemically synthesized
aaccaaggcatttccagctcac

SEQ ID NO: 39610 - DNA, 22 bp, Artificial Sequence
  chemically synthesized
ccagctcactaacattggacca

SEQ ID NO: 39611 - DNA, 22 bp, Artificial Sequence
  chemically synthesized
cagctcactaacattggaccat

SEQ ID NO: 39612 - DNA, 22 bp, Artificial Sequence
  chemically synthesized
actaacattggaccatctttta

SEQ ID NO: 39613 - DNA, 22 bp, Artificial Sequence
  chemically synthesized
acattggaccatcttttaatcc

SEQ ID NO: 39614 - DNA, 22 bp, Artificial Sequence
  chemically synthesized
gaccatcttttaatccatattt

SEQ ID NO: 39615 - DNA, 22 bp, Artificial Sequence
  chemically synthesized
ttaatccatatttcagctaacc

SEQ ID NO: 39616 - DNA, 22 bp, Artificial Sequence
  chemically synthesized
taatccatatttcagctaacca

SEQ ID NO: 39617 - DNA, 22 bp, Artificial Sequence
  chemically synthesized
aatccatatttcagctaaccaa

SEQ ID NO: 39618 - DNA, 22 bp, Artificial Sequence
  chemically synthesized
atccatatttcagctaaccaag

SEQ ID NO: 39619 - DNA, 22 bp, Artificial Sequence
  chemically synthesized
cagctaaccaagcaaataaact

SEQ ID NO: 39620 - DNA, 22 bp, Artificial Sequence
  chemically synthesized
agctaaccaagcaaataaacta

SEQ ID NO: 39621 - DNA, 22 bp, Artificial Sequence
  chemically synthesized
accaagcaaataaactattata

SEQ ID NO: 39622 - DNA, 22 bp, Artificial Sequence
  chemically synthesized
ttataacttttttttttttttt

SEQ ID NO: 39623 - DNA, 22 bp, Artificial Sequence
  chemically synthesized
taactttttttttttttttttt

SEQ ID NO: 39624 - DNA, 22 bp, Artificial Sequence
  chemically synthesized
ttttttttttttttttggaaat

SEQ ID NO: 39625 - DNA, 22 bp, Artificial Sequence
  chemically synthesized
tttttttttttttttggaaatg

SEQ ID NO: 39626 - DNA, 22 bp, Artificial Sequence
  chemically synthesized
ttttttttttttttggaaatgg

SEQ ID NO: 39627 - DNA, 22 bp, Artificial Sequence
  chemically synthesized
tttttttttttttggaaatgga

SEQ ID NO: 39628 - DNA, 22 bp, Artificial Sequence
  chemically synthesized
ttttttttttttggaaatggag

SEQ ID NO: 39629 - DNA, 22 bp, Artificial Sequence
  chemically synthesized
tttttttttttggaaatggagt

SEQ ID NO: 39630 - DNA, 22 bp, Artificial Sequence
  chemically synthesized
ttttttttttggaaatggagtc

SEQ ID NO: 39631 - DNA, 22 bp, Artificial Sequence
  chemically synthesized
tttttttttggaaatggagtct

SEQ ID NO: 39632 - DNA, 22 bp, Artificial Sequence
  chemically synthesized
ttttttttggaaatggagtctt

SEQ ID NO: 39633 - DNA, 22 bp, Artificial Sequence
  chemically synthesized
tttttttggaaatggagtcttg

SEQ ID NO: 39634 - DNA, 22 bp, Artificial Sequence
  chemically synthesized
ttttttggaaatggagtcttgc

SEQ ID NO: 39635 - DNA, 22 bp, Artificial Sequence
  chemically synthesized
tttttggaaatggagtcttgct

SEQ ID NO: 39636 - DNA, 22 bp, Artificial Sequence
  chemically synthesized
ttttggaaatggagtcttgctc

SEQ ID NO: 39637 - DNA, 22 bp, Artificial Sequence
  chemically synthesized
tttggaaatggagtcttgctct

SEQ ID NO: 39638 - DNA, 22 bp, Artificial Sequence
  chemically synthesized
ttggaaatggagtcttgctctg

SEQ ID NO: 39639 - DNA, 22 bp, Artificial Sequence
  chemically synthesized
tggaaatggagtcttgctctgt

SEQ ID NO: 39640 - DNA, 22 bp, Artificial Sequence
  chemically synthesized
ggaaatggagtcttgctctgtt

SEQ ID NO: 39641 - DNA, 22 bp, Artificial Sequence
  chemically synthesized
gaaatggagtcttgctctgtta

SEQ ID NO: 39642 - DNA, 22 bp, Artificial Sequence
  chemically synthesized
gctctgttaccaggctggaatg

SEQ ID NO: 39643 - DNA, 22 bp, Artificial Sequence
  chemically synthesized
ctctgttaccaggctggaatgc

SEQ ID NO: 39644 - DNA, 22 bp, Artificial Sequence
  chemically synthesized
tgttaccaggctggaatgcagt

SEQ ID NO: 39645 - DNA, 22 bp, Artificial Sequence
  chemically synthesized
ttaccaggctggaatgcagtgg

SEQ ID NO: 39646 - DNA, 22 bp, Artificial Sequence
  chemically synthesized
ccaggctggaatgcagtggggc

SEQ ID NO: 39647 - DNA, 22 bp, Artificial Sequence
  chemically synthesized
gaatgcagtggggcgatcttgg

SEQ ID NO: 39648 - DNA, 22 bp, Artificial Sequence
  chemically synthesized
ggctcactgcaatctctgcctc

SEQ ID NO: 39649 - DNA, 22 bp, Artificial Sequence
  chemically synthesized
gctcactgcaatctctgcctca

SEQ ID NO: 39650 - DNA, 22 bp, Artificial Sequence
  chemically synthesized
actgcaatctctgcctcacagg

SEQ ID NO: 39651 - DNA, 22 bp, Artificial Sequence
  chemically synthesized
caatctctgcctcacaggttca

SEQ ID NO: 39652 - DNA, 22 bp, Artificial Sequence
  chemically synthesized
tgcctcacaggttcaagcagtt

SEQ ID NO: 39653 - DNA, 22 bp, Artificial Sequence
  chemically synthesized
cctcacaggttcaagcagttct

SEQ ID NO: 39654 - DNA, 22 bp, Artificial Sequence
  chemically synthesized
acaggttcaagcagttctcttg

SEQ ID NO: 39655 - DNA, 22 bp, Artificial Sequence
  chemically synthesized
aagcagttctcttgcctcagcc

SEQ ID NO: 39656 - DNA, 22 bp, Artificial Sequence
  chemically synthesized
tcttgcctcagcctcccaagta

SEQ ID NO: 39657 - DNA, 22 bp, Artificial Sequence
  chemically synthesized
ttgcctcagcctcccaagtaga

SEQ ID NO: 39658 - DNA, 22 bp, Artificial Sequence
  chemically synthesized
gcctcagcctcccaagtagatg

SEQ ID NO: 39659 - DNA, 22 bp, Artificial Sequence
  chemically synthesized
cctcagcctcccaagtagatga

SEQ ID NO: 39660 - DNA, 22 bp, Artificial Sequence
  chemically synthesized
agcctcccaagtagatgagatt

SEQ ID NO: 39661 - DNA, 22 bp, Artificial Sequence
  chemically synthesized
ccaagtagatgagattacagtt

SEQ ID NO: 39662 - DNA, 22 bp, Artificial Sequence
  chemically synthesized
cagttacgcatcaccatgccca

SEQ ID NO: 39663 - DNA, 22 bp, Artificial Sequence
  chemically synthesized
cgcatcaccatgcccagctaat

SEQ ID NO: 39664 - DNA, 22 bp, Artificial Sequence
  chemically synthesized
atttttgtatttttagcagaga

SEQ ID NO: 39665 - DNA, 22 bp, Artificial Sequence
  chemically synthesized
ttgtatttttagcagagatggg

SEQ ID NO: 39666 - DNA, 22 bp, Artificial Sequence
  chemically synthesized
tgtatttttagcagagatgggg

SEQ ID NO: 39667 - DNA, 22 bp, Artificial Sequence
  chemically synthesized
gtatttttagcagagatggggt

SEQ ID NO: 39668 - DNA, 22 bp, Artificial Sequence
  chemically synthesized
tatttttagcagagatggggtt

SEQ ID NO: 39669 - DNA, 22 bp, Artificial Sequence
  chemically synthesized
ttagcagagatggggtttcacc

SEQ ID NO: 39670 - DNA, 22 bp, Artificial Sequence
  chemically synthesized
tagcagagatggggtttcacca

SEQ ID NO: 39671 - DNA, 22 bp, Artificial Sequence
  chemically synthesized
agcagagatggggtttcaccat

SEQ ID NO: 39672 - DNA, 22 bp, Artificial Sequence
  chemically synthesized
gcagagatggggtttcaccatt

SEQ ID NO: 39673 - DNA, 22 bp, Artificial Sequence
  chemically synthesized
caccattttagccagaattgtc

SEQ ID NO: 39674 - DNA, 22 bp, Artificial Sequence
  chemically synthesized
accattttagccagaattgtct

SEQ ID NO: 39675 - DNA, 22 bp, Artificial Sequence
  chemically synthesized
tagccagaattgtctcaatctc

SEQ ID NO: 39676 - DNA, 22 bp, Artificial Sequence
  chemically synthesized
agccagaattgtctcaatctcc

SEQ ID NO: 39677 - DNA, 22 bp, Artificial Sequence
  chemically synthesized
gccagaattgtctcaatctcct

SEQ ID NO: 39678 - DNA, 22 bp, Artificial Sequence
  chemically synthesized
tctcaatctcctgatctcgtga

SEQ ID NO: 39679 - DNA, 22 bp, Artificial Sequence
  chemically synthesized
aatctcctgatctcgtgatctg

SEQ ID NO: 39680 - DNA, 22 bp, Artificial Sequence
  chemically synthesized
ctgatctcgtgatctgcccgcc

SEQ ID NO: 39681 - DNA, 22 bp, Artificial Sequence
  chemically synthesized
atctcgtgatctgcccgccccc

SEQ ID NO: 39682 - DNA, 22 bp, Artificial Sequence
  chemically synthesized
gtgatctgcccgcccccgcctc

SEQ ID NO: 39683 - DNA, 22 bp, Artificial Sequence
  chemically synthesized
cccgcccccgcctcccaaggtg

SEQ ID NO: 39684 - DNA, 22 bp, Artificial Sequence
  chemically synthesized
ccaaggtgctgggattacaggc

SEQ ID NO: 39685 - DNA, 22 bp, Artificial Sequence
  chemically synthesized
ggattacaggcgtgagccactg

SEQ ID NO: 39686 - DNA, 22 bp, Artificial Sequence
  chemically synthesized
caggcgtgagccactgctcccg

SEQ ID NO: 39687 - DNA, 22 bp, Artificial Sequence
  chemically synthesized
ctcccggccctatcagaacctt

SEQ ID NO: 39688 - DNA, 22 bp, Artificial Sequence
  chemically synthesized
ccggccctatcagaaccttttc

SEQ ID NO: 39689 - DNA, 22 bp, Artificial Sequence
  chemically synthesized
tcagaaccttttctaagtcccc

SEQ ID NO: 39690 - DNA, 22 bp, Artificial Sequence
  chemically synthesized
ttctaagtccccgagctgcaac

SEQ ID NO: 39691 - DNA, 22 bp, Artificial Sequence
  chemically synthesized
tctaagtccccgagctgcaaca

SEQ ID NO: 39692 - DNA, 22 bp, Artificial Sequence
  chemically synthesized
ctaagtccccgagctgcaacat

SEQ ID NO: 39693 - DNA, 22 bp, Artificial Sequence
  chemically synthesized
taagtccccgagctgcaacatt

SEQ ID NO: 39694 - DNA, 22 bp, Artificial Sequence
  chemically synthesized
agtccccgagctgcaacattaa

SEQ ID NO: 39695 - DNA, 22 bp, Artificial Sequence
  chemically synthesized
caacattaaatgcagaatccct

SEQ ID NO: 39696 - DNA, 22 bp, Artificial Sequence
  chemically synthesized
aatgcagaatccctacttagta

SEQ ID NO: 39697 - DNA, 22 bp, Artificial Sequence
  chemically synthesized
cttagtagggccaaaccaataa

SEQ ID NO: 39698 - DNA, 22 bp, Artificial Sequence
  chemically synthesized
agtagggccaaaccaataaatt

SEQ ID NO: 39699 - DNA, 22 bp, Artificial Sequence
  chemically synthesized
gtagggccaaaccaataaattc

SEQ ID NO: 39700 - DNA, 22 bp, Artificial Sequence
  chemically synthesized
agcttgatccaactctatgtcc

SEQ ID NO: 39701 - DNA, 22 bp, Artificial Sequence
  chemically synthesized
gatccaactctatgtcccttcc

SEQ ID NO: 39702 - DNA, 22 bp, Artificial Sequence
  chemically synthesized
atccaactctatgtcccttcca

SEQ ID NO: 39703 - DNA, 22 bp, Artificial Sequence
  chemically synthesized
tatgtcccttccaccattatcc

SEQ ID NO: 39704 - DNA, 22 bp, Artificial Sequence
  chemically synthesized
tgtcccttccaccattatccct

SEQ ID NO: 39705 - DNA, 22 bp, Artificial Sequence
  chemically synthesized
ccaccattatcccttaccctta

SEQ ID NO: 39706 - DNA, 22 bp, Artificial Sequence
  chemically synthesized
caccattatcccttacccttaa

SEQ ID NO: 39707 - DNA, 22 bp, Artificial Sequence
  chemically synthesized
tcccttacccttaatatccatt

SEQ ID NO: 39708 - DNA, 22 bp, Artificial Sequence
  chemically synthesized
acccttaatatccattcccatg

SEQ ID NO: 39709 - DNA, 22 bp, Artificial Sequence
  chemically synthesized
cccttaatatccattcccatgc

SEQ ID NO: 39710 - DNA, 22 bp, Artificial Sequence
  chemically synthesized
aatatccattcccatgcctgtt

SEQ ID NO: 39711 - DNA, 22 bp, Artificial Sequence
  chemically synthesized
atatccattcccatgcctgttc

SEQ ID NO: 39712 - DNA, 22 bp, Artificial Sequence
  chemically synthesized
ccatgcctgttctccagatttc

SEQ ID NO: 39713 - DNA, 22 bp, Artificial Sequence
  chemically synthesized
ttctccagatttctgccaatat

SEQ ID NO: 39714 - DNA, 22 bp, Artificial Sequence
  chemically synthesized
tccagatttctgccaatataaa

SEQ ID NO: 39715 - DNA, 22 bp, Artificial Sequence
  chemically synthesized
cagatttctgccaatataaatt

SEQ ID NO: 39716 - DNA, 22 bp, Artificial Sequence
  chemically synthesized
ctgccaatataaattagaaagc

SEQ ID NO: 39717 - DNA, 22 bp, Artificial Sequence
  chemically synthesized
tgccaatataaattagaaagct

SEQ ID NO: 39718 - DNA, 22 bp, Artificial Sequence
  chemically synthesized
ccaatataaattagaaagctta

SEQ ID NO: 39719 - DNA, 22 bp, Artificial Sequence
  chemically synthesized
gaaagcttaagcagttctttta

SEQ ID NO: 39720 - DNA, 22 bp, Artificial Sequence
  chemically synthesized
aagcagttcttttagagtataa

SEQ ID NO: 39721 - DNA, 22 bp, Artificial Sequence
  chemically synthesized
agcagttcttttagagtataat

SEQ ID NO: 39722 - DNA, 22 bp, Artificial Sequence
  chemically synthesized
ttttagagtataatgcacctcc

SEQ ID NO: 39723 - DNA, 22 bp, Artificial Sequence
  chemically synthesized
ttagagtataatgcacctcctc

SEQ ID NO: 39724 - DNA, 22 bp, Artificial Sequence
  chemically synthesized
tagagtataatgcacctcctca

SEQ ID NO: 39725 - DNA, 22 bp, Artificial Sequence
  chemically synthesized
agagtataatgcacctcctcat

SEQ ID NO: 39726 - DNA, 22 bp, Artificial Sequence
  chemically synthesized
gagtataatgcacctcctcatg

SEQ ID NO: 39727 - DNA, 22 bp, Artificial Sequence
  chemically synthesized
ctcatgggtcacactctgaacc

SEQ ID NO: 39728 - DNA, 22 bp, Artificial Sequence
  chemically synthesized
atgggtcacactctgaacctca

SEQ ID NO: 39729 - DNA, 22 bp, Artificial Sequence
  chemically synthesized
tgaacctcacctctggggcccg

SEQ ID NO: 39730 - DNA, 22 bp, Artificial Sequence
  chemically synthesized
aacctcacctctggggcccgca

SEQ ID NO: 39731 - DNA, 22 bp, Artificial Sequence
  chemically synthesized
acctctggggcccgcaaggaat

SEQ ID NO: 39732 - DNA, 22 bp, Artificial Sequence
  chemically synthesized
tggggcccgcaaggaatttagc

SEQ ID NO: 39733 - DNA, 22 bp, Artificial Sequence
  chemically synthesized
gggcccgcaaggaatttagcct

SEQ ID NO: 39734 - DNA, 22 bp, Artificial Sequence
  chemically synthesized
agcctagttataggtctagaag

SEQ ID NO: 39735 - DNA, 22 bp, Artificial Sequence
  chemically synthesized
gcctagttataggtctagaagc

SEQ ID NO: 39736 - DNA, 22 bp, Artificial Sequence
  chemically synthesized
gttataggtctagaagcattca

SEQ ID NO: 39737 - DNA, 22 bp, Artificial Sequence
  chemically synthesized
taggtctagaagcattcagggg

SEQ ID NO: 39738 - DNA, 22 bp, Artificial Sequence
  chemically synthesized
gaagcattcaggggcattaggg

SEQ ID NO: 39739 - DNA, 22 bp, Artificial Sequence
  chemically synthesized
aggggcattaggggtgcctctt

SEQ ID NO: 39740 - DNA, 22 bp, Artificial Sequence
  chemically synthesized
ggggtgcctcttgaggagaatc

SEQ ID NO: 39741 - DNA, 22 bp, Artificial Sequence
  chemically synthesized
ttgaggagaatcaacattatct

SEQ ID NO: 39742 - DNA, 22 bp, Artificial Sequence
  chemically synthesized
gaggagaatcaacattatcttg

SEQ ID NO: 39743 - DNA, 22 bp, Artificial Sequence
  chemically synthesized
aggagaatcaacattatcttgc

SEQ ID NO: 39744 - DNA, 22 bp, Artificial Sequence
  chemically synthesized
tcttgcctggcagctgcctcag

SEQ ID NO: 39745 - DNA, 22 bp, Artificial Sequence
  chemically synthesized
gcctggcagctgcctcagggaa

SEQ ID NO: 39746 - DNA, 22 bp, Artificial Sequence
  chemically synthesized
cctggcagctgcctcagggaag

SEQ ID NO: 39747 - DNA, 22 bp, Artificial Sequence
  chemically synthesized
gcagctgcctcagggaaggcca

SEQ ID NO: 39748 - DNA, 22 bp, Artificial Sequence
  chemically synthesized
cctcagggaaggccatcactgt

SEQ ID NO: 39749 - DNA, 22 bp, Artificial Sequence
  chemically synthesized
agggaaggccatcactgttgcc

SEQ ID NO: 39750 - DNA, 22 bp, Artificial Sequence
  chemically synthesized
ttgcctcaagcagtgcagggtt

SEQ ID NO: 39751 - DNA, 22 bp, Artificial Sequence
  chemically synthesized
cctcaagcagtgcagggtttac

SEQ ID NO: 39752 - DNA, 22 bp, Artificial Sequence
  chemically synthesized
aagcagtgcagggtttacatcc

SEQ ID NO: 39753 - DNA, 22 bp, Artificial Sequence
  chemically synthesized
acatcctcagacaaaggtggaa

SEQ ID NO: 39754 - DNA, 22 bp, Artificial Sequence
  chemically synthesized
catcctcagacaaaggtggaaa

SEQ ID NO: 39755 - DNA, 22 bp, Artificial Sequence
  chemically synthesized
agacaaaggtggaaaggctaat

SEQ ID NO: 39756 - DNA, 22 bp, Artificial Sequence
  chemically synthesized
atggcagcacgggtcagggagg

SEQ ID NO: 39757 - DNA, 22 bp, Artificial Sequence
  chemically synthesized
ccactactggggatggggaaac

SEQ ID NO: 39758 - DNA, 22 bp, Artificial Sequence
  chemically synthesized
ctggggatggggaaactgtttc

SEQ ID NO: 39759 - DNA, 22 bp, Artificial Sequence
  chemically synthesized
gggatggggaaactgtttcttc

SEQ ID NO: 39760 - DNA, 22 bp, Artificial Sequence
  chemically synthesized
tttcttctggcaaaaaagtttc

SEQ ID NO: 39761 - DNA, 22 bp, Artificial Sequence
  chemically synthesized
cttctggcaaaaaagtttcatc

SEQ ID NO: 39762 - DNA, 22 bp, Artificial Sequence
  chemically synthesized
ttctggcaaaaaagtttcatca

SEQ ID NO: 39763 - DNA, 22 bp, Artificial Sequence
  chemically synthesized
ctggcaaaaaagtttcatcaga

SEQ ID NO: 39764 - DNA, 22 bp, Artificial Sequence
  chemically synthesized
tggcaaaaaagtttcatcagag

SEQ ID NO: 39765 - DNA, 22 bp, Artificial Sequence
  chemically synthesized
gcaaaaaagtttcatcagagtt

SEQ ID NO: 39766 - DNA, 22 bp, Artificial Sequence
  chemically synthesized
catcagagttcacaaactcagt

SEQ ID NO: 39767 - DNA, 22 bp, Artificial Sequence
  chemically synthesized
atcagagttcacaaactcagtg

SEQ ID NO: 39768 - DNA, 22 bp, Artificial Sequence
  chemically synthesized
acaaactcagtgtcctcagctt

SEQ ID NO: 39769 - DNA, 22 bp, Artificial Sequence
  chemically synthesized
agtgtcctcagcttcatcaggg

SEQ ID NO: 39770 - DNA, 22 bp, Artificial Sequence
  chemically synthesized
agcttcatcagggttctcccac

SEQ ID NO: 39771 - DNA, 22 bp, Artificial Sequence
  chemically synthesized
catcagggttctcccacacatc

SEQ ID NO: 39772 - DNA, 22 bp, Artificial Sequence
  chemically synthesized
atcagggttctcccacacatcc

SEQ ID NO: 39773 - DNA, 22 bp, Artificial Sequence
  chemically synthesized
tcccacacatccccactccaag

SEQ ID NO: 39774 - DNA, 22 bp, Artificial Sequence
  chemically synthesized
ccacacatccccactccaagtt

SEQ ID NO: 39775 - DNA, 22 bp, Artificial Sequence
  chemically synthesized
caagttccagggtcccattttt

SEQ ID NO: 39776 - DNA, 22 bp, Artificial Sequence
  chemically synthesized
cagggtcccatttttttccagt

SEQ ID NO: 39777 - DNA, 22 bp, Artificial Sequence
  chemically synthesized
ttttccagtcaatgccctcact

SEQ ID NO: 39778 - DNA, 22 bp, Artificial Sequence
  chemically synthesized
tttccagtcaatgccctcactt

SEQ ID NO: 39779 - DNA, 22 bp, Artificial Sequence
  chemically synthesized
ttccagtcaatgccctcacttt

SEQ ID NO: 39780 - DNA, 22 bp, Artificial Sequence
  chemically synthesized
tccagtcaatgccctcacttta

SEQ ID NO: 39781 - DNA, 22 bp, Artificial Sequence
  chemically synthesized
ccagtcaatgccctcactttaa

SEQ ID NO: 39782 - DNA, 22 bp, Artificial Sequence
  chemically synthesized
cagtcaatgccctcactttaac

SEQ ID NO: 39783 - DNA, 22 bp, Artificial Sequence
  chemically synthesized
actttaacagtaaacacctggc

SEQ ID NO: 39784 - DNA, 22 bp, Artificial Sequence
  chemically synthesized
taacagtaaacacctggcaagg

SEQ ID NO: 39785 - DNA, 22 bp, Artificial Sequence
  chemically synthesized
aacagtaaacacctggcaaggc

SEQ ID NO: 39786 - DNA, 22 bp, Artificial Sequence
  chemically synthesized
acagtaaacacctggcaaggct

SEQ ID NO: 39787 - DNA, 22 bp, Artificial Sequence
  chemically synthesized
gcaaggctgtgcatgcacctct

SEQ ID NO: 39788 - DNA, 22 bp, Artificial Sequence
  chemically synthesized
tgcatgcacctcttgttgcaga

SEQ ID NO: 39789 - DNA, 22 bp, Artificial Sequence
  chemically synthesized
ttgttgcagatcagctactcgc

SEQ ID NO: 39790 - DNA, 22 bp, Artificial Sequence
  chemically synthesized
gttgcagatcagctactcgcat

SEQ ID NO: 39791 - DNA, 22 bp, Artificial Sequence
  chemically synthesized
ttgcagatcagctactcgcatg

SEQ ID NO: 39792 - DNA, 22 bp, Artificial Sequence
  chemically synthesized
cagatcagctactcgcatgata

SEQ ID NO: 39793 - DNA, 22 bp, Artificial Sequence
  chemically synthesized
ctcgcatgataacagcttgtct

SEQ ID NO: 39794 - DNA, 22 bp, Artificial Sequence
  chemically synthesized
gcatgataacagcttgtctctg

SEQ ID NO: 39795 - DNA, 22 bp, Artificial Sequence
  chemically synthesized
gtctctgttttttcacaatttc

SEQ ID NO: 39796 - DNA, 22 bp, Artificial Sequence
  chemically synthesized
tctctgttttttcacaatttca

SEQ ID NO: 39797 - DNA, 22 bp, Artificial Sequence
  chemically synthesized
tgttttttcacaatttcaactc

SEQ ID NO: 39798 - DNA, 22 bp, Artificial Sequence
  chemically synthesized
ttttttcacaatttcaactctt

SEQ ID NO: 39799 - DNA, 22 bp, Artificial Sequence
  chemically synthesized
tttcacaatttcaactctttct

SEQ ID NO: 39800 - DNA, 22 bp, Artificial Sequence
  chemically synthesized
ttcacaatttcaactctttctc

SEQ ID NO: 39801 - DNA, 22 bp, Artificial Sequence
  chemically synthesized
tcacaatttcaactctttctct

SEQ ID NO: 39802 - DNA, 22 bp, Artificial Sequence
  chemically synthesized
cacaatttcaactctttctcta

SEQ ID NO: 39803 - DNA, 22 bp, Artificial Sequence
  chemically synthesized
acaatttcaactctttctctac

SEQ ID NO: 39804 - DNA, 22 bp, Artificial Sequence
  chemically synthesized
caactctttctctacaggagtt

SEQ ID NO: 39805 - DNA, 22 bp, Artificial Sequence
  chemically synthesized
aactctttctctacaggagtta

SEQ ID NO: 39806 - DNA, 22 bp, Artificial Sequence
  chemically synthesized
tttctctacaggagttaaaact

SEQ ID NO: 39807 - DNA, 22 bp, Artificial Sequence
  chemically synthesized
tctctacaggagttaaaactct

SEQ ID NO: 39808 - DNA, 22 bp, Artificial Sequence
  chemically synthesized
ctctacaggagttaaaactctc

SEQ ID NO: 39809 - DNA, 22 bp, Artificial Sequence
  chemically synthesized
tctacaggagttaaaactctca

SEQ ID NO: 39810 - DNA, 22 bp, Artificial Sequence
  chemically synthesized
tacaggagttaaaactctcatt

SEQ ID NO: 39811 - DNA, 22 bp, Artificial Sequence
  chemically synthesized
caggagttaaaactctcattca

SEQ ID NO: 39812 - DNA, 22 bp, Artificial Sequence
  chemically synthesized
aaactctcattcagggcaatct

SEQ ID NO: 39813 - DNA, 22 bp, Artificial Sequence
  chemically synthesized
tcattcagggcaatcttagcag

SEQ ID NO: 39814 - DNA, 22 bp, Artificial Sequence
  chemically synthesized
attcagggcaatcttagcagat

SEQ ID NO: 39815 - DNA, 22 bp, Artificial Sequence
  chemically synthesized
agggcaatcttagcagatttgt

SEQ ID NO: 39816 - DNA, 22 bp, Artificial Sequence
  chemically synthesized
agcagatttgtggctcagtatc

SEQ ID NO: 39817 - DNA, 22 bp, Artificial Sequence
  chemically synthesized
gcagatttgtggctcagtatct

SEQ ID NO: 39818 - DNA, 22 bp, Artificial Sequence
  chemically synthesized
gtggctcagtatctgcttctga

SEQ ID NO: 39819 - DNA, 22 bp, Artificial Sequence
  chemically synthesized
tggctcagtatctgcttctgaa

SEQ ID NO: 39820 - DNA, 22 bp, Artificial Sequence
  chemically synthesized
agtatctgcttctgaaggtggg

SEQ ID NO: 39821 - DNA, 22 bp, Artificial Sequence
  chemically synthesized
cttctgaaggtgggagacagat

SEQ ID NO: 39822 - DNA, 22 bp, Artificial Sequence
  chemically synthesized
ctgaaggtgggagacagatccc

SEQ ID NO: 39823 - DNA, 22 bp, Artificial Sequence
  chemically synthesized
tgaaggtgggagacagatcccc

SEQ ID NO: 39824 - DNA, 22 bp, Artificial Sequence
  chemically synthesized
aaggtgggagacagatcccctg

SEQ ID NO: 39825 - DNA, 22 bp, Artificial Sequence
  chemically synthesized
agatcatcattttctttcatct

SEQ ID NO: 39826 - DNA, 22 bp, Artificial Sequence
  chemically synthesized
tctttcatctctttctccagag

SEQ ID NO: 39827 - DNA, 22 bp, Artificial Sequence
  chemically synthesized
ctttcatctctttctccagaga

SEQ ID NO: 39828 - DNA, 22 bp, Artificial Sequence
  chemically synthesized
tttcatctctttctccagagaa

SEQ ID NO: 39829 - DNA, 22 bp, Artificial Sequence
  chemically synthesized
tcatctctttctccagagaact

SEQ ID NO: 39830 - DNA, 22 bp, Artificial Sequence
  chemically synthesized
catctctttctccagagaactt

SEQ ID NO: 39831 - DNA, 22 bp, Artificial Sequence
  chemically synthesized
atctctttctccagagaactta

SEQ ID NO: 39832 - DNA, 22 bp, Artificial Sequence
  chemically synthesized
tttctccagagaacttaggagc

SEQ ID NO: 39833 - DNA, 22 bp, Artificial Sequence
  chemically synthesized
tctccagagaacttaggagcaa

SEQ ID NO: 39834 - DNA, 22 bp, Artificial Sequence
  chemically synthesized
ctccagagaacttaggagcaat

SEQ ID NO: 39835 - DNA, 22 bp, Artificial Sequence
  chemically synthesized
tccagagaacttaggagcaatc

SEQ ID NO: 39836 - DNA, 22 bp, Artificial Sequence
  chemically synthesized
cagagaacttaggagcaatcaa

SEQ ID NO: 39837 - DNA, 22 bp, Artificial Sequence
  chemically synthesized
aggagcaatcaaccaacttcat

SEQ ID NO: 39838 - DNA, 22 bp, Artificial Sequence
  chemically synthesized
ggagcaatcaaccaacttcatt

SEQ ID NO: 39839 - DNA, 22 bp, Artificial Sequence
  chemically synthesized
cattatgttccttggttctcca

SEQ ID NO: 39840 - DNA, 22 bp, Artificial Sequence
  chemically synthesized
attatgttccttggttctccac

SEQ ID NO: 39841 - DNA, 22 bp, Artificial Sequence
  chemically synthesized
tgttccttggttctccacatat

SEQ ID NO: 39842 - DNA, 22 bp, Artificial Sequence
  chemically synthesized
cttggttctccacatatagtca

SEQ ID NO: 39843 - DNA, 22 bp, Artificial Sequence
  chemically synthesized
ggttctccacatatagtcaaag

SEQ ID NO: 39844 - DNA, 22 bp, Artificial Sequence
  chemically synthesized
gttctccacatatagtcaaagg

SEQ ID NO: 39845 - DNA, 22 bp, Artificial Sequence
  chemically synthesized
tccacatatagtcaaaggtatt

SEQ ID NO: 39846 - DNA, 22 bp, Artificial Sequence
  chemically synthesized
cacatatagtcaaaggtattat

SEQ ID NO: 39847 - DNA, 22 bp, Artificial Sequence
  chemically synthesized
tgtatagagtcactaaactcct

SEQ ID NO: 39848 - DNA, 22 bp, Artificial Sequence
  chemically synthesized
aactccttgcctctcataagtg

SEQ ID NO: 39849 - DNA, 22 bp, Artificial Sequence
  chemically synthesized
cttgcctctcataagtgatgaa

SEQ ID NO: 39850 - DNA, 22 bp, Artificial Sequence
  chemically synthesized
gcctctcataagtgatgaatca

SEQ ID NO: 39851 - DNA, 22 bp, Artificial Sequence
  chemically synthesized
cctctcataagtgatgaatcag

SEQ ID NO: 39852 - DNA, 22 bp, Artificial Sequence
  chemically synthesized
tcataagtgatgaatcagtagt

SEQ ID NO: 39853 - DNA, 22 bp, Artificial Sequence
  chemically synthesized
ataagtgatgaatcagtagtgt

SEQ ID NO: 39854 - DNA, 22 bp, Artificial Sequence
  chemically synthesized
attttgcataactctctaaaca

SEQ ID NO: 39855 - DNA, 22 bp, Artificial Sequence
  chemically synthesized
ttttgcataactctctaaacaa

SEQ ID NO: 39856 - DNA, 22 bp, Artificial Sequence
  chemically synthesized
tgcataactctctaaacaattc

SEQ ID NO: 39857 - DNA, 22 bp, Artificial Sequence
  chemically synthesized
gcataactctctaaacaattca

SEQ ID NO: 39858 - DNA, 22 bp, Artificial Sequence
  chemically synthesized
cataactctctaaacaattcag

SEQ ID NO: 39859 - DNA, 22 bp, Artificial Sequence
  chemically synthesized
tctaaacaattcaggccaagta

SEQ ID NO: 39860 - DNA, 22 bp, Artificial Sequence
  chemically synthesized
taaacaattcaggccaagtact

SEQ ID NO: 39861 - DNA, 22 bp, Artificial Sequence
  chemically synthesized
aacaattcaggccaagtactat

SEQ ID NO: 39862 - DNA, 22 bp, Artificial Sequence
  chemically synthesized
aggccaagtactatcagtgttc

SEQ ID NO: 39863 - DNA, 22 bp, Artificial Sequence
  chemically synthesized
tcagtgttctccatactattag

SEQ ID NO: 39864 - DNA, 22 bp, Artificial Sequence
  chemically synthesized
tccatactattagaagtagagt

SEQ ID NO: 39865 - DNA, 22 bp, Artificial Sequence
  chemically synthesized
catactattagaagtagagtcc

SEQ ID NO: 39866 - DNA, 22 bp, Artificial Sequence
  chemically synthesized
ttagaagtagagtccttagcat

SEQ ID NO: 39867 - DNA, 22 bp, Artificial Sequence
  chemically synthesized
gaagtagagtccttagcatttt

SEQ ID NO: 39868 - DNA, 22 bp, Artificial Sequence
  chemically synthesized
agcattttttggtctaatcata

SEQ ID NO: 39869 - DNA, 22 bp, Artificial Sequence
  chemically synthesized
gcattttttggtctaatcatat

SEQ ID NO: 39870 - DNA, 22 bp, Artificial Sequence
  chemically synthesized
tttggtctaatcatattaatca

SEQ ID NO: 39871 - DNA, 22 bp, Artificial Sequence
  chemically synthesized
ttggtctaatcatattaatcag

SEQ ID NO: 39872 - DNA, 22 bp, Artificial Sequence
  chemically synthesized
tggtctaatcatattaatcagc

SEQ ID NO: 39873 - DNA, 22 bp, Artificial Sequence
  chemically synthesized
ggtctaatcatattaatcagcc

SEQ ID NO: 39874 - DNA, 22 bp, Artificial Sequence
  chemically synthesized
gtctaatcatattaatcagcca

SEQ ID NO: 39875 - DNA, 22 bp, Artificial Sequence
  chemically synthesized
atcatattaatcagccaacacc

SEQ ID NO: 39876 - DNA, 22 bp, Artificial Sequence
  chemically synthesized
atcagccaacaccagaagtccc

SEQ ID NO: 39877 - DNA, 22 bp, Artificial Sequence
  chemically synthesized
catccttaatattctgttcctc

SEQ ID NO: 39878 - DNA, 22 bp, Artificial Sequence
  chemically synthesized
aatattctgttcctcaagaacc

SEQ ID NO: 39879 - DNA, 22 bp, Artificial Sequence
  chemically synthesized
atattctgttcctcaagaacca

SEQ ID NO: 39880 - DNA, 22 bp, Artificial Sequence
  chemically synthesized
tgttcctcaagaaccacttctg

SEQ ID NO: 39881 - DNA, 22 bp, Artificial Sequence
  chemically synthesized
ttcctcaagaaccacttctggt

SEQ ID NO: 39882 - DNA, 22 bp, Artificial Sequence
  chemically synthesized
ctcaagaaccacttctggtatg

SEQ ID NO: 39883 - DNA, 22 bp, Artificial Sequence
  chemically synthesized
aagaaccacttctggtatgaaa

SEQ ID NO: 39884 - DNA, 22 bp, Artificial Sequence
  chemically synthesized
ctggtatgaaaatctgtattag

SEQ ID NO: 39885 - DNA, 22 bp, Artificial Sequence
  chemically synthesized
tggtatgaaaatctgtattagt

SEQ ID NO: 39886 - DNA, 22 bp, Artificial Sequence
  chemically synthesized
gtatgaaaatctgtattagtcg

SEQ ID NO: 39887 - DNA, 22 bp, Artificial Sequence
  chemically synthesized
tattagtcggggttctctagag

SEQ ID NO: 39888 - DNA, 22 bp, Artificial Sequence
  chemically synthesized
gtcggggttctctagagggaca

SEQ ID NO: 39889 - DNA, 22 bp, Artificial Sequence
  chemically synthesized
tctagagggacagaactaatag

SEQ ID NO: 39890 - DNA, 22 bp, Artificial Sequence
  chemically synthesized
tagagggacagaactaatagga

SEQ ID NO: 39891 - DNA, 22 bp, Artificial Sequence
  chemically synthesized
gagggacagaactaataggaga

SEQ ID NO: 39892 - DNA, 22 bp, Artificial Sequence
  chemically synthesized
ataggagattatatatatatat

SEQ ID NO: 39893 - DNA, 22 bp, Artificial Sequence
  chemically synthesized
tatatatatatatatgagagag

SEQ ID NO: 39894 - DNA, 22 bp, Artificial Sequence
  chemically synthesized
tatctatctatagatatagata

SEQ ID NO: 39895 - DNA, 22 bp, Artificial Sequence
  chemically synthesized
tctatagatatagatatactca

SEQ ID NO: 39896 - DNA, 22 bp, Artificial Sequence
  chemically synthesized
tagatatagatatactcacaca

SEQ ID NO: 39897 - DNA, 22 bp, Artificial Sequence
  chemically synthesized
acacaaaggggagcttattaag

SEQ ID NO: 39898 - DNA, 22 bp, Artificial Sequence
  chemically synthesized
attaagtggtattaactcacaa

SEQ ID NO: 39899 - DNA, 22 bp, Artificial Sequence
  chemically synthesized
ttaagtggtattaactcacaag

SEQ ID NO: 39900 - DNA, 22 bp, Artificial Sequence
  chemically synthesized
agtggtattaactcacaagatt

SEQ ID NO: 39901 - DNA, 22 bp, Artificial Sequence
  chemically synthesized
actcacaagattacaaggtccc

SEQ ID NO: 39902 - DNA, 22 bp, Artificial Sequence
  chemically synthesized
acaagattacaaggtcccataa

SEQ ID NO: 39903 - DNA, 22 bp, Artificial Sequence
  chemically synthesized
caaggtcccataataggccacc

SEQ ID NO: 39904 - DNA, 22 bp, Artificial Sequence
  chemically synthesized
caatctgaggagcaaggaagac

SEQ ID NO: 39905 - DNA, 22 bp, Artificial Sequence
  chemically synthesized
aggagcaaggaagacagtccaa

SEQ ID NO: 39906 - DNA, 22 bp, Artificial Sequence
  chemically synthesized
aagaacttggagtccgatgttc

SEQ ID NO: 39907 - DNA, 22 bp, Artificial Sequence
  chemically synthesized
ggagtccgatgttcaagagcag

SEQ ID NO: 39908 - DNA, 22 bp, Artificial Sequence
  chemically synthesized
gagtccgatgttcaagagcagg

SEQ ID NO: 39909 - DNA, 22 bp, Artificial Sequence
  chemically synthesized
aagagcaggaaggatccagcac

SEQ ID NO: 39910 - DNA, 22 bp, Artificial Sequence
  chemically synthesized
ggaggctaagccagtctagcct

SEQ ID NO: 39911 - DNA, 22 bp, Artificial Sequence
  chemically synthesized
agccagtctagcctttttacat

SEQ ID NO: 39912 - DNA, 22 bp, Artificial Sequence
  chemically synthesized
gcctttttacatttttctgcca

SEQ ID NO: 39913 - DNA, 22 bp, Artificial Sequence
  chemically synthesized
tttacatttttctgccagcttt

SEQ ID NO: 39914 - DNA, 22 bp, Artificial Sequence
  chemically synthesized
ttacatttttctgccagcttta

SEQ ID NO: 39915 - DNA, 22 bp, Artificial Sequence
  chemically synthesized
tacatttttctgccagctttat

SEQ ID NO: 39916 - DNA, 22 bp, Artificial Sequence
  chemically synthesized
acatttttctgccagctttata

SEQ ID NO: 39917 - DNA, 22 bp, Artificial Sequence
  chemically synthesized
catttttctgccagctttatat

SEQ ID NO: 39918 - DNA, 22 bp, Artificial Sequence
  chemically synthesized
ttctgccagctttatattctgg

SEQ ID NO: 39919 - DNA, 22 bp, Artificial Sequence
  chemically synthesized
tctgccagctttatattctggc

SEQ ID NO: 39920 - DNA, 22 bp, Artificial Sequence
  chemically synthesized
ctgccagctttatattctggct

SEQ ID NO: 39921 - DNA, 22 bp, Artificial Sequence
  chemically synthesized
tgccagctttatattctggctc

SEQ ID NO: 39922 - DNA, 22 bp, Artificial Sequence
  chemically synthesized
ccagctttatattctggctcta

SEQ ID NO: 39923 - DNA, 22 bp, Artificial Sequence
  chemically synthesized
tatattctggctctacagcttg

SEQ ID NO: 39924 - DNA, 22 bp, Artificial Sequence
  chemically synthesized
atattctggctctacagcttgg

SEQ ID NO: 39925 - DNA, 22 bp, Artificial Sequence
  chemically synthesized
tattctggctctacagcttggg

SEQ ID NO: 39926 - DNA, 22 bp, Artificial Sequence
  chemically synthesized
tggctctacagcttgggggcag

SEQ ID NO: 39927 - DNA, 22 bp, Artificial Sequence
  chemically synthesized
gctctacagcttgggggcagca

SEQ ID NO: 39928 - DNA, 22 bp, Artificial Sequence
  chemically synthesized
tacagcttgggggcagcagggg

SEQ ID NO: 39929 - DNA, 22 bp, Artificial Sequence
  chemically synthesized
cagcttgggggcagcaggggca

SEQ ID NO: 39930 - DNA, 22 bp, Artificial Sequence
  chemically synthesized
gggggcagcaggggcaggggcc

SEQ ID NO: 39931 - DNA, 22 bp, Artificial Sequence
  chemically synthesized
ggggcagcaggggcaggggcct

SEQ ID NO: 39932 - DNA, 22 bp, Artificial Sequence
  chemically synthesized
agggtgcttgcagggatgacac

SEQ ID NO: 39933 - DNA, 22 bp, Artificial Sequence
  chemically synthesized
gcagggatgacacactggcctc

SEQ ID NO: 39934 - DNA, 22 bp, Artificial Sequence
  chemically synthesized
cagggatgacacactggcctct

SEQ ID NO: 39935 - DNA, 22 bp, Artificial Sequence
  chemically synthesized
gcctcttttccatagggtggct

SEQ ID NO: 39936 - DNA, 22 bp, Artificial Sequence
  chemically synthesized
ttttccatagggtggctggggc

SEQ ID NO: 39937 - DNA, 22 bp, Artificial Sequence
  chemically synthesized
ttccatagggtggctggggcac

SEQ ID NO: 39938 - DNA, 22 bp, Artificial Sequence
  chemically synthesized
tccatagggtggctggggcaca

SEQ ID NO: 39939 - DNA, 22 bp, Artificial Sequence
  chemically synthesized
ccatagggtggctggggcacac

SEQ ID NO: 39940 - DNA, 22 bp, Artificial Sequence
  chemically synthesized
catagggtggctggggcacact

SEQ ID NO: 39941 - DNA, 22 bp, Artificial Sequence
  chemically synthesized
gggcacactggggtgtgagtaa

SEQ ID NO: 39942 - DNA, 22 bp, Artificial Sequence
  chemically synthesized
gggtgtgagtaaagcactcagg

SEQ ID NO: 39943 - DNA, 22 bp, Artificial Sequence
  chemically synthesized
aggatcttttttccttccctag

SEQ ID NO: 39944 - DNA, 22 bp, Artificial Sequence
  chemically synthesized
ttttccttccctagtccaagta

SEQ ID NO: 39945 - DNA, 22 bp, Artificial Sequence
  chemically synthesized
tttccttccctagtccaagtac

SEQ ID NO: 39946 - DNA, 22 bp, Artificial Sequence
  chemically synthesized
ttccttccctagtccaagtaca

SEQ ID NO: 39947 - DNA, 22 bp, Artificial Sequence
  chemically synthesized
tccttccctagtccaagtacag

SEQ ID NO: 39948 - DNA, 22 bp, Artificial Sequence
  chemically synthesized
ccttccctagtccaagtacagc

SEQ ID NO: 39949 - DNA, 22 bp, Artificial Sequence
  chemically synthesized
cttccctagtccaagtacagca

SEQ ID NO: 39950 - DNA, 22 bp, Artificial Sequence
  chemically synthesized
ccctagtccaagtacagcaagg

SEQ ID NO: 39951 - DNA, 22 bp, Artificial Sequence
  chemically synthesized
cctagtccaagtacagcaaggg

SEQ ID NO: 39952 - DNA, 22 bp, Artificial Sequence
  chemically synthesized
gtccaagtacagcaagggcagt

SEQ ID NO: 39953 - DNA, 22 bp, Artificial Sequence
  chemically synthesized
cagtgttagtggcagaaggact

SEQ ID NO: 39954 - DNA, 22 bp, Artificial Sequence
  chemically synthesized
gtggcagaaggactttcagtca

SEQ ID NO: 39955 - DNA, 22 bp, Artificial Sequence
  chemically synthesized
tcagtcacctctgggagcttca

SEQ ID NO: 39956 - DNA, 22 bp, Artificial Sequence
  chemically synthesized
cagtcacctctgggagcttcac

SEQ ID NO: 39957 - DNA, 22 bp, Artificial Sequence
  chemically synthesized
agtcacctctgggagcttcacc

SEQ ID NO: 39958 - DNA, 22 bp, Artificial Sequence
  chemically synthesized
tgggagcttcaccccacaaaaa

SEQ ID NO: 39959 - DNA, 22 bp, Artificial Sequence
  chemically synthesized
ggagcttcaccccacaaaaaca

SEQ ID NO: 39960 - DNA, 22 bp, Artificial Sequence
  chemically synthesized
caccccacaaaaacacagagtg

SEQ ID NO: 39961 - DNA, 22 bp, Artificial Sequence
  chemically synthesized
accccacaaaaacacagagtgc

SEQ ID NO: 39962 - DNA, 22 bp, Artificial Sequence
  chemically synthesized
aactgagttcgaggtgcctgca

SEQ ID NO: 39963 - DNA, 22 bp, Artificial Sequence
  chemically synthesized
agttcgaggtgcctgcactgtg

SEQ ID NO: 39964 - DNA, 22 bp, Artificial Sequence
  chemically synthesized
gaggtgcctgcactgtgggccc

SEQ ID NO: 39965 - DNA, 22 bp, Artificial Sequence
  chemically synthesized
cactgtgggcccaagccaggag

SEQ ID NO: 39966 - DNA, 22 bp, Artificial Sequence
  chemically synthesized
tgggcccaagccaggagccttg

SEQ ID NO: 39967 - DNA, 22 bp, Artificial Sequence
  chemically synthesized
gcctggtgaagagtagcaggtg

SEQ ID NO: 39968 - DNA, 22 bp, Artificial Sequence
  chemically synthesized
cctggtgaagagtagcaggtga

SEQ ID NO: 39969 - DNA, 22 bp, Artificial Sequence
  chemically synthesized
gtgaagagtagcaggtgaaagc

SEQ ID NO: 39970 - DNA, 22 bp, Artificial Sequence
  chemically synthesized
acaagaaagagaaactggaatt

SEQ ID NO: 39971 - DNA, 22 bp, Artificial Sequence
  chemically synthesized
gaattctttccctgctgtgtgc

SEQ ID NO: 39972 - DNA, 22 bp, Artificial Sequence
  chemically synthesized
tttccctgctgtgtgctggagg

SEQ ID NO: 39973 - DNA, 22 bp, Artificial Sequence
  chemically synthesized
tccctgctgtgtgctggaggtg

SEQ ID NO: 39974 - DNA, 22 bp, Artificial Sequence
  chemically synthesized
ccctgctgtgtgctggaggtgt

SEQ ID NO: 39975 - DNA, 22 bp, Artificial Sequence
  chemically synthesized
cctgctgtgtgctggaggtgtc

SEQ ID NO: 39976 - DNA, 22 bp, Artificial Sequence
  chemically synthesized
ctgtgtgctggaggtgtcaggg

SEQ ID NO: 39977 - DNA, 22 bp, Artificial Sequence
  chemically synthesized
tgtgctggaggtgtcagggaag

SEQ ID NO: 39978 - DNA, 22 bp, Artificial Sequence
  chemically synthesized
gaggtgtcagggaagtggccag

SEQ ID NO: 39979 - DNA, 22 bp, Artificial Sequence
  chemically synthesized
ctttctcaagcccaagggcatt

SEQ ID NO: 39980 - DNA, 22 bp, Artificial Sequence
  chemically synthesized
tttctcaagcccaagggcatta

SEQ ID NO: 39981 - DNA, 22 bp, Artificial Sequence
  chemically synthesized
tctcaagcccaagggcattaac

SEQ ID NO: 39982 - DNA, 22 bp, Artificial Sequence
  chemically synthesized
ctcaagcccaagggcattaacg

SEQ ID NO: 39983 - DNA, 22 bp, Artificial Sequence
  chemically synthesized
tcaagcccaagggcattaacgg

SEQ ID NO: 39984 - DNA, 22 bp, Artificial Sequence
  chemically synthesized
aagcccaagggcattaacggtg

SEQ ID NO: 39985 - DNA, 22 bp, Artificial Sequence
  chemically synthesized
acggtggtactgctgcagctga

SEQ ID NO: 39986 - DNA, 22 bp, Artificial Sequence
  chemically synthesized
ctgcagctgaaatggcagaggg

SEQ ID NO: 39987 - DNA, 22 bp, Artificial Sequence
  chemically synthesized
cagctgaaatggcagaggggct

SEQ ID NO: 39988 - DNA, 22 bp, Artificial Sequence
  chemically synthesized
aaatggcagaggggctgtgggt

SEQ ID NO: 39989 - DNA, 22 bp, Artificial Sequence
  chemically synthesized
tgggttgtctcttggatttcct

SEQ ID NO: 39990 - DNA, 22 bp, Artificial Sequence
  chemically synthesized
tctcttggatttcctccccaga

SEQ ID NO: 39991 - DNA, 22 bp, Artificial Sequence
  chemically synthesized
ttggatttcctccccagagaag

SEQ ID NO: 39992 - DNA, 22 bp, Artificial Sequence
  chemically synthesized
ggatttcctccccagagaagca

SEQ ID NO: 39993 - DNA, 22 bp, Artificial Sequence
  chemically synthesized
gatttcctccccagagaagcac

SEQ ID NO: 39994 - DNA, 22 bp, Artificial Sequence
  chemically synthesized
cctccccagagaagcacagagc

SEQ ID NO: 39995 - DNA, 22 bp, Artificial Sequence
  chemically synthesized
ctccccagagaagcacagagcc

SEQ ID NO: 39996 - DNA, 22 bp, Artificial Sequence
  chemically synthesized
cccagagaagcacagagccaac

SEQ ID NO: 39997 - DNA, 22 bp, Artificial Sequence
  chemically synthesized
actaaaatgttcaggcagggcc

SEQ ID NO: 39998 - DNA, 22 bp, Artificial Sequence
  chemically synthesized
aaatgttcaggcagggccaggg

SEQ ID NO: 39999 - DNA, 22 bp, Artificial Sequence
  chemically synthesized
aggcagggccagggtggctgtg

SEQ ID NO: 40000 - DNA, 22 bp, Artificial Sequence
  chemically synthesized
tgctctgcccagtgaggaatag

SEQ ID NO: 40001 - DNA, 22 bp, Artificial Sequence
  chemically synthesized
tgcccagtgaggaatagtaggg

SEQ ID NO: 40002 - DNA, 22 bp, Artificial Sequence
  chemically synthesized
cccagtgaggaatagtaggggc

SEQ ID NO: 40003 - DNA, 22 bp, Artificial Sequence
  chemically synthesized
ttccataaggcagctacactgt

SEQ ID NO: 40004 - DNA, 22 bp, Artificial Sequence
  chemically synthesized
tccataaggcagctacactgtg

SEQ ID NO: 40005 - DNA, 22 bp, Artificial Sequence
  chemically synthesized
ccataaggcagctacactgtgc

SEQ ID NO: 40006 - DNA, 22 bp, Artificial Sequence
  chemically synthesized
cataaggcagctacactgtgct

SEQ ID NO: 40007 - DNA, 22 bp, Artificial Sequence
  chemically synthesized
cactgtgctggaggtccgtgag

SEQ ID NO: 40008 - DNA, 22 bp, Artificial Sequence
  chemically synthesized
tgctggaggtccgtgagagtcc

SEQ ID NO: 40009 - DNA, 22 bp, Artificial Sequence
  chemically synthesized
gaggtccgtgagagtcctgaag

SEQ ID NO: 40010 - DNA, 22 bp, Artificial Sequence
  chemically synthesized
aagctcctcgctccctcctgag

SEQ ID NO: 40011 - DNA, 22 bp, Artificial Sequence
  chemically synthesized
ctcgctccctcctgagcccata

SEQ ID NO: 40012 - DNA, 22 bp, Artificial Sequence
  chemically synthesized
gctccctcctgagcccatactt

SEQ ID NO: 40013 - DNA, 22 bp, Artificial Sequence
  chemically synthesized
cctcctgagcccatactttaat

SEQ ID NO: 40014 - DNA, 22 bp, Artificial Sequence
  chemically synthesized
ctgagcccatactttaatctca

SEQ ID NO: 40015 - DNA, 22 bp, Artificial Sequence
  chemically synthesized
agcccatactttaatctcaaga

SEQ ID NO: 40016 - DNA, 22 bp, Artificial Sequence
  chemically synthesized
taatctcaagagtttgagataa

SEQ ID NO: 40017 - DNA, 22 bp, Artificial Sequence
  chemically synthesized
aatctcaagagtttgagataaa

SEQ ID NO: 40018 - DNA, 22 bp, Artificial Sequence
  chemically synthesized
atctcaagagtttgagataaac

SEQ ID NO: 40019 - DNA, 22 bp, Artificial Sequence
  chemically synthesized
aagagtttgagataaacagtgg

SEQ ID NO: 40020 - DNA, 22 bp, Artificial Sequence
  chemically synthesized
gagataaacagtggtaaggaag

SEQ ID NO: 40021 - DNA, 22 bp, Artificial Sequence
  chemically synthesized
agataaacagtggtaaggaaga

SEQ ID NO: 40022 - DNA, 22 bp, Artificial Sequence
  chemically synthesized
atgaaacccaggaagataagtc

SEQ ID NO: 40023 - DNA, 22 bp, Artificial Sequence
  chemically synthesized
caacctaaagaaatacttttta

SEQ ID NO: 40024 - DNA, 22 bp, Artificial Sequence
  chemically synthesized
aagaaatactttttaaaaatca

SEQ ID NO: 40025 - DNA, 22 bp, Artificial Sequence
  chemically synthesized
tttaaaaatcatatttatagag

SEQ ID NO: 40026 - DNA, 22 bp, Artificial Sequence
  chemically synthesized
ttaaaaatcatatttatagagg

SEQ ID NO: 40027 - DNA, 22 bp, Artificial Sequence
  chemically synthesized
taaaaatcatatttatagaggt

SEQ ID NO: 40028 - DNA, 22 bp, Artificial Sequence
  chemically synthesized
aaaaatcatatttatagaggtt

SEQ ID NO: 40029 - DNA, 22 bp, Artificial Sequence
  chemically synthesized
aaaatcatatttatagaggttt

SEQ ID NO: 40030 - DNA, 22 bp, Artificial Sequence
  chemically synthesized
atagaggtttgcagtgatacta

SEQ ID NO: 40031 - DNA, 22 bp, Artificial Sequence
  chemically synthesized
tagaggtttgcagtgatactaa

SEQ ID NO: 40032 - DNA, 22 bp, Artificial Sequence
  chemically synthesized
gcagtgatactaaagacaatat

SEQ ID NO: 40033 - DNA, 22 bp, Artificial Sequence
  chemically synthesized
cagtgatactaaagacaatatt

SEQ ID NO: 40034 - DNA, 22 bp, Artificial Sequence
  chemically synthesized
aagacaatattgcaaatcatta

SEQ ID NO: 40035 - DNA, 22 bp, Artificial Sequence
  chemically synthesized
caaatcattattaagaatacaa

SEQ ID NO: 40036 - DNA, 22 bp, Artificial Sequence
  chemically synthesized
ttaagaatacaagaagtacaat

SEQ ID NO: 40037 - DNA, 22 bp, Artificial Sequence
  chemically synthesized
agaatacaagaagtacaatgtt

SEQ ID NO: 40038 - DNA, 22 bp, Artificial Sequence
  chemically synthesized
cttgtttctttaacacctgtga

SEQ ID NO: 40039 - DNA, 22 bp, Artificial Sequence
  chemically synthesized
ttgtttctttaacacctgtgat

SEQ ID NO: 40040 - DNA, 22 bp, Artificial Sequence
  chemically synthesized
gtttctttaacacctgtgatac

SEQ ID NO: 40041 - DNA, 22 bp, Artificial Sequence
  chemically synthesized
tttctttaacacctgtgataca

SEQ ID NO: 40042 - DNA, 22 bp, Artificial Sequence
  chemically synthesized
ctttaacacctgtgatacaggt

SEQ ID NO: 40043 - DNA, 22 bp, Artificial Sequence
  chemically synthesized
tttaacacctgtgatacaggtg

SEQ ID NO: 40044 - DNA, 22 bp, Artificial Sequence
  chemically synthesized
taacacctgtgatacaggtgtt

SEQ ID NO: 40045 - DNA, 22 bp, Artificial Sequence
  chemically synthesized
aacacctgtgatacaggtgttt

SEQ ID NO: 40046 - DNA, 22 bp, Artificial Sequence
  chemically synthesized
acacctgtgatacaggtgtttg

SEQ ID NO: 40047 - DNA, 22 bp, Artificial Sequence
  chemically synthesized
tgatacaggtgtttgatatgaa

SEQ ID NO: 40048 - DNA, 22 bp, Artificial Sequence
  chemically synthesized
gatatgaattctacgtaatggc

SEQ ID NO: 40049 - DNA, 22 bp, Artificial Sequence
  chemically synthesized
atatgaattctacgtaatggct

SEQ ID NO: 40050 - DNA, 22 bp, Artificial Sequence
  chemically synthesized
tacgtaatggctgcattgcttc

SEQ ID NO: 40051 - DNA, 22 bp, Artificial Sequence
  chemically synthesized
cgtaatggctgcattgcttctt

SEQ ID NO: 40052 - DNA, 22 bp, Artificial Sequence
  chemically synthesized
cattgcttcttgccaccaccca

SEQ ID NO: 40053 - DNA, 22 bp, Artificial Sequence
  chemically synthesized
cttcttgccaccacccaaagaa

SEQ ID NO: 40054 - DNA, 22 bp, Artificial Sequence
  chemically synthesized
cttgccaccacccaaagaaggt

SEQ ID NO: 40055 - DNA, 22 bp, Artificial Sequence
  chemically synthesized
ttgccaccacccaaagaaggtt

SEQ ID NO: 40056 - DNA, 22 bp, Artificial Sequence
  chemically synthesized
gccaccacccaaagaaggttgt

SEQ ID NO: 40057 - DNA, 22 bp, Artificial Sequence
  chemically synthesized
ccaccacccaaagaaggttgta

SEQ ID NO: 40058 - DNA, 22 bp, Artificial Sequence
  chemically synthesized
tatagcactcagatgtatacta

SEQ ID NO: 40059 - DNA, 22 bp, Artificial Sequence
  chemically synthesized
agatgtatactaactgcaaccg

SEQ ID NO: 40060 - DNA, 22 bp, Artificial Sequence
  chemically synthesized
actgcaaccgtgtatctcttag

SEQ ID NO: 40061 - DNA, 22 bp, Artificial Sequence
  chemically synthesized
caaccgtgtatctcttaggaat

SEQ ID NO: 40062 - DNA, 22 bp, Artificial Sequence
  chemically synthesized
ttaggaatttctcctttgccct

SEQ ID NO: 40063 - DNA, 22 bp, Artificial Sequence
  chemically synthesized
aggaatttctcctttgccctct

SEQ ID NO: 40064 - DNA, 22 bp, Artificial Sequence
  chemically synthesized
ggaatttctcctttgccctctt

SEQ ID NO: 40065 - DNA, 22 bp, Artificial Sequence
  chemically synthesized
ctcctttgccctcttccctccc

SEQ ID NO: 40066 - DNA, 22 bp, Artificial Sequence
  chemically synthesized
tcctttgccctcttccctccct

SEQ ID NO: 40067 - DNA, 22 bp, Artificial Sequence
  chemically synthesized
ctttgccctcttccctccctat

SEQ ID NO: 40068 - DNA, 22 bp, Artificial Sequence
  chemically synthesized
tgccctcttccctccctatcag

SEQ ID NO: 40069 - DNA, 22 bp, Artificial Sequence
  chemically synthesized
gccctcttccctccctatcagc

SEQ ID NO: 40070 - DNA, 22 bp, Artificial Sequence
  chemically synthesized
ccctcttccctccctatcagca

SEQ ID NO: 40071 - DNA, 22 bp, Artificial Sequence
  chemically synthesized
ttccctccctatcagcatgtat

SEQ ID NO: 40072 - DNA, 22 bp, Artificial Sequence
  chemically synthesized
ccctccctatcagcatgtatct

SEQ ID NO: 40073 - DNA, 22 bp, Artificial Sequence
  chemically synthesized
cctccctatcagcatgtatcta

SEQ ID NO: 40074 - DNA, 22 bp, Artificial Sequence
  chemically synthesized
cctatcagcatgtatctagcag

SEQ ID NO: 40075 - DNA, 22 bp, Artificial Sequence
  chemically synthesized
tcagcatgtatctagcagcatt

SEQ ID NO: 40076 - DNA, 22 bp, Artificial Sequence
  chemically synthesized
gcagcattctgaaaagttaact

SEQ ID NO: 40077 - DNA, 22 bp, Artificial Sequence
  chemically synthesized
tgaaaagttaactgcacagtga

SEQ ID NO: 40078 - DNA, 22 bp, Artificial Sequence
  chemically synthesized
aaaagttaactgcacagtgagc

SEQ ID NO: 40079 - DNA, 22 bp, Artificial Sequence
  chemically synthesized
actgcacagtgagcgactgctg

SEQ ID NO: 40080 - DNA, 22 bp, Artificial Sequence
  chemically synthesized
cacagtgagcgactgctgggca

SEQ ID NO: 40081 - DNA, 22 bp, Artificial Sequence
  chemically synthesized
ctgggcatcttaaggggcattc

SEQ ID NO: 40082 - DNA, 22 bp, Artificial Sequence
  chemically synthesized
ggcatcttaaggggcattcttt

SEQ ID NO: 40083 - DNA, 22 bp, Artificial Sequence
  chemically synthesized
aaggggcattcttttctaccta

SEQ ID NO: 40084 - DNA, 22 bp, Artificial Sequence
  chemically synthesized
aggggcattcttttctacctag

SEQ ID NO: 40085 - DNA, 22 bp, Artificial Sequence
  chemically synthesized
ttttctacctaggtattccccc

SEQ ID NO: 40086 - DNA, 22 bp, Artificial Sequence
  chemically synthesized
ttctacctaggtattccccctc

SEQ ID NO: 40087 - DNA, 22 bp, Artificial Sequence
  chemically synthesized
tctacctaggtattccccctcc

SEQ ID NO: 40088 - DNA, 22 bp, Artificial Sequence
  chemically synthesized
ctacctaggtattccccctcct

SEQ ID NO: 40089 - DNA, 22 bp, Artificial Sequence
  chemically synthesized
tacctaggtattccccctcctc

SEQ ID NO: 40090 - DNA, 22 bp, Artificial Sequence
  chemically synthesized
cctaggtattccccctcctcca

SEQ ID NO: 40091 - DNA, 22 bp, Artificial Sequence
  chemically synthesized
ggtattccccctcctccactca

SEQ ID NO: 40092 - DNA, 22 bp, Artificial Sequence
  chemically synthesized
cccctcctccactcatgtctag

SEQ ID NO: 40093 - DNA, 22 bp, Artificial Sequence
  chemically synthesized
ctccactcatgtctagcatgca

SEQ ID NO: 40094 - DNA, 22 bp, Artificial Sequence
  chemically synthesized
cactcatgtctagcatgcagga

SEQ ID NO: 40095 - DNA, 22 bp, Artificial Sequence
  chemically synthesized
atgtctagcatgcaggacttgg

SEQ ID NO: 40096 - DNA, 22 bp, Artificial Sequence
  chemically synthesized
gcatgcaggacttgggtaatct

SEQ ID NO: 40097 - DNA, 22 bp, Artificial Sequence
  chemically synthesized
gggtaatctctggggtttcaga

SEQ ID NO: 40098 - DNA, 22 bp, Artificial Sequence
  chemically synthesized
ggtaatctctggggtttcagat

SEQ ID NO: 40099 - DNA, 22 bp, Artificial Sequence
  chemically synthesized
tggggtttcagattctccagac

SEQ ID NO: 40100 - DNA, 22 bp, Artificial Sequence
  chemically synthesized
gggtttcagattctccagacct

SEQ ID NO: 40101 - DNA, 22 bp, Artificial Sequence
  chemically synthesized
cagattctccagacctccattc

SEQ ID NO: 40102 - DNA, 22 bp, Artificial Sequence
  chemically synthesized
agattctccagacctccattct

SEQ ID NO: 40103 - DNA, 22 bp, Artificial Sequence
  chemically synthesized
tccagacctccattctctcagg

SEQ ID NO: 40104 - DNA, 22 bp, Artificial Sequence
  chemically synthesized
cagacctccattctctcagggg

SEQ ID NO: 40105 - DNA, 22 bp, Artificial Sequence
  chemically synthesized
cattctctcaggggcttccacc

SEQ ID NO: 40106 - DNA, 22 bp, Artificial Sequence
  chemically synthesized
tctcaggggcttccacctcctg

SEQ ID NO: 40107 - DNA, 22 bp, Artificial Sequence
  chemically synthesized
tcaggggcttccacctcctgct

SEQ ID NO: 40108 - DNA, 22 bp, Artificial Sequence
  chemically synthesized
aggggcttccacctcctgctca

SEQ ID NO: 40109 - DNA, 22 bp, Artificial Sequence
  chemically synthesized
ccacctcctgctcatatctagc

SEQ ID NO: 40110 - DNA, 22 bp, Artificial Sequence
  chemically synthesized
cacctcctgctcatatctagct

SEQ ID NO: 40111 - DNA, 22 bp, Artificial Sequence
  chemically synthesized
ctgctcatatctagctatctgc

SEQ ID NO: 40112 - DNA, 22 bp, Artificial Sequence
  chemically synthesized
ctcatatctagctatctgccta

SEQ ID NO: 40113 - DNA, 22 bp, Artificial Sequence
  chemically synthesized
atatctagctatctgcctagtc

SEQ ID NO: 40114 - DNA, 22 bp, Artificial Sequence
  chemically synthesized
gctatctgcctagtctaaccat

SEQ ID NO: 40115 - DNA, 22 bp, Artificial Sequence
  chemically synthesized
tctgcctagtctaaccataaaa

SEQ ID NO: 40116 - DNA, 22 bp, Artificial Sequence
  chemically synthesized
cctagtctaaccataaaatctt

SEQ ID NO: 40117 - DNA, 22 bp, Artificial Sequence
  chemically synthesized
gtctaaccataaaatcttaaat

SEQ ID NO: 40118 - DNA, 22 bp, Artificial Sequence
  chemically synthesized
accataaaatcttaaataagaa

SEQ ID NO: 40119 - DNA, 22 bp, Artificial Sequence
  chemically synthesized
aaataagaataaatcatgtttg

SEQ ID NO: 40120 - DNA, 22 bp, Artificial Sequence
  chemically synthesized
aataagaataaatcatgtttgc

SEQ ID NO: 40121 - DNA, 22 bp, Artificial Sequence
  chemically synthesized
gctcttgattgccatgtcatga

SEQ ID NO: 40122 - DNA, 22 bp, Artificial Sequence
  chemically synthesized
ctcttgattgccatgtcatgat

SEQ ID NO: 40123 - DNA, 22 bp, Artificial Sequence
  chemically synthesized
ttgattgccatgtcatgataaa

SEQ ID NO: 40124 - DNA, 22 bp, Artificial Sequence
  chemically synthesized
gattgccatgtcatgataaaaa

SEQ ID NO: 40125 - DNA, 22 bp, Artificial Sequence
  chemically synthesized
attgccatgtcatgataaaaaa

SEQ ID NO: 40126 - DNA, 22 bp, Artificial Sequence
  chemically synthesized
ccatgtcatgataaaaaaaata

SEQ ID NO: 40127 - DNA, 22 bp, Artificial Sequence
  chemically synthesized
tgttgccaagattgatgttgat

SEQ ID NO: 40128 - DNA, 22 bp, Artificial Sequence
  chemically synthesized
ccaagattgatgttgatctgct

SEQ ID NO: 40129 - DNA, 22 bp, Artificial Sequence
  chemically synthesized
atgttgatctgctaatccctgt

SEQ ID NO: 40130 - DNA, 22 bp, Artificial Sequence
  chemically synthesized
atctgctaatccctgtgtagaa

SEQ ID NO: 40131 - DNA, 22 bp, Artificial Sequence
  chemically synthesized
ctaatccctgtgtagaaatgaa

SEQ ID NO: 40132 - DNA, 22 bp, Artificial Sequence
  chemically synthesized
atccctgtgtagaaatgaacct

SEQ ID NO: 40133 - DNA, 22 bp, Artificial Sequence
  chemically synthesized
tgtagaaatgaaccttggaggc

SEQ ID NO: 40134 - DNA, 22 bp, Artificial Sequence
  chemically synthesized
ggaggccattgtttgatttctt

SEQ ID NO: 40135 - DNA, 22 bp, Artificial Sequence
  chemically synthesized
gaggccattgtttgatttctta

SEQ ID NO: 40136 - DNA, 22 bp, Artificial Sequence
  chemically synthesized
tttgatttcttacaatatgtgc

SEQ ID NO: 40137 - DNA, 22 bp, Artificial Sequence
  chemically synthesized
gatttcttacaatatgtgcatt

SEQ ID NO: 40138 - DNA, 22 bp, Artificial Sequence
  chemically synthesized
atttcttacaatatgtgcattg

SEQ ID NO: 40139 - DNA, 22 bp, Artificial Sequence
  chemically synthesized
cttacaatatgtgcattggttg

SEQ ID NO: 40140 - DNA, 22 bp, Artificial Sequence
  chemically synthesized
ttacaatatgtgcattggttgt

SEQ ID NO: 40141 - DNA, 22 bp, Artificial Sequence
  chemically synthesized
acaatatgtgcattggttgtaa

SEQ ID NO: 40142 - DNA, 22 bp, Artificial Sequence
  chemically synthesized
caatatgtgcattggttgtaac

SEQ ID NO: 40143 - DNA, 22 bp, Artificial Sequence
  chemically synthesized
gttgtaacactgtcactttgac

SEQ ID NO: 40144 - DNA, 22 bp, Artificial Sequence
  chemically synthesized
taacactgtcactttgacagtt

SEQ ID NO: 40145 - DNA, 22 bp, Artificial Sequence
  chemically synthesized
tcactttgacagttgataagca

SEQ ID NO: 40146 - DNA, 22 bp, Artificial Sequence
  chemically synthesized
tgacagttgataagcatcttct

SEQ ID NO: 40147 - DNA, 22 bp, Artificial Sequence
  chemically synthesized
gacagttgataagcatcttctg

SEQ ID NO: 40148 - DNA, 22 bp, Artificial Sequence
  chemically synthesized
acagttgataagcatcttctga

SEQ ID NO: 40149 - DNA, 22 bp, Artificial Sequence
  chemically synthesized
ataagcatcttctgaatggtcc

SEQ ID NO: 40150 - DNA, 22 bp, Artificial Sequence
  chemically synthesized
ctgaatggtccctcctttagtt

SEQ ID NO: 40151 - DNA, 22 bp, Artificial Sequence
  chemically synthesized
tgaatggtccctcctttagtta

SEQ ID NO: 40152 - DNA, 22 bp, Artificial Sequence
  chemically synthesized
aatggtccctcctttagttaca

SEQ ID NO: 40153 - DNA, 22 bp, Artificial Sequence
  chemically synthesized
ctttagttacaaaaatgttggt

SEQ ID NO: 40154 - DNA, 22 bp, Artificial Sequence
  chemically synthesized
tagttacaaaaatgttggtgca

SEQ ID NO: 40155 - DNA, 22 bp, Artificial Sequence
  chemically synthesized
agttacaaaaatgttggtgcat

SEQ ID NO: 40156 - DNA, 22 bp, Artificial Sequence
  chemically synthesized
gttacaaaaatgttggtgcatg

SEQ ID NO: 40157 - DNA, 22 bp, Artificial Sequence
  chemically synthesized
caaaaatgttggtgcatggatg

SEQ ID NO: 40158 - DNA, 22 bp, Artificial Sequence
  chemically synthesized
gtgcatggatgatgttgggaat

SEQ ID NO: 40159 - DNA, 22 bp, Artificial Sequence
  chemically synthesized
ggaataaataaaaagtgaacta

SEQ ID NO: 40160 - DNA, 22 bp, Artificial Sequence
  chemically synthesized
aattatgttctcatcttgggca

SEQ ID NO: 40161 - DNA, 22 bp, Artificial Sequence
  chemically synthesized
tgttctcatcttgggcaaaaat

SEQ ID NO: 40162 - DNA, 22 bp, Artificial Sequence
  chemically synthesized
tcatcttgggcaaaaattaagc

SEQ ID NO: 40163 - DNA, 22 bp, Artificial Sequence
  chemically synthesized
atcttgggcaaaaattaagcaa

SEQ ID NO: 40164 - DNA, 22 bp, Artificial Sequence
  chemically synthesized
gggcaaaaattaagcaaaaaaa

SEQ ID NO: 40165 - DNA, 22 bp, Artificial Sequence
  chemically synthesized
ggcaaaaattaagcaaaaaaaa

SEQ ID NO: 40166 - DNA, 22 bp, Artificial Sequence
  chemically synthesized
agcaaaaaaaaaatggaggata

SEQ ID NO: 40167 - DNA, 22 bp, Artificial Sequence
  chemically synthesized
ctccacaaagaaggccattttt

SEQ ID NO: 40168 - DNA, 22 bp, Artificial Sequence
  chemically synthesized
cacaaagaaggccatttttgta

SEQ ID NO: 40169 - DNA, 22 bp, Artificial Sequence
  chemically synthesized
ttgtactaggcttactacagtg

SEQ ID NO: 40170 - DNA, 22 bp, Artificial Sequence
  chemically synthesized
tgtactaggcttactacagtga

SEQ ID NO: 40171 - DNA, 22 bp, Artificial Sequence
  chemically synthesized
gtactaggcttactacagtgac

SEQ ID NO: 40172 - DNA, 22 bp, Artificial Sequence
  chemically synthesized
tactaggcttactacagtgaca

SEQ ID NO: 40173 - DNA, 22 bp, Artificial Sequence
  chemically synthesized
ggcttactacagtgacacacca

SEQ ID NO: 40174 - DNA, 22 bp, Artificial Sequence
  chemically synthesized
actacagtgacacaccactatt

SEQ ID NO: 40175 - DNA, 22 bp, Artificial Sequence
  chemically synthesized
ctacagtgacacaccactatta

SEQ ID NO: 40176 - DNA, 22 bp, Artificial Sequence
  chemically synthesized
cagtgacacaccactattagtt

SEQ ID NO: 40177 - DNA, 22 bp, Artificial Sequence
  chemically synthesized
ttagttggggagaattcagttt

SEQ ID NO: 40178 - DNA, 22 bp, Artificial Sequence
  chemically synthesized
gttggggagaattcagtttttc

SEQ ID NO: 40179 - DNA, 22 bp, Artificial Sequence
  chemically synthesized
gggagaattcagtttttccaag

SEQ ID NO: 40180 - DNA, 22 bp, Artificial Sequence
  chemically synthesized
agtttttccaaggtgttgatag

SEQ ID NO: 40181 - DNA, 22 bp, Artificial Sequence
  chemically synthesized
ttccaaggtgttgataggcatc

SEQ ID NO: 40182 - DNA, 22 bp, Artificial Sequence
  chemically synthesized
tccaaggtgttgataggcatcc

SEQ ID NO: 40183 - DNA, 22 bp, Artificial Sequence
  chemically synthesized
ccaaggtgttgataggcatcca

SEQ ID NO: 40184 - DNA, 22 bp, Artificial Sequence
  chemically synthesized
caaggtgttgataggcatccag

SEQ ID NO: 40185 - DNA, 22 bp, Artificial Sequence
  chemically synthesized
ataggcatccagatttcagagg

SEQ ID NO: 40186 - DNA, 22 bp, Artificial Sequence
  chemically synthesized
cagaggaaattgtaaaaaagca

SEQ ID NO: 40187 - DNA, 22 bp, Artificial Sequence
  chemically synthesized
agaggaaattgtaaaaaagcag

SEQ ID NO: 40188 - DNA, 22 bp, Artificial Sequence
  chemically synthesized
taaaaaagcagaacctgggacc

SEQ ID NO: 40189 - DNA, 22 bp, Artificial Sequence
  chemically synthesized
ggaccaatactgcccacgattt

SEQ ID NO: 40190 - DNA, 22 bp, Artificial Sequence
  chemically synthesized
cccacgatttttctttgagatc

SEQ ID NO: 40191 - DNA, 22 bp, Artificial Sequence
  chemically synthesized
ttctttgagatcaaatctgagg

SEQ ID NO: 40192 - DNA, 22 bp, Artificial Sequence
  chemically synthesized
tctttgagatcaaatctgaggc

SEQ ID NO: 40193 - DNA, 22 bp, Artificial Sequence
  chemically synthesized
ctttgagatcaaatctgaggca

SEQ ID NO: 40194 - DNA, 22 bp, Artificial Sequence
  chemically synthesized
tttgagatcaaatctgaggcaa

SEQ ID NO: 40195 - DNA, 22 bp, Artificial Sequence
  chemically synthesized
tgagatcaaatctgaggcaaca

SEQ ID NO: 40196 - DNA, 22 bp, Artificial Sequence
  chemically synthesized
gagatcaaatctgaggcaacaa

SEQ ID NO: 40197 - DNA, 22 bp, Artificial Sequence
  chemically synthesized
agatcaaatctgaggcaacaaa

SEQ ID NO: 40198 - DNA, 22 bp, Artificial Sequence
  chemically synthesized
aggcaacaaatctgttcaaaag

SEQ ID NO: 40199 - DNA, 22 bp, Artificial Sequence
  chemically synthesized
ttcaaaagctgctttctgcctg

SEQ ID NO: 40200 - DNA, 22 bp, Artificial Sequence
  chemically synthesized
aaaagctgctttctgcctggtt

SEQ ID NO: 40201 - DNA, 22 bp, Artificial Sequence
  chemically synthesized
ctttctgcctggttgtggcaaa

SEQ ID NO: 40202 - DNA, 22 bp, Artificial Sequence
  chemically synthesized
tctgcctggttgtggcaaaggg

SEQ ID NO: 40203 - DNA, 22 bp, Artificial Sequence
  chemically synthesized
ctgcctggttgtggcaaagggt

SEQ ID NO: 40204 - DNA, 22 bp, Artificial Sequence
  chemically synthesized
tgcctggttgtggcaaagggtg

SEQ ID NO: 40205 - DNA, 22 bp, Artificial Sequence
  chemically synthesized
cctggttgtggcaaagggtggc

SEQ ID NO: 40206 - DNA, 22 bp, Artificial Sequence
  chemically synthesized
gttgtggcaaagggtggccaag

SEQ ID NO: 40207 - DNA, 22 bp, Artificial Sequence
  chemically synthesized
tggcaaagggtggccaagtggg

SEQ ID NO: 40208 - DNA, 22 bp, Artificial Sequence
  chemically synthesized
agctgtgttcccattgcaaggc

SEQ ID NO: 40209 - DNA, 22 bp, Artificial Sequence
  chemically synthesized
tgttcccattgcaaggctactg

SEQ ID NO: 40210 - DNA, 22 bp, Artificial Sequence
  chemically synthesized
ccattgcaaggctactgagcat

SEQ ID NO: 40211 - DNA, 22 bp, Artificial Sequence
  chemically synthesized
caaggctactgagcatcccctg

SEQ ID NO: 40212 - DNA, 22 bp, Artificial Sequence
  chemically synthesized
ctgagcatcccctgtcctgagg

SEQ ID NO: 40213 - DNA, 22 bp, Artificial Sequence
  chemically synthesized
agcatcccctgtcctgaggctc

SEQ ID NO: 40214 - DNA, 22 bp, Artificial Sequence
  chemically synthesized
tcctgaggctccttaggacacc

SEQ ID NO: 40215 - DNA, 22 bp, Artificial Sequence
  chemically synthesized
aggctccttaggacacctggct

SEQ ID NO: 40216 - DNA, 22 bp, Artificial Sequence
  chemically synthesized
cttaggacacctggctgagctt

SEQ ID NO: 40217 - DNA, 22 bp, Artificial Sequence
  chemically synthesized
aggacacctggctgagcttcag

SEQ ID NO: 40218 - DNA, 22 bp, Artificial Sequence
  chemically synthesized
ggacacctggctgagcttcagc

SEQ ID NO: 40219 - DNA, 22 bp, Artificial Sequence
  chemically synthesized
gctgagcttcagcagccctctt

SEQ ID NO: 40220 - DNA, 22 bp, Artificial Sequence
  chemically synthesized
agcttcagcagccctcttccaa

SEQ ID NO: 40221 - DNA, 22 bp, Artificial Sequence
  chemically synthesized
cagcagccctcttccaagcctg

SEQ ID NO: 40222 - DNA, 22 bp, Artificial Sequence
  chemically synthesized
agcagccctcttccaagcctgg

SEQ ID NO: 40223 - DNA, 22 bp, Artificial Sequence
  chemically synthesized
ttccaagcctggagatgccagc

SEQ ID NO: 40224 - DNA, 22 bp, Artificial Sequence
  chemically synthesized
ccaagcctggagatgccagctc

SEQ ID NO: 40225 - DNA, 22 bp, Artificial Sequence
  chemically synthesized
caagcctggagatgccagctcc

SEQ ID NO: 40226 - DNA, 22 bp, Artificial Sequence
  chemically synthesized
gagatgccagctccatctctgg

SEQ ID NO: 40227 - DNA, 22 bp, Artificial Sequence
  chemically synthesized
catctctggcacaaaatgtagt

SEQ ID NO: 40228 - DNA, 22 bp, Artificial Sequence
  chemically synthesized
tggcacaaaatgtagtgatttt

SEQ ID NO: 40229 - DNA, 22 bp, Artificial Sequence
  chemically synthesized
gcacaaaatgtagtgattttca

SEQ ID NO: 40230 - DNA, 22 bp, Artificial Sequence
  chemically synthesized
tcacagggtgagaggccaaaag

SEQ ID NO: 40231 - DNA, 22 bp, Artificial Sequence
  chemically synthesized
cacagggtgagaggccaaaaga

SEQ ID NO: 40232 - DNA, 22 bp, Artificial Sequence
  chemically synthesized
acagggtgagaggccaaaagag

SEQ ID NO: 40233 - DNA, 22 bp, Artificial Sequence
  chemically synthesized
ataaaatgaagatagccaagct

SEQ ID NO: 40234 - DNA, 22 bp, Artificial Sequence
  chemically synthesized
ccatggaattaagcaacaggac

SEQ ID NO: 40235 - DNA, 22 bp, Artificial Sequence
  chemically synthesized
catggaattaagcaacaggaca

SEQ ID NO: 40236 - DNA, 22 bp, Artificial Sequence
  chemically synthesized
agcaacaggacaaccttgacca

SEQ ID NO: 40237 - DNA, 22 bp, Artificial Sequence
  chemically synthesized
gaccactttgaggggtgtggtg

SEQ ID NO: 40238 - DNA, 22 bp, Artificial Sequence
  chemically synthesized
accactttgaggggtgtggtgg

SEQ ID NO: 40239 - DNA, 22 bp, Artificial Sequence
  chemically synthesized
tgaggggtgtggtgggggccac

SEQ ID NO: 40240 - DNA, 22 bp, Artificial Sequence
  chemically synthesized
gaggggtgtggtgggggccaca

SEQ ID NO: 40241 - DNA, 22 bp, Artificial Sequence
  chemically synthesized
aggggtgtggtgggggccacat

SEQ ID NO: 40242 - DNA, 22 bp, Artificial Sequence
  chemically synthesized
aagagtgactagaagagcagtg

SEQ ID NO: 40243 - DNA, 22 bp, Artificial Sequence
  chemically synthesized
gaagagcagtgggggtggcagc

SEQ ID NO: 40244 - DNA, 22 bp, Artificial Sequence
  chemically synthesized
gctctgaaagcagcgagacttc

SEQ ID NO: 40245 - DNA, 22 bp, Artificial Sequence
  chemically synthesized
tgaaagcagcgagacttctagg

SEQ ID NO: 40246 - DNA, 22 bp, Artificial Sequence
  chemically synthesized
aaagcagcgagacttctaggga

SEQ ID NO: 40247 - DNA, 22 bp, Artificial Sequence
  chemically synthesized
ctagggaatacagggtcagggg

SEQ ID NO: 40248 - DNA, 22 bp, Artificial Sequence
  chemically synthesized
tagggaatacagggtcagggga

SEQ ID NO: 40249 - DNA, 22 bp, Artificial Sequence
  chemically synthesized
gggaatacagggtcaggggagg

SEQ ID NO: 40250 - DNA, 22 bp, Artificial Sequence
  chemically synthesized
tgaaagatgacacactgcagag

SEQ ID NO: 40251 - DNA, 22 bp, Artificial Sequence
  chemically synthesized
aaagatgacacactgcagagaa

SEQ ID NO: 40252 - DNA, 22 bp, Artificial Sequence
  chemically synthesized
cagagaacatgtgtttgtatgc

SEQ ID NO: 40253 - DNA, 22 bp, Artificial Sequence
  chemically synthesized
gtatgccgatgacaagtatcca

SEQ ID NO: 40254 - DNA, 22 bp, Artificial Sequence
  chemically synthesized
tatgccgatgacaagtatccag

SEQ ID NO: 40255 - DNA, 22 bp, Artificial Sequence
  chemically synthesized
tcattctcagaaaggcctgtcc

SEQ ID NO: 40256 - DNA, 22 bp, Artificial Sequence
  chemically synthesized
attctcagaaaggcctgtcctg

SEQ ID NO: 40257 - DNA, 22 bp, Artificial Sequence
  chemically synthesized
tcagaaaggcctgtcctgacct

SEQ ID NO: 40258 - DNA, 22 bp, Artificial Sequence
  chemically synthesized
agaaaggcctgtcctgacctcc

SEQ ID NO: 40259 - DNA, 22 bp, Artificial Sequence
  chemically synthesized
tcctgacctcctgagagtacac

SEQ ID NO: 40260 - DNA, 22 bp, Artificial Sequence
  chemically synthesized
acctcctgagagtacacagacc

SEQ ID NO: 40261 - DNA, 22 bp, Artificial Sequence
  chemically synthesized
ctgagagtacacagaccatgag

SEQ ID NO: 40262 - DNA, 22 bp, Artificial Sequence
  chemically synthesized
agagtacacagaccatgagggc

SEQ ID NO: 40263 - DNA, 22 bp, Artificial Sequence
  chemically synthesized
actgtttcatgcaaagtccttg

SEQ ID NO: 40264 - DNA, 22 bp, Artificial Sequence
  chemically synthesized
tttcatgcaaagtccttggcca

SEQ ID NO: 40265 - DNA, 22 bp, Artificial Sequence
  chemically synthesized
catgcaaagtccttggccacag

SEQ ID NO: 40266 - DNA, 22 bp, Artificial Sequence
  chemically synthesized
atgcaaagtccttggccacagt

SEQ ID NO: 40267 - DNA, 22 bp, Artificial Sequence
  chemically synthesized
ggccacagtccacctgctcccc

SEQ ID NO: 40268 - DNA, 22 bp, Artificial Sequence
  chemically synthesized
gccacagtccacctgctcccca

SEQ ID NO: 40269 - DNA, 22 bp, Artificial Sequence
  chemically synthesized
ctccccacctctgtgactttgt

SEQ ID NO: 40270 - DNA, 22 bp, Artificial Sequence
  chemically synthesized
cccacctctgtgactttgtcct

SEQ ID NO: 40271 - DNA, 22 bp, Artificial Sequence
  chemically synthesized
tgtgactttgtccttcctcaat

SEQ ID NO: 40272 - DNA, 22 bp, Artificial Sequence
  chemically synthesized
tgactttgtccttcctcaattt

SEQ ID NO: 40273 - DNA, 22 bp, Artificial Sequence
  chemically synthesized
tgtccttcctcaatttaatatg

SEQ ID NO: 40274 - DNA, 22 bp, Artificial Sequence
  chemically synthesized
gtccttcctcaatttaatatgc

SEQ ID NO: 40275 - DNA, 22 bp, Artificial Sequence
  chemically synthesized
tccttcctcaatttaatatgct

SEQ ID NO: 40276 - DNA, 22 bp, Artificial Sequence
  chemically synthesized
cctcaatttaatatgctctatg

SEQ ID NO: 40277 - DNA, 22 bp, Artificial Sequence
  chemically synthesized
ctcaatttaatatgctctatgc

SEQ ID NO: 40278 - DNA, 22 bp, Artificial Sequence
  chemically synthesized
aatttaatatgctctatgctgg

SEQ ID NO: 40279 - DNA, 22 bp, Artificial Sequence
  chemically synthesized
aatatgctctatgctggaaaac

SEQ ID NO: 40280 - DNA, 22 bp, Artificial Sequence
  chemically synthesized
atatgctctatgctggaaaact

SEQ ID NO: 40281 - DNA, 22 bp, Artificial Sequence
  chemically synthesized
tatgctggaaaactggattatt

SEQ ID NO: 40282 - DNA, 22 bp, Artificial Sequence
  chemically synthesized
tgctggaaaactggattattga

SEQ ID NO: 40283 - DNA, 22 bp, Artificial Sequence
  chemically synthesized
gaaaactggattattgaacagg

SEQ ID NO: 40284 - DNA, 22 bp, Artificial Sequence
  chemically synthesized
gattattgaacaggcattggct

SEQ ID NO: 40285 - DNA, 22 bp, Artificial Sequence
  chemically synthesized
ttgaacaggcattggctgatgc

SEQ ID NO: 40286 - DNA, 22 bp, Artificial Sequence
  chemically synthesized
aacaggcattggctgatgcatt

SEQ ID NO: 40287 - DNA, 22 bp, Artificial Sequence
  chemically synthesized
gctgatgcattctgaacctaat

SEQ ID NO: 40288 - DNA, 22 bp, Artificial Sequence
  chemically synthesized
atgcattctgaacctaatccac

SEQ ID NO: 40289 - DNA, 22 bp, Artificial Sequence
  chemically synthesized
tgaacctaatccactaaaaagc

SEQ ID NO: 40290 - DNA, 22 bp, Artificial Sequence
  chemically synthesized
aacctaatccactaaaaagcac

SEQ ID NO: 40291 - DNA, 22 bp, Artificial Sequence
  chemically synthesized
atccactaaaaagcacttgata

SEQ ID NO: 40292 - DNA, 22 bp, Artificial Sequence
  chemically synthesized
aaaagcacttgatagatatatc

SEQ ID NO: 40293 - DNA, 22 bp, Artificial Sequence
  chemically synthesized
gatagatatatcaaaatatcat

SEQ ID NO: 40294 - DNA, 22 bp, Artificial Sequence
  chemically synthesized
atagatatatcaaaatatcatt

SEQ ID NO: 40295 - DNA, 22 bp, Artificial Sequence
  chemically synthesized
agaaatagatattttaggccca

SEQ ID NO: 40296 - DNA, 22 bp, Artificial Sequence
  chemically synthesized
taggcccatatccatgtcttca

SEQ ID NO: 40297 - DNA, 22 bp, Artificial Sequence
  chemically synthesized
aggcccatatccatgtcttcac

SEQ ID NO: 40298 - DNA, 22 bp, Artificial Sequence
  chemically synthesized
ggcccatatccatgtcttcacc

SEQ ID NO: 40299 - DNA, 22 bp, Artificial Sequence
  chemically synthesized
caccccgcactgtttctcattt

SEQ ID NO: 40300 - DNA, 22 bp, Artificial Sequence
  chemically synthesized
accccgcactgtttctcatttg

SEQ ID NO: 40301 - DNA, 22 bp, Artificial Sequence
  chemically synthesized
tttctcatttgaactctctttt

SEQ ID NO: 40302 - DNA, 22 bp, Artificial Sequence
  chemically synthesized
ctcatttgaactctcttttcca

SEQ ID NO: 40303 - DNA, 22 bp, Artificial Sequence
  chemically synthesized
tcatttgaactctcttttccag

SEQ ID NO: 40304 - DNA, 22 bp, Artificial Sequence
  chemically synthesized
atttgaactctcttttccagga

SEQ ID NO: 40305 - DNA, 22 bp, Artificial Sequence
  chemically synthesized
gaactctcttttccaggaagag

SEQ ID NO: 40306 - DNA, 22 bp, Artificial Sequence
  chemically synthesized
aactctcttttccaggaagagt

SEQ ID NO: 40307 - DNA, 22 bp, Artificial Sequence
  chemically synthesized
tcttttccaggaagagttgtgc

SEQ ID NO: 40308 - DNA, 22 bp, Artificial Sequence
  chemically synthesized
ttttccaggaagagttgtgctt

SEQ ID NO: 40309 - DNA, 22 bp, Artificial Sequence
  chemically synthesized
ttccaggaagagttgtgcttgg

SEQ ID NO: 40310 - DNA, 22 bp, Artificial Sequence
  chemically synthesized
tccaggaagagttgtgcttggg

SEQ ID NO: 40311 - DNA, 22 bp, Artificial Sequence
  chemically synthesized
ccaggaagagttgtgcttgggt

SEQ ID NO: 40312 - DNA, 22 bp, Artificial Sequence
  chemically synthesized
caggaagagttgtgcttgggta

SEQ ID NO: 40313 - DNA, 22 bp, Artificial Sequence
  chemically synthesized
tgcttgggtaaattctatagct

SEQ ID NO: 40314 - DNA, 22 bp, Artificial Sequence
  chemically synthesized
gggtaaattctatagctcacag

SEQ ID NO: 40315 - DNA, 22 bp, Artificial Sequence
  chemically synthesized
ggtaaattctatagctcacagt

SEQ ID NO: 40316 - DNA, 22 bp, Artificial Sequence
  chemically synthesized
tatagctcacagtgtgacttca

SEQ ID NO: 40317 - DNA, 22 bp, Artificial Sequence
  chemically synthesized
tagctcacagtgtgacttcaaa

SEQ ID NO: 40318 - DNA, 22 bp, Artificial Sequence
  chemically synthesized
acagtgtgacttcaaaacacac

SEQ ID NO: 40319 - DNA, 22 bp, Artificial Sequence
  chemically synthesized
caaaacacacaataaattaata

SEQ ID NO: 40320 - DNA, 22 bp, Artificial Sequence
  chemically synthesized
aaaacacacaataaattaataa

SEQ ID NO: 40321 - DNA, 22 bp, Artificial Sequence
  chemically synthesized
ataaggtgcttcctacagtgag

SEQ ID NO: 40322 - DNA, 22 bp, Artificial Sequence
  chemically synthesized
cctacagtgagttcagttaaac

SEQ ID NO: 40323 - DNA, 22 bp, Artificial Sequence
  chemically synthesized
ctacagtgagttcagttaaaca

SEQ ID NO: 40324 - DNA, 22 bp, Artificial Sequence
  chemically synthesized
cagtgagttcagttaaacattt

SEQ ID NO: 40325 - DNA, 22 bp, Artificial Sequence
  chemically synthesized
agttaaacattttgaagagtgt

SEQ ID NO: 40326 - DNA, 22 bp, Artificial Sequence
  chemically synthesized
aacattttgaagagtgtttttg

SEQ ID NO: 40327 - DNA, 22 bp, Artificial Sequence
  chemically synthesized
tgaagagtgtttttgaaatgta

SEQ ID NO: 40328 - DNA, 22 bp, Artificial Sequence
  chemically synthesized
gaagagtgtttttgaaatgtag

SEQ ID NO: 40329 - DNA, 22 bp, Artificial Sequence
  chemically synthesized
aagagtgtttttgaaatgtagc

SEQ ID NO: 40330 - DNA, 22 bp, Artificial Sequence
  chemically synthesized
ttgaaatgtagcagagcaggct

SEQ ID NO: 40331 - DNA, 22 bp, Artificial Sequence
  chemically synthesized
tgaaatgtagcagagcaggcta

SEQ ID NO: 40332 - DNA, 22 bp, Artificial Sequence
  chemically synthesized
gaaatgtagcagagcaggctac

SEQ ID NO: 40333 - DNA, 22 bp, Artificial Sequence
  chemically synthesized
aaatgtagcagagcaggctaca

SEQ ID NO: 40334 - DNA, 22 bp, Artificial Sequence
  chemically synthesized
caattgatattcaaaaagagga

SEQ ID NO: 40335 - DNA, 22 bp, Artificial Sequence
  chemically synthesized
atattcaaaaagaggaaacttc

SEQ ID NO: 40336 - DNA, 22 bp, Artificial Sequence
  chemically synthesized
aaaaagaggaaacttccattta

SEQ ID NO: 40337 - DNA, 22 bp, Artificial Sequence
  chemically synthesized
ccatttatttccccctttaact

SEQ ID NO: 40338 - DNA, 22 bp, Artificial Sequence
  chemically synthesized
catttatttccccctttaacta

SEQ ID NO: 40339 - DNA, 22 bp, Artificial Sequence
  chemically synthesized
atttccccctttaactaagtta

SEQ ID NO: 40340 - DNA, 22 bp, Artificial Sequence
  chemically synthesized
tttccccctttaactaagttac

SEQ ID NO: 40341 - DNA, 22 bp, Artificial Sequence
  chemically synthesized
ccccctttaactaagttacctg

SEQ ID NO: 40342 - DNA, 22 bp, Artificial Sequence
  chemically synthesized
cccctttaactaagttacctgt

SEQ ID NO: 40343 - DNA, 22 bp, Artificial Sequence
  chemically synthesized
taactaagttacctgtaactgt

SEQ ID NO: 40344 - DNA, 22 bp, Artificial Sequence
  chemically synthesized
aactaagttacctgtaactgtg

SEQ ID NO: 40345 - DNA, 22 bp, Artificial Sequence
  chemically synthesized
actaagttacctgtaactgtgt

SEQ ID NO: 40346 - DNA, 22 bp, Artificial Sequence
  chemically synthesized
agttacctgtaactgtgtcatt

SEQ ID NO: 40347 - DNA, 22 bp, Artificial Sequence
  chemically synthesized
cctgtaactgtgtcattttatt

SEQ ID NO: 40348 - DNA, 22 bp, Artificial Sequence
  chemically synthesized
taactgtgtcattttattatgc

SEQ ID NO: 40349 - DNA, 22 bp, Artificial Sequence
  chemically synthesized
tgtcattttattatgcttcata

SEQ ID NO: 40350 - DNA, 22 bp, Artificial Sequence
  chemically synthesized
tattatgcttcatagagcatca

SEQ ID NO: 40351 - DNA, 22 bp, Artificial Sequence
  chemically synthesized
attatgcttcatagagcatcac

SEQ ID NO: 40352 - DNA, 22 bp, Artificial Sequence
  chemically synthesized
ttatgcttcatagagcatcact

SEQ ID NO: 40353 - DNA, 22 bp, Artificial Sequence
  chemically synthesized
tgcttcatagagcatcactgct

SEQ ID NO: 40354 - DNA, 22 bp, Artificial Sequence
  chemically synthesized
catagagcatcactgctgagat

SEQ ID NO: 40355 - DNA, 22 bp, Artificial Sequence
  chemically synthesized
atagagcatcactgctgagatc

SEQ ID NO: 40356 - DNA, 22 bp, Artificial Sequence
  chemically synthesized
ctgagatcccctccccagctca

SEQ ID NO: 40357 - DNA, 22 bp, Artificial Sequence
  chemically synthesized
agatcccctccccagctcatgt

SEQ ID NO: 40358 - DNA, 22 bp, Artificial Sequence
  chemically synthesized
cccagctcatgttgctaggaaa

SEQ ID NO: 40359 - DNA, 22 bp, Artificial Sequence
  chemically synthesized
atgttgctaggaaatatcccaa

SEQ ID NO: 40360 - DNA, 22 bp, Artificial Sequence
  chemically synthesized
ctaggaaatatcccaaaacaga

SEQ ID NO: 40361 - DNA, 22 bp, Artificial Sequence
  chemically synthesized
ggaaatatcccaaaacagaatc

SEQ ID NO: 40362 - DNA, 22 bp, Artificial Sequence
  chemically synthesized
ttctttttttaacctgatgatt

SEQ ID NO: 40363 - DNA, 22 bp, Artificial Sequence
  chemically synthesized
tctttttttaacctgatgattt

SEQ ID NO: 40364 - DNA, 22 bp, Artificial Sequence
  chemically synthesized
ctttttttaacctgatgatttt

SEQ ID NO: 40365 - DNA, 22 bp, Artificial Sequence
  chemically synthesized
tttttttaacctgatgattttt

SEQ ID NO: 40366 - DNA, 22 bp, Artificial Sequence
  chemically synthesized
tttttaacctgatgatttttcc

SEQ ID NO: 40367 - DNA, 22 bp, Artificial Sequence
  chemically synthesized
ttttaacctgatgatttttcca

SEQ ID NO: 40368 - DNA, 22 bp, Artificial Sequence
  chemically synthesized
tttaacctgatgatttttccac

SEQ ID NO: 40369 - DNA, 22 bp, Artificial Sequence
  chemically synthesized
ttaacctgatgatttttccaca

SEQ ID NO: 40370 - DNA, 22 bp, Artificial Sequence
  chemically synthesized
taacctgatgatttttccacaa

SEQ ID NO: 40371 - DNA, 22 bp, Artificial Sequence
  chemically synthesized
aacctgatgatttttccacaat

SEQ ID NO: 40372 - DNA, 22 bp, Artificial Sequence
  chemically synthesized
acctgatgatttttccacaatc

SEQ ID NO: 40373 - DNA, 22 bp, Artificial Sequence
  chemically synthesized
atgatttttccacaatcctttt

SEQ ID NO: 40374 - DNA, 22 bp, Artificial Sequence
  chemically synthesized
ttccacaatccttttgtttctc

SEQ ID NO: 40375 - DNA, 22 bp, Artificial Sequence
  chemically synthesized
tccacaatccttttgtttctct

SEQ ID NO: 40376 - DNA, 22 bp, Artificial Sequence
  chemically synthesized
ccacaatccttttgtttctctg

SEQ ID NO: 40377 - DNA, 22 bp, Artificial Sequence
  chemically synthesized
cacaatccttttgtttctctga

SEQ ID NO: 40378 - DNA, 22 bp, Artificial Sequence
  chemically synthesized
ttgtttctctgattcacctcca

SEQ ID NO: 40379 - DNA, 22 bp, Artificial Sequence
  chemically synthesized
tgtttctctgattcacctccag

SEQ ID NO: 40380 - DNA, 22 bp, Artificial Sequence
  chemically synthesized
gtttctctgattcacctccagg

SEQ ID NO: 40381 - DNA, 22 bp, Artificial Sequence
  chemically synthesized
tttctctgattcacctccaggg

SEQ ID NO: 40382 - DNA, 22 bp, Artificial Sequence
  chemically synthesized
ctctgattcacctccagggctc

SEQ ID NO: 40383 - DNA, 22 bp, Artificial Sequence
  chemically synthesized
tctgattcacctccagggctca

SEQ ID NO: 40384 - DNA, 22 bp, Artificial Sequence
  chemically synthesized
tgattcacctccagggctcata

SEQ ID NO: 40385 - DNA, 22 bp, Artificial Sequence
  chemically synthesized
attcacctccagggctcatatg

SEQ ID NO: 40386 - DNA, 22 bp, Artificial Sequence
  chemically synthesized
acctccagggctcatatggcaa

SEQ ID NO: 40387 - DNA, 22 bp, Artificial Sequence
  chemically synthesized
cagggctcatatggcaatgggg

SEQ ID NO: 40388 - DNA, 22 bp, Artificial Sequence
  chemically synthesized
atatggcaatggggatttaata

SEQ ID NO: 40389 - DNA, 22 bp, Artificial Sequence
  chemically synthesized
aatagggtttatttgttggtga

SEQ ID NO: 40390 - DNA, 22 bp, Artificial Sequence
  chemically synthesized
atagggtttatttgttggtgaa

SEQ ID NO: 40391 - DNA, 22 bp, Artificial Sequence
  chemically synthesized
atttgttggtgaagaaacatta

SEQ ID NO: 40392 - DNA, 22 bp, Artificial Sequence
  chemically synthesized
tttgttggtgaagaaacattaa

SEQ ID NO: 40393 - DNA, 22 bp, Artificial Sequence
  chemically synthesized
gttggtgaagaaacattaaaca

SEQ ID NO: 40394 - DNA, 22 bp, Artificial Sequence
  chemically synthesized
ttggtgaagaaacattaaacaa

SEQ ID NO: 40395 - DNA, 22 bp, Artificial Sequence
  chemically synthesized
gtgaagaaacattaaacaaatc

SEQ ID NO: 40396 - DNA, 22 bp, Artificial Sequence
  chemically synthesized
aacaaatcttttaataggaaaa

SEQ ID NO: 40397 - DNA, 22 bp, Artificial Sequence
  chemically synthesized
ttaataggaaaaatacttttat

SEQ ID NO: 40398 - DNA, 22 bp, Artificial Sequence
  chemically synthesized
taataggaaaaatacttttata

SEQ ID NO: 40399 - DNA, 22 bp, Artificial Sequence
  chemically synthesized
aataggaaaaatacttttatat

SEQ ID NO: 40400 - DNA, 22 bp, Artificial Sequence
  chemically synthesized
ataggaaaaatacttttatatt

SEQ ID NO: 40401 - DNA, 22 bp, Artificial Sequence
  chemically synthesized
ttatattataggcaaaatgtag

SEQ ID NO: 40402 - DNA, 22 bp, Artificial Sequence
  chemically synthesized
tatattataggcaaaatgtaga

SEQ ID NO: 40403 - DNA, 22 bp, Artificial Sequence
  chemically synthesized
atattataggcaaaatgtagat

SEQ ID NO: 40404 - DNA, 22 bp, Artificial Sequence
  chemically synthesized
tattataggcaaaatgtagatg

SEQ ID NO: 40405 - DNA, 22 bp, Artificial Sequence
  chemically synthesized
taggcaaaatgtagatgtatat

SEQ ID NO: 40406 - DNA, 22 bp, Artificial Sequence
  chemically synthesized
ctactgaagtaaatgtatttta

SEQ ID NO: 40407 - DNA, 22 bp, Artificial Sequence
  chemically synthesized
ctgaagtaaatgtattttatta

SEQ ID NO: 40408 - DNA, 22 bp, Artificial Sequence
  chemically synthesized
aagtaaatgtattttattaatg

SEQ ID NO: 40409 - DNA, 22 bp, Artificial Sequence
  chemically synthesized
tattaatggtgtgagaatttct

SEQ ID NO: 40410 - DNA, 22 bp, Artificial Sequence
  chemically synthesized
attaatggtgtgagaatttctt

SEQ ID NO: 40411 - DNA, 22 bp, Artificial Sequence
  chemically synthesized
ttaatggtgtgagaatttcttc

SEQ ID NO: 40412 - DNA, 22 bp, Artificial Sequence
  chemically synthesized
atggtgtgagaatttcttcctc

SEQ ID NO: 40413 - DNA, 22 bp, Artificial Sequence
  chemically synthesized
cttcctcactgtggtgtgtgaa

SEQ ID NO: 40414 - DNA, 22 bp, Artificial Sequence
  chemically synthesized
ttcctcactgtggtgtgtgaat

SEQ ID NO: 40415 - DNA, 22 bp, Artificial Sequence
  chemically synthesized
cctcactgtggtgtgtgaatgt

SEQ ID NO: 40416 - DNA, 22 bp, Artificial Sequence
  chemically synthesized
ctcactgtggtgtgtgaatgtg

SEQ ID NO: 40417 - DNA, 22 bp, Artificial Sequence
  chemically synthesized
actgtggtgtgtgaatgtgtat

SEQ ID NO: 40418 - DNA, 22 bp, Artificial Sequence
  chemically synthesized
tggtgtgtgaatgtgtatgcat

SEQ ID NO: 40419 - DNA, 22 bp, Artificial Sequence
  chemically synthesized
gcatgtgtaaaagacttagcaa

SEQ ID NO: 40420 - DNA, 22 bp, Artificial Sequence
  chemically synthesized
catgtgtaaaagacttagcaat

SEQ ID NO: 40421 - DNA, 22 bp, Artificial Sequence
  chemically synthesized
agcaatttgtgaatagaagatg

SEQ ID NO: 40422 - DNA, 22 bp, Artificial Sequence
  chemically synthesized
gcaatttgtgaatagaagatgt

SEQ ID NO: 40423 - DNA, 22 bp, Artificial Sequence
  chemically synthesized
gtgaatagaagatgtttctccg

SEQ ID NO: 40424 - DNA, 22 bp, Artificial Sequence
  chemically synthesized
tgaatagaagatgtttctccgc

SEQ ID NO: 40425 - DNA, 22 bp, Artificial Sequence
  chemically synthesized
ctccgcttctcactgagcatgg

SEQ ID NO: 40426 - DNA, 22 bp, Artificial Sequence
  chemically synthesized
tccgcttctcactgagcatggc

SEQ ID NO: 40427 - DNA, 22 bp, Artificial Sequence
  chemically synthesized
cgcttctcactgagcatggctg

SEQ ID NO: 40428 - DNA, 22 bp, Artificial Sequence
  chemically synthesized
ctcactgagcatggctgtaaaa

SEQ ID NO: 40429 - DNA, 22 bp, Artificial Sequence
  chemically synthesized
tcactgagcatggctgtaaaag

SEQ ID NO: 40430 - DNA, 22 bp, Artificial Sequence
  chemically synthesized
actgagcatggctgtaaaagaa

SEQ ID NO: 40431 - DNA, 22 bp, Artificial Sequence
  chemically synthesized
agcatggctgtaaaagaaactt

SEQ ID NO: 40432 - DNA, 22 bp, Artificial Sequence
  chemically synthesized
taaaagaaactttttcctctcc

SEQ ID NO: 40433 - DNA, 22 bp, Artificial Sequence
  chemically synthesized
tttcctctccccgggcattcca

SEQ ID NO: 40434 - DNA, 22 bp, Artificial Sequence
  chemically synthesized
ttcctctccccgggcattccag

SEQ ID NO: 40435 - DNA, 22 bp, Artificial Sequence
  chemically synthesized
tcctctccccgggcattccagc

SEQ ID NO: 40436 - DNA, 22 bp, Artificial Sequence
  chemically synthesized
cctctccccgggcattccagca

SEQ ID NO: 40437 - DNA, 22 bp, Artificial Sequence
  chemically synthesized
ctctccccgggcattccagcac

SEQ ID NO: 40438 - DNA, 22 bp, Artificial Sequence
  chemically synthesized
tccccgggcattccagcacaca

SEQ ID NO: 40439 - DNA, 22 bp, Artificial Sequence
  chemically synthesized
cccgggcattccagcacacatt

SEQ ID NO: 40440 - DNA, 22 bp, Artificial Sequence
  chemically synthesized
cagcacacattggaaagataac

SEQ ID NO: 40441 - DNA, 22 bp, Artificial Sequence
  chemically synthesized
gaaagataacacgtccacagaa

SEQ ID NO: 40442 - DNA, 22 bp, Artificial Sequence
  chemically synthesized
gctttccaaaagagcttatcag

SEQ ID NO: 40443 - DNA, 22 bp, Artificial Sequence
  chemically synthesized
tccaaaagagcttatcagagaa

SEQ ID NO: 40444 - DNA, 22 bp, Artificial Sequence
  chemically synthesized
ccaaaagagcttatcagagaat

SEQ ID NO: 40445 - DNA, 22 bp, Artificial Sequence
  chemically synthesized
caaaagagcttatcagagaatg

SEQ ID NO: 40446 - DNA, 22 bp, Artificial Sequence
  chemically synthesized
atcagagaatgtgccccccagg

SEQ ID NO: 40447 - DNA, 22 bp, Artificial Sequence
  chemically synthesized
tcagagaatgtgccccccaggt

SEQ ID NO: 40448 - DNA, 22 bp, Artificial Sequence
  chemically synthesized
aaacatatgttaatcctgtggc

SEQ ID NO: 40449 - DNA, 22 bp, Artificial Sequence
  chemically synthesized
atcctgtggcagagaagtttgt

SEQ ID NO: 40450 - DNA, 22 bp, Artificial Sequence
  chemically synthesized
tggcagagaagtttgttctagc

SEQ ID NO: 40451 - DNA, 22 bp, Artificial Sequence
  chemically synthesized
gttctagcctttgggtgtagcc

SEQ ID NO: 40452 - DNA, 22 bp, Artificial Sequence
  chemically synthesized
ttctagcctttgggtgtagcct

SEQ ID NO: 40453 - DNA, 22 bp, Artificial Sequence
  chemically synthesized
tagcctttgggtgtagcctgct

SEQ ID NO: 40454 - DNA, 22 bp, Artificial Sequence
  chemically synthesized
gcctttgggtgtagcctgctga

SEQ ID NO: 40455 - DNA, 22 bp, Artificial Sequence
  chemically synthesized
tgggtgtagcctgctgaataag

SEQ ID NO: 40456 - DNA, 22 bp, Artificial Sequence
  chemically synthesized
gggtgtagcctgctgaataagt

SEQ ID NO: 40457 - DNA, 22 bp, Artificial Sequence
  chemically synthesized
ggtgtagcctgctgaataagtt

SEQ ID NO: 40458 - DNA, 22 bp, Artificial Sequence
  chemically synthesized
ctgaataagttcacagtgatct

SEQ ID NO: 40459 - DNA, 22 bp, Artificial Sequence
  chemically synthesized
aataagttcacagtgatctaca

SEQ ID NO: 40460 - DNA, 22 bp, Artificial Sequence
  chemically synthesized
acagtgatctacatcctagttt

SEQ ID NO: 40461 - DNA, 22 bp, Artificial Sequence
  chemically synthesized
catcctagtttccatgggctga

SEQ ID NO: 40462 - DNA, 22 bp, Artificial Sequence
  chemically synthesized
gtttccatgggctgaaatagaa

SEQ ID NO: 40463 - DNA, 22 bp, Artificial Sequence
  chemically synthesized
ccatgggctgaaatagaatatt

SEQ ID NO: 40464 - DNA, 22 bp, Artificial Sequence
  chemically synthesized
catgggctgaaatagaatattc

SEQ ID NO: 40465 - DNA, 22 bp, Artificial Sequence
  chemically synthesized
aaatagaatattcatatcccct

SEQ ID NO: 40466 - DNA, 22 bp, Artificial Sequence
  chemically synthesized
atatcccctgcactccctacac

SEQ ID NO: 40467 - DNA, 22 bp, Artificial Sequence
  chemically synthesized
cactccctacacacacagacat

SEQ ID NO: 40468 - DNA, 22 bp, Artificial Sequence
  chemically synthesized
cctacacacacagacatagaca

SEQ ID NO: 40469 - DNA, 22 bp, Artificial Sequence
  chemically synthesized
cacacacagacatagacaccaa

SEQ ID NO: 40470 - DNA, 22 bp, Artificial Sequence
  chemically synthesized
ccccaaaaaactctttgcttaa

SEQ ID NO: 40471 - DNA, 22 bp, Artificial Sequence
  chemically synthesized
cccaaaaaactctttgcttaat

SEQ ID NO: 40472 - DNA, 22 bp, Artificial Sequence
  chemically synthesized
tttgcttaatcttctcctgctc

SEQ ID NO: 40473 - DNA, 22 bp, Artificial Sequence
  chemically synthesized
tgcttaatcttctcctgctctg

SEQ ID NO: 40474 - DNA, 22 bp, Artificial Sequence
  chemically synthesized
gcttaatcttctcctgctctgt

SEQ ID NO: 40475 - DNA, 22 bp, Artificial Sequence
  chemically synthesized
cttaatcttctcctgctctgta

SEQ ID NO: 40476 - DNA, 22 bp, Artificial Sequence
  chemically synthesized
aatcttctcctgctctgtattt

SEQ ID NO: 40477 - DNA, 22 bp, Artificial Sequence
  chemically synthesized
atcttctcctgctctgtatttt

SEQ ID NO: 40478 - DNA, 22 bp, Artificial Sequence
  chemically synthesized
ctcctgctctgtattttctttg

SEQ ID NO: 40479 - DNA, 22 bp, Artificial Sequence
  chemically synthesized
tcctgctctgtattttctttga

SEQ ID NO: 40480 - DNA, 22 bp, Artificial Sequence
  chemically synthesized
ctgctctgtattttctttgata

SEQ ID NO: 40481 - DNA, 22 bp, Artificial Sequence
  chemically synthesized
ctctgtattttctttgatattt

SEQ ID NO: 40482 - DNA, 22 bp, Artificial Sequence
  chemically synthesized
tgtattttctttgatattttct

SEQ ID NO: 40483 - DNA, 22 bp, Artificial Sequence
  chemically synthesized
tattttctttgatattttcttg

SEQ ID NO: 40484 - DNA, 22 bp, Artificial Sequence
  chemically synthesized
tctttgatattttcttgaatgg

SEQ ID NO: 40485 - DNA, 22 bp, Artificial Sequence
  chemically synthesized
ctttgatattttcttgaatggc

SEQ ID NO: 40486 - DNA, 22 bp, Artificial Sequence
  chemically synthesized
tttgatattttcttgaatggct

SEQ ID NO: 40487 - DNA, 22 bp, Artificial Sequence
  chemically synthesized
tgatattttcttgaatggcttc

SEQ ID NO: 40488 - DNA, 22 bp, Artificial Sequence
  chemically synthesized
gatattttcttgaatggcttcc

SEQ ID NO: 40489 - DNA, 22 bp, Artificial Sequence
  chemically synthesized
atattttcttgaatggcttcca

SEQ ID NO: 40490 - DNA, 22 bp, Artificial Sequence
  chemically synthesized
tcttgaatggcttccactaaat

SEQ ID NO: 40491 - DNA, 22 bp, Artificial Sequence
  chemically synthesized
cttgaatggcttccactaaatt

SEQ ID NO: 40492 - DNA, 22 bp, Artificial Sequence
  chemically synthesized
ttgaatggcttccactaaattc

SEQ ID NO: 40493 - DNA, 22 bp, Artificial Sequence
  chemically synthesized
gaatggcttccactaaattcaa

SEQ ID NO: 40494 - DNA, 22 bp, Artificial Sequence
  chemically synthesized
aatggcttccactaaattcaaa

SEQ ID NO: 40495 - DNA, 22 bp, Artificial Sequence
  chemically synthesized
ccactaaattcaaatgtgtttg

SEQ ID NO: 40496 - DNA, 22 bp, Artificial Sequence
  chemically synthesized
cactaaattcaaatgtgtttga

SEQ ID NO: 40497 - DNA, 22 bp, Artificial Sequence
  chemically synthesized
aattcaaatgtgtttgacttta

SEQ ID NO: 40498 - DNA, 22 bp, Artificial Sequence
  chemically synthesized
aaatgtgtttgactttaaagtc

SEQ ID NO: 40499 - DNA, 22 bp, Artificial Sequence
  chemically synthesized
gactttaaagtcaacttgtaaa

SEQ ID NO: 40500 - DNA, 22 bp, Artificial Sequence
  chemically synthesized
actttaaagtcaacttgtaaaa

SEQ ID NO: 40501 - DNA, 22 bp, Artificial Sequence
  chemically synthesized
taaagtcaacttgtaaaatttt

SEQ ID NO: 40502 - DNA, 22 bp, Artificial Sequence
  chemically synthesized
aaagtcaacttgtaaaatttta

SEQ ID NO: 40503 - DNA, 22 bp, Artificial Sequence
  chemically synthesized
aagtcaacttgtaaaattttat

SEQ ID NO: 40504 - DNA, 22 bp, Artificial Sequence
  chemically synthesized
gtaaaattttatctggtaattt

SEQ ID NO: 40505 - DNA, 22 bp, Artificial Sequence
  chemically synthesized
taaaattttatctggtaattta

SEQ ID NO: 40506 - DNA, 22 bp, Artificial Sequence
  chemically synthesized
tatctggtaatttatagattaa

SEQ ID NO: 40507 - DNA, 22 bp, Artificial Sequence
  chemically synthesized
atctggtaatttatagattaaa

SEQ ID NO: 40508 - DNA, 22 bp, Artificial Sequence
  chemically synthesized
tctggtaatttatagattaaat

SEQ ID NO: 40509 - DNA, 22 bp, Artificial Sequence
  chemically synthesized
gtaatttatagattaaattgca

SEQ ID NO: 40510 - DNA, 22 bp, Artificial Sequence
  chemically synthesized
atagattaaattgcaagcatct

SEQ ID NO: 40511 - DNA, 22 bp, Artificial Sequence
  chemically synthesized
tagattaaattgcaagcatcta

SEQ ID NO: 40512 - DNA, 22 bp, Artificial Sequence
  chemically synthesized
aattgcaagcatctacctccct

SEQ ID NO: 40513 - DNA, 22 bp, Artificial Sequence
  chemically synthesized
caagcatctacctccctttcat

SEQ ID NO: 40514 - DNA, 22 bp, Artificial Sequence
  chemically synthesized
cctccctttcatcagactctcc

SEQ ID NO: 40515 - DNA, 22 bp, Artificial Sequence
  chemically synthesized
cctttcatcagactctccctgc

SEQ ID NO: 40516 - DNA, 22 bp, Artificial Sequence
  chemically synthesized
tcatcagactctccctgcaggg

SEQ ID NO: 40517 - DNA, 22 bp, Artificial Sequence
  chemically synthesized
catcagactctccctgcagggc

SEQ ID NO: 40518 - DNA, 22 bp, Artificial Sequence
  chemically synthesized
atcagactctccctgcagggca

SEQ ID NO: 40519 - DNA, 22 bp, Artificial Sequence
  chemically synthesized
tccctgcagggcaagttcatct

SEQ ID NO: 40520 - DNA, 22 bp, Artificial Sequence
  chemically synthesized
cctgcagggcaagttcatctaa

SEQ ID NO: 40521 - DNA, 22 bp, Artificial Sequence
  chemically synthesized
cagggcaagttcatctaactat

SEQ ID NO: 40522 - DNA, 22 bp, Artificial Sequence
  chemically synthesized
atctaactatgtatgtgcttca

SEQ ID NO: 40523 - DNA, 22 bp, Artificial Sequence
  chemically synthesized
actatgtatgtgcttcaagatg

SEQ ID NO: 40524 - DNA, 22 bp, Artificial Sequence
  chemically synthesized
tgtatgtgcttcaagatggaac

SEQ ID NO: 40525 - DNA, 22 bp, Artificial Sequence
  chemically synthesized
caagatggaactcctgagttca

SEQ ID NO: 40526 - DNA, 22 bp, Artificial Sequence
  chemically synthesized
aagatggaactcctgagttcac

SEQ ID NO: 40527 - DNA, 22 bp, Artificial Sequence
  chemically synthesized
ctgagttcacaggtgatttata

SEQ ID NO: 40528 - DNA, 22 bp, Artificial Sequence
  chemically synthesized
agttcacaggtgatttataaac

SEQ ID NO: 40529 - DNA, 22 bp, Artificial Sequence
  chemically synthesized
acaggtgatttataaaccaaag

SEQ ID NO: 40530 - DNA, 22 bp, Artificial Sequence
  chemically synthesized
ataaaccaaagcatgcccacta

SEQ ID NO: 40531 - DNA, 22 bp, Artificial Sequence
  chemically synthesized
taaaccaaagcatgcccactac

SEQ ID NO: 40532 - DNA, 22 bp, Artificial Sequence
  chemically synthesized
caaaactctcaccctccagaga

SEQ ID NO: 40533 - DNA, 22 bp, Artificial Sequence
  chemically synthesized
tcaccctccagagatttgcctc

SEQ ID NO: 40534 - DNA, 22 bp, Artificial Sequence
  chemically synthesized
accctccagagatttgcctcaa

SEQ ID NO: 40535 - DNA, 22 bp, Artificial Sequence
  chemically synthesized
cagagatttgcctcaagggaca

SEQ ID NO: 40536 - DNA, 22 bp, Artificial Sequence
  chemically synthesized
gcctcaagggacaacaccctgc

SEQ ID NO: 40537 - DNA, 22 bp, Artificial Sequence
  chemically synthesized
cctcaagggacaacaccctgct

SEQ ID NO: 40538 - DNA, 22 bp, Artificial Sequence
  chemically synthesized
aagggacaacaccctgctcaca

SEQ ID NO: 40539 - DNA, 22 bp, Artificial Sequence
  chemically synthesized
ctcacaaaggcaccagcaggca

SEQ ID NO: 40540 - DNA, 22 bp, Artificial Sequence
  chemically synthesized
acaaaggcaccagcaggcaact

SEQ ID NO: 40541 - DNA, 22 bp, Artificial Sequence
  chemically synthesized
ctcaactacctggtggataagg

SEQ ID NO: 40542 - DNA, 22 bp, Artificial Sequence
  chemically synthesized
aactacctggtggataaggtgc

SEQ ID NO: 40543 - DNA, 22 bp, Artificial Sequence
  chemically synthesized
cctggtggataaggtgcccaag

SEQ ID NO: 40544 - DNA, 22 bp, Artificial Sequence
  chemically synthesized
gtggataaggtgcccaagctag

SEQ ID NO: 40545 - DNA, 22 bp, Artificial Sequence
  chemically synthesized
gcatggacccctgaatccttgc

SEQ ID NO: 40546 - DNA, 22 bp, Artificial Sequence
  chemically synthesized
aatccttgctcgcctcctctgt

SEQ ID NO: 40547 - DNA, 22 bp, Artificial Sequence
  chemically synthesized
gctcgcctcctctgttgccttt

SEQ ID NO: 40548 - DNA, 22 bp, Artificial Sequence
  chemically synthesized
ctcgcctcctctgttgcctttt

SEQ ID NO: 40549 - DNA, 22 bp, Artificial Sequence
  chemically synthesized
gcctcctctgttgccttttaaa

SEQ ID NO: 40550 - DNA, 22 bp, Artificial Sequence
  chemically synthesized
ctctgttgccttttaaaagtgc

SEQ ID NO: 40551 - DNA, 22 bp, Artificial Sequence
  chemically synthesized
tgttgccttttaaaagtgccac

SEQ ID NO: 40552 - DNA, 22 bp, Artificial Sequence
  chemically synthesized
ttgccttttaaaagtgccactt

SEQ ID NO: 40553 - DNA, 22 bp, Artificial Sequence
  chemically synthesized
ccttttaaaagtgccactttct

SEQ ID NO: 40554 - DNA, 22 bp, Artificial Sequence
  chemically synthesized
ttaaaagtgccactttctgctc

SEQ ID NO: 40555 - DNA, 22 bp, Artificial Sequence
  chemically synthesized
taaaagtgccactttctgctcc

SEQ ID NO: 40556 - DNA, 22 bp, Artificial Sequence
  chemically synthesized
aaaagtgccactttctgctcct

SEQ ID NO: 40557 - DNA, 22 bp, Artificial Sequence
  chemically synthesized
aaagtgccactttctgctccta

SEQ ID NO: 40558 - DNA, 22 bp, Artificial Sequence
  chemically synthesized
tctgctcctaaagtgaagtagt

SEQ ID NO: 40559 - DNA, 22 bp, Artificial Sequence
  chemically synthesized
ctgctcctaaagtgaagtagta

SEQ ID NO: 40560 - DNA, 22 bp, Artificial Sequence
  chemically synthesized
tgctcctaaagtgaagtagtac

SEQ ID NO: 40561 - DNA, 22 bp, Artificial Sequence
  chemically synthesized
ctcctaaagtgaagtagtacgg

SEQ ID NO: 40562 - DNA, 22 bp, Artificial Sequence
  chemically synthesized
ctaaagtgaagtagtacggcag

SEQ ID NO: 40563 - DNA, 22 bp, Artificial Sequence
  chemically synthesized
aagtgaagtagtacggcaggac

SEQ ID NO: 40564 - DNA, 22 bp, Artificial Sequence
  chemically synthesized
ctgcatttcttcccctaagcta

SEQ ID NO: 40565 - DNA, 22 bp, Artificial Sequence
  chemically synthesized
catttcttcccctaagctagct

SEQ ID NO: 40566 - DNA, 22 bp, Artificial Sequence
  chemically synthesized
cttcccctaagctagctttgga

SEQ ID NO: 40567 - DNA, 22 bp, Artificial Sequence
  chemically synthesized
ttcccctaagctagctttggaa

SEQ ID NO: 40568 - DNA, 22 bp, Artificial Sequence
  chemically synthesized
cccctaagctagctttggaagc

SEQ ID NO: 40569 - DNA, 22 bp, Artificial Sequence
  chemically synthesized
ccctaagctagctttggaagca

SEQ ID NO: 40570 - DNA, 22 bp, Artificial Sequence
  chemically synthesized
agctagctttggaagcaaatca

SEQ ID NO: 40571 - DNA, 22 bp, Artificial Sequence
  chemically synthesized
gctttggaagcaaatcactttc

SEQ ID NO: 40572 - DNA, 22 bp, Artificial Sequence
  chemically synthesized
tggaagcaaatcactttcttta

SEQ ID NO: 40573 - DNA, 22 bp, Artificial Sequence
  chemically synthesized
ggaagcaaatcactttctttat

SEQ ID NO: 40574 - DNA, 22 bp, Artificial Sequence
  chemically synthesized
gaagcaaatcactttctttata

SEQ ID NO: 40575 - DNA, 22 bp, Artificial Sequence
  chemically synthesized
tctttataccagacttctctct

SEQ ID NO: 40576 - DNA, 22 bp, Artificial Sequence
  chemically synthesized
ctttataccagacttctctctt

SEQ ID NO: 40577 - DNA, 22 bp, Artificial Sequence
  chemically synthesized
tttataccagacttctctcttc

SEQ ID NO: 40578 - DNA, 22 bp, Artificial Sequence
  chemically synthesized
tataccagacttctctcttctt

SEQ ID NO: 40579 - DNA, 22 bp, Artificial Sequence
  chemically synthesized
ataccagacttctctcttctta

SEQ ID NO: 40580 - DNA, 22 bp, Artificial Sequence
  chemically synthesized
taccagacttctctcttcttaa

SEQ ID NO: 40581 - DNA, 22 bp, Artificial Sequence
  chemically synthesized
ctctcttcttaattggattctg

SEQ ID NO: 40582 - DNA, 22 bp, Artificial Sequence
  chemically synthesized
tctcttcttaattggattctgc

SEQ ID NO: 40583 - DNA, 22 bp, Artificial Sequence
  chemically synthesized
tcttcttaattggattctgcaa

SEQ ID NO: 40584 - DNA, 22 bp, Artificial Sequence
  chemically synthesized
ttcttaattggattctgcaagt

SEQ ID NO: 40585 - DNA, 22 bp, Artificial Sequence
  chemically synthesized
cttaattggattctgcaagtgg

SEQ ID NO: 40586 - DNA, 22 bp, Artificial Sequence
  chemically synthesized
ttaattggattctgcaagtggc

SEQ ID NO: 40587 - DNA, 22 bp, Artificial Sequence
  chemically synthesized
aattggattctgcaagtggcaa

SEQ ID NO: 40588 - DNA, 22 bp, Artificial Sequence
  chemically synthesized
attggattctgcaagtggcaaa

SEQ ID NO: 40589 - DNA, 22 bp, Artificial Sequence
  chemically synthesized
gattctgcaagtggcaaacaat

SEQ ID NO: 40590 - DNA, 22 bp, Artificial Sequence
  chemically synthesized
tgcaagtggcaaacaattaacc

SEQ ID NO: 40591 - DNA, 22 bp, Artificial Sequence
  chemically synthesized
caagtggcaaacaattaacctg

SEQ ID NO: 40592 - DNA, 22 bp, Artificial Sequence
  chemically synthesized
acctgctcttcagttacattgg

SEQ ID NO: 40593 - DNA, 22 bp, Artificial Sequence
  chemically synthesized
ctcttcagttacattggaatgt

SEQ ID NO: 40594 - DNA, 22 bp, Artificial Sequence
  chemically synthesized
ttcagttacattggaatgtgtt

SEQ ID NO: 40595 - DNA, 22 bp, Artificial Sequence
  chemically synthesized
cagttacattggaatgtgttta

SEQ ID NO: 40596 - DNA, 22 bp, Artificial Sequence
  chemically synthesized
agttacattggaatgtgtttag

SEQ ID NO: 40597 - DNA, 22 bp, Artificial Sequence
  chemically synthesized
cattggaatgtgtttagattta

SEQ ID NO: 40598 - DNA, 22 bp, Artificial Sequence
  chemically synthesized
gaatgtgtttagatttattttt

SEQ ID NO: 40599 - DNA, 22 bp, Artificial Sequence
  chemically synthesized
agatttattttttcaaatgttg

SEQ ID NO: 40600 - DNA, 22 bp, Artificial Sequence
  chemically synthesized
gatttattttttcaaatgttgg

SEQ ID NO: 40601 - DNA, 22 bp, Artificial Sequence
  chemically synthesized
attttttcaaatgttggaacaa

SEQ ID NO: 40602 - DNA, 22 bp, Artificial Sequence
  chemically synthesized
ttttttcaaatgttggaacaaa

SEQ ID NO: 40603 - DNA, 22 bp, Artificial Sequence
  chemically synthesized
tttcaaatgttggaacaaagat

SEQ ID NO: 40604 - DNA, 22 bp, Artificial Sequence
  chemically synthesized
ttcaaatgttggaacaaagatg

SEQ ID NO: 40605 - DNA, 22 bp, Artificial Sequence
  chemically synthesized
tcaaatgttggaacaaagatga

SEQ ID NO: 40606 - DNA, 22 bp, Artificial Sequence
  chemically synthesized
caaatgttggaacaaagatgaa

SEQ ID NO: 40607 - DNA, 22 bp, Artificial Sequence
  chemically synthesized
aaatgttggaacaaagatgaaa

SEQ ID NO: 40608 - DNA, 22 bp, Artificial Sequence
  chemically synthesized
gaacaaagatgaaaaagtgaga

SEQ ID NO: 40609 - DNA, 22 bp, Artificial Sequence
  chemically synthesized
gattttttcttggaaatctggc

SEQ ID NO: 40610 - DNA, 22 bp, Artificial Sequence
  chemically synthesized
tttcttggaaatctggcttaaa

SEQ ID NO: 40611 - DNA, 22 bp, Artificial Sequence
  chemically synthesized
ttcttggaaatctggcttaaat

SEQ ID NO: 40612 - DNA, 22 bp, Artificial Sequence
  chemically synthesized
tcttggaaatctggcttaaatc

SEQ ID NO: 40613 - DNA, 22 bp, Artificial Sequence
  chemically synthesized
cttggaaatctggcttaaatcc

SEQ ID NO: 40614 - DNA, 22 bp, Artificial Sequence
  chemically synthesized
ttggaaatctggcttaaatcca

SEQ ID NO: 40615 - DNA, 22 bp, Artificial Sequence
  chemically synthesized
ggaaatctggcttaaatccagg

SEQ ID NO: 40616 - DNA, 22 bp, Artificial Sequence
  chemically synthesized
gaaatctggcttaaatccaggt

SEQ ID NO: 40617 - DNA, 22 bp, Artificial Sequence
  chemically synthesized
gcttaaatccaggtttctttat

SEQ ID NO: 40618 - DNA, 22 bp, Artificial Sequence
  chemically synthesized
aaatccaggtttctttatttcc

SEQ ID NO: 40619 - DNA, 22 bp, Artificial Sequence
  chemically synthesized
aatccaggtttctttatttcct

SEQ ID NO: 40620 - DNA, 22 bp, Artificial Sequence
  chemically synthesized
ctttatttccttgatttgggaa

SEQ ID NO: 40621 - DNA, 22 bp, Artificial Sequence
  chemically synthesized
tttatttccttgatttgggaat

SEQ ID NO: 40622 - DNA, 22 bp, Artificial Sequence
  chemically synthesized
tatttccttgatttgggaattt

SEQ ID NO: 40623 - DNA, 22 bp, Artificial Sequence
  chemically synthesized
atttccttgatttgggaatttg

SEQ ID NO: 40624 - DNA, 22 bp, Artificial Sequence
  chemically synthesized
tttccttgatttgggaatttgg

SEQ ID NO: 40625 - DNA, 22 bp, Artificial Sequence
  chemically synthesized
ccttgatttgggaatttggtca

SEQ ID NO: 40626 - DNA, 22 bp, Artificial Sequence
  chemically synthesized
cttgatttgggaatttggtcac

SEQ ID NO: 40627 - DNA, 22 bp, Artificial Sequence
  chemically synthesized
gatttgggaatttggtcacgag

SEQ ID NO: 40628 - DNA, 22 bp, Artificial Sequence
  chemically synthesized
atttgggaatttggtcacgaga

SEQ ID NO: 40629 - DNA, 22 bp, Artificial Sequence
  chemically synthesized
gggaatttggtcacgagacaaa

SEQ ID NO: 40630 - DNA, 22 bp, Artificial Sequence
  chemically synthesized
ggaatttggtcacgagacaaat

SEQ ID NO: 40631 - DNA, 22 bp, Artificial Sequence
  chemically synthesized
ggtcacgagacaaataacatga

SEQ ID NO: 40632 - DNA, 22 bp, Artificial Sequence
  chemically synthesized
gtcacgagacaaataacatgat

SEQ ID NO: 40633 - DNA, 22 bp, Artificial Sequence
  chemically synthesized
tcctaagtctagatttctttgt

SEQ ID NO: 40634 - DNA, 22 bp, Artificial Sequence
  chemically synthesized
cctaagtctagatttctttgtt

SEQ ID NO: 40635 - DNA, 22 bp, Artificial Sequence
  chemically synthesized
ctaagtctagatttctttgttt

SEQ ID NO: 40636 - DNA, 22 bp, Artificial Sequence
  chemically synthesized
agtctagatttctttgtttata

SEQ ID NO: 40637 - DNA, 22 bp, Artificial Sequence
  chemically synthesized
gatttctttgtttataaaatgg

SEQ ID NO: 40638 - DNA, 22 bp, Artificial Sequence
  chemically synthesized
ctttgtttataaaatggggatg

SEQ ID NO: 40639 - DNA, 22 bp, Artificial Sequence
  chemically synthesized
tttgtttataaaatggggatga

SEQ ID NO: 40640 - DNA, 22 bp, Artificial Sequence
  chemically synthesized
tgtttataaaatggggatgact

SEQ ID NO: 40641 - DNA, 22 bp, Artificial Sequence
  chemically synthesized
gtttataaaatggggatgacta

SEQ ID NO: 40642 - DNA, 22 bp, Artificial Sequence
  chemically synthesized
tttataaaatggggatgactat

SEQ ID NO: 40643 - DNA, 22 bp, Artificial Sequence
  chemically synthesized
ataaaatggggatgactatgct

SEQ ID NO: 40644 - DNA, 22 bp, Artificial Sequence
  chemically synthesized
taaaatggggatgactatgcta

SEQ ID NO: 40645 - DNA, 22 bp, Artificial Sequence
  chemically synthesized
tgctaccctacctataccatga

SEQ ID NO: 40646 - DNA, 22 bp, Artificial Sequence
  chemically synthesized
ccctacctataccatgagctaa

SEQ ID NO: 40647 - DNA, 22 bp, Artificial Sequence
  chemically synthesized
cctataccatgagctaaataag

SEQ ID NO: 40648 - DNA, 22 bp, Artificial Sequence
  chemically synthesized
taccatgagctaaataagctag

SEQ ID NO: 40649 - DNA, 22 bp, Artificial Sequence
  chemically synthesized
aataagctagtatttgtaaagg

SEQ ID NO: 40650 - DNA, 22 bp, Artificial Sequence
  chemically synthesized
gtatttgtaaaggacacacact

SEQ ID NO: 40651 - DNA, 22 bp, Artificial Sequence
  chemically synthesized
gtaaaggacacacacttacatt

SEQ ID NO: 40652 - DNA, 22 bp, Artificial Sequence
  chemically synthesized
taaaggacacacacttacattc

SEQ ID NO: 40653 - DNA, 22 bp, Artificial Sequence
  chemically synthesized
acattcacaatcacacacggtg

SEQ ID NO: 40654 - DNA, 22 bp, Artificial Sequence
  chemically synthesized
cattcacaatcacacacggtgt

SEQ ID NO: 40655 - DNA, 22 bp, Artificial Sequence
  chemically synthesized
acaatcacacacggtgtgtatg

SEQ ID NO: 40656 - DNA, 22 bp, Artificial Sequence
  chemically synthesized
acccactcaacaaataccctga

SEQ ID NO: 40657 - DNA, 22 bp, Artificial Sequence
  chemically synthesized
aacaaataccctgagtatttgt

SEQ ID NO: 40658 - DNA, 22 bp, Artificial Sequence
  chemically synthesized
agtatttgttgaatcattatat

SEQ ID NO: 40659 - DNA, 22 bp, Artificial Sequence
  chemically synthesized
gttgaatcattatatgcgtata

SEQ ID NO: 40660 - DNA, 22 bp, Artificial Sequence
  chemically synthesized
ttgaatcattatatgcgtatat

SEQ ID NO: 40661 - DNA, 22 bp, Artificial Sequence
  chemically synthesized
aatcattatatgcgtatatcat

SEQ ID NO: 40662 - DNA, 22 bp, Artificial Sequence
  chemically synthesized
tatgcgtatatcatctggcaaa

SEQ ID NO: 40663 - DNA, 22 bp, Artificial Sequence
  chemically synthesized
gcaaatggatgtgtataatttc

SEQ ID NO: 40664 - DNA, 22 bp, Artificial Sequence
  chemically synthesized
ctccagggataagaagcaaatg

SEQ ID NO: 40665 - DNA, 22 bp, Artificial Sequence
  chemically synthesized
tccagggataagaagcaaatgt

SEQ ID NO: 40666 - DNA, 22 bp, Artificial Sequence
  chemically synthesized
cagggataagaagcaaatgtat

SEQ ID NO: 40667 - DNA, 22 bp, Artificial Sequence
  chemically synthesized
actcaggccataacaaagagag

SEQ ID NO: 40668 - DNA, 22 bp, Artificial Sequence
  chemically synthesized
ctcaggccataacaaagagaga

SEQ ID NO: 40669 - DNA, 22 bp, Artificial Sequence
  chemically synthesized
aggccataacaaagagagaaat

SEQ ID NO: 40670 - DNA, 22 bp, Artificial Sequence
  chemically synthesized
agtcccactccatgaacaggtc

SEQ ID NO: 40671 - DNA, 22 bp, Artificial Sequence
  chemically synthesized
catgaacaggtcaaggaaccaa

SEQ ID NO: 40672 - DNA, 22 bp, Artificial Sequence
  chemically synthesized
aaagagttatttcattgtttca

SEQ ID NO: 40673 - DNA, 22 bp, Artificial Sequence
  chemically synthesized
tttcattgtttcaacttgctag

SEQ ID NO: 40674 - DNA, 22 bp, Artificial Sequence
  chemically synthesized
cattgtttcaacttgctagtga

SEQ ID NO: 40675 - DNA, 22 bp, Artificial Sequence
  chemically synthesized
attgtttcaacttgctagtgag

SEQ ID NO: 40676 - DNA, 22 bp, Artificial Sequence
  chemically synthesized
tttcaacttgctagtgagggga

SEQ ID NO: 40677 - DNA, 22 bp, Artificial Sequence
  chemically synthesized
caacttgctagtgaggggagca

SEQ ID NO: 40678 - DNA, 22 bp, Artificial Sequence
  chemically synthesized
aacttgctagtgaggggagcat

SEQ ID NO: 40679 - DNA, 22 bp, Artificial Sequence
  chemically synthesized
gctagtgaggggagcatggcac

SEQ ID NO: 40680 - DNA, 22 bp, Artificial Sequence
  chemically synthesized
ctagtgaggggagcatggcacc

SEQ ID NO: 40681 - DNA, 22 bp, Artificial Sequence
  chemically synthesized
gtgaggggagcatggcacctga

SEQ ID NO: 40682 - DNA, 22 bp, Artificial Sequence
  chemically synthesized
aacagagatgatataaattaat

SEQ ID NO: 40683 - DNA, 22 bp, Artificial Sequence
  chemically synthesized
atgaaactgagaaccaagcgaa

SEQ ID NO: 40684 - DNA, 22 bp, Artificial Sequence
  chemically synthesized
agaaccaagcgaagagcttagc

SEQ ID NO: 40685 - DNA, 22 bp, Artificial Sequence
  chemically synthesized
agccatcctttgcatagttagc

SEQ ID NO: 40686 - DNA, 22 bp, Artificial Sequence
  chemically synthesized
gccatcctttgcatagttagct

SEQ ID NO: 40687 - DNA, 22 bp, Artificial Sequence
  chemically synthesized
tgcatagttagctacaatggct

SEQ ID NO: 40688 - DNA, 22 bp, Artificial Sequence
  chemically synthesized
gcatagttagctacaatggcta

SEQ ID NO: 40689 - DNA, 22 bp, Artificial Sequence
  chemically synthesized
catagttagctacaatggctat

SEQ ID NO: 40690 - DNA, 22 bp, Artificial Sequence
  chemically synthesized
gctacaatggctatttattttt

SEQ ID NO: 40691 - DNA, 22 bp, Artificial Sequence
  chemically synthesized
caatggctatttatttttcagc

SEQ ID NO: 40692 - DNA, 22 bp, Artificial Sequence
  chemically synthesized
tttatttttcagccagactggc

SEQ ID NO: 40693 - DNA, 22 bp, Artificial Sequence
  chemically synthesized
atttttcagccagactggccat

SEQ ID NO: 40694 - DNA, 22 bp, Artificial Sequence
  chemically synthesized
tttttcagccagactggccatc

SEQ ID NO: 40695 - DNA, 22 bp, Artificial Sequence
  chemically synthesized
ttcagccagactggccatcatg

SEQ ID NO: 40696 - DNA, 22 bp, Artificial Sequence
  chemically synthesized
tcagccagactggccatcatgt

SEQ ID NO: 40697 - DNA, 22 bp, Artificial Sequence
  chemically synthesized
cagccagactggccatcatgta

SEQ ID NO: 40698 - DNA, 22 bp, Artificial Sequence
  chemically synthesized
agccagactggccatcatgtag

SEQ ID NO: 40699 - DNA, 22 bp, Artificial Sequence
  chemically synthesized
gccatcatgtaggcacactctt

SEQ ID NO: 40700 - DNA, 22 bp, Artificial Sequence
  chemically synthesized
ttttagattagaaaaatcaacc

SEQ ID NO: 40701 - DNA, 22 bp, Artificial Sequence
  chemically synthesized
ttagattagaaaaatcaaccat

SEQ ID NO: 40702 - DNA, 22 bp, Artificial Sequence
  chemically synthesized
tagattagaaaaatcaaccatt

SEQ ID NO: 40703 - DNA, 22 bp, Artificial Sequence
  chemically synthesized
agattagaaaaatcaaccatta

SEQ ID NO: 40704 - DNA, 22 bp, Artificial Sequence
  chemically synthesized
gattagaaaaatcaaccattat

SEQ ID NO: 40705 - DNA, 22 bp, Artificial Sequence
  chemically synthesized
gaaaaatcaaccattatttttt

SEQ ID NO: 40706 - DNA, 22 bp, Artificial Sequence
  chemically synthesized
ttttttctgcccattcattcca

SEQ ID NO: 40707 - DNA, 22 bp, Artificial Sequence
  chemically synthesized
tttctgcccattcattccagca

SEQ ID NO: 40708 - DNA, 22 bp, Artificial Sequence
  chemically synthesized
ttctgcccattcattccagcac

SEQ ID NO: 40709 - DNA, 22 bp, Artificial Sequence
  chemically synthesized
tctgcccattcattccagcacc

SEQ ID NO: 40710 - DNA, 22 bp, Artificial Sequence
  chemically synthesized
ctgcccattcattccagcaccg

SEQ ID NO: 40711 - DNA, 22 bp, Artificial Sequence
  chemically synthesized
tgcccattcattccagcaccgt

SEQ ID NO: 40712 - DNA, 22 bp, Artificial Sequence
  chemically synthesized
cccattcattccagcaccgtga

SEQ ID NO: 40713 - DNA, 22 bp, Artificial Sequence
  chemically synthesized
attccagcaccgtgacagtctt

SEQ ID NO: 40714 - DNA, 22 bp, Artificial Sequence
  chemically synthesized
cagcaccgtgacagtcttcacg

SEQ ID NO: 40715 - DNA, 22 bp, Artificial Sequence
  chemically synthesized
cacggggaaattaaacttattt

SEQ ID NO: 40716 - DNA, 22 bp, Artificial Sequence
  chemically synthesized
acggggaaattaaacttatttt

SEQ ID NO: 40717 - DNA, 22 bp, Artificial Sequence
  chemically synthesized
aacttatttttttaagaatttt

SEQ ID NO: 40718 - DNA, 22 bp, Artificial Sequence
  chemically synthesized
atttttttaagaatttttcaat

SEQ ID NO: 40719 - DNA, 22 bp, Artificial Sequence
  chemically synthesized
tttttttaagaatttttcaatc

SEQ ID NO: 40720 - DNA, 22 bp, Artificial Sequence
  chemically synthesized
ttttaagaatttttcaatcata

SEQ ID NO: 40721 - DNA, 22 bp, Artificial Sequence
  chemically synthesized
tttaagaatttttcaatcatat

SEQ ID NO: 40722 - DNA, 22 bp, Artificial Sequence
  chemically synthesized
ttaagaatttttcaatcatata

SEQ ID NO: 40723 - DNA, 22 bp, Artificial Sequence
  chemically synthesized
taagaatttttcaatcatatac

SEQ ID NO: 40724 - DNA, 22 bp, Artificial Sequence
  chemically synthesized
aagaatttttcaatcatataca

SEQ ID NO: 40725 - DNA, 22 bp, Artificial Sequence
  chemically synthesized
agaatttttcaatcatatacaa

SEQ ID NO: 40726 - DNA, 22 bp, Artificial Sequence
  chemically synthesized
ttcaatcatatacaagattttg

SEQ ID NO: 40727 - DNA, 22 bp, Artificial Sequence
  chemically synthesized
tcaatcatatacaagattttga

SEQ ID NO: 40728 - DNA, 22 bp, Artificial Sequence
  chemically synthesized
caatcatatacaagattttgaa

SEQ ID NO: 40729 - DNA, 22 bp, Artificial Sequence
  chemically synthesized
aatcatatacaagattttgaac

SEQ ID NO: 40730 - DNA, 22 bp, Artificial Sequence
  chemically synthesized
tgaactgggaatttcatgaatc

SEQ ID NO: 40731 - DNA, 22 bp, Artificial Sequence
  chemically synthesized
gaactgggaatttcatgaatca

SEQ ID NO: 40732 - DNA, 22 bp, Artificial Sequence
  chemically synthesized
aactgggaatttcatgaatcaa

SEQ ID NO: 40733 - DNA, 22 bp, Artificial Sequence
  chemically synthesized
ggaatttcatgaatcaaaaatt

SEQ ID NO: 40734 - DNA, 22 bp, Artificial Sequence
  chemically synthesized
catgaatcaaaaattaaatgaa

SEQ ID NO: 40735 - DNA, 22 bp, Artificial Sequence
  chemically synthesized
atgaatcaaaaattaaatgaat

SEQ ID NO: 40736 - DNA, 22 bp, Artificial Sequence
  chemically synthesized
aatgaattgcacataaagccat

SEQ ID NO: 40737 - DNA, 22 bp, Artificial Sequence
  chemically synthesized
cacataaagccatggcatatgt

SEQ ID NO: 40738 - DNA, 22 bp, Artificial Sequence
  chemically synthesized
ttactacattgtgggagaaaaa

SEQ ID NO: 40739 - DNA, 22 bp, Artificial Sequence
  chemically synthesized
tactacattgtgggagaaaaaa

SEQ ID NO: 40740 - DNA, 22 bp, Artificial Sequence
  chemically synthesized
actacattgtgggagaaaaaat

SEQ ID NO: 40741 - DNA, 22 bp, Artificial Sequence
  chemically synthesized
ctacattgtgggagaaaaaata

SEQ ID NO: 40742 - DNA, 22 bp, Artificial Sequence
  chemically synthesized
cattgtgggagaaaaaataatt

SEQ ID NO: 40743 - DNA, 22 bp, Artificial Sequence
  chemically synthesized
tgggagaaaaaataattcttat

SEQ ID NO: 40744 - DNA, 22 bp, Artificial Sequence
  chemically synthesized
ttataatttaaaaaaactatgt

SEQ ID NO: 40745 - DNA, 22 bp, Artificial Sequence
  chemically synthesized
ataatttaaaaaaactatgtct

SEQ ID NO: 40746 - DNA, 22 bp, Artificial Sequence
  chemically synthesized
taatttaaaaaaactatgtctt

SEQ ID NO: 40747 - DNA, 22 bp, Artificial Sequence
  chemically synthesized
aaaaaaactatgtcttacctga

SEQ ID NO: 40748 - DNA, 22 bp, Artificial Sequence
  chemically synthesized
aaaaaactatgtcttacctgat

SEQ ID NO: 40749 - DNA, 22 bp, Artificial Sequence
  chemically synthesized
tgtcttacctgatttcagaaat

SEQ ID NO: 40750 - DNA, 22 bp, Artificial Sequence
  chemically synthesized
acctgatttcagaaataaaaga

SEQ ID NO: 40751 - DNA, 22 bp, Artificial Sequence
  chemically synthesized
cctgatttcagaaataaaagaa

SEQ ID NO: 40752 - DNA, 22 bp, Artificial Sequence
  chemically synthesized
atttcagaaataaaagaagtag

SEQ ID NO: 40753 - DNA, 22 bp, Artificial Sequence
  chemically synthesized
cagaaataaaagaagtagaaga

SEQ ID NO: 40754 - DNA, 22 bp, Artificial Sequence
  chemically synthesized
agaaataaaagaagtagaagaa

SEQ ID NO: 40755 - DNA, 22 bp, Artificial Sequence
  chemically synthesized
ccttatgttccattttgggact

SEQ ID NO: 40756 - DNA, 22 bp, Artificial Sequence
  chemically synthesized
cttatgttccattttgggactg

SEQ ID NO: 40757 - DNA, 22 bp, Artificial Sequence
  chemically synthesized
atgttccattttgggactggcc

SEQ ID NO: 40758 - DNA, 22 bp, Artificial Sequence
  chemically synthesized
tgttccattttgggactggcca

SEQ ID NO: 40759 - DNA, 22 bp, Artificial Sequence
  chemically synthesized
cattttgggactggccagcagt

SEQ ID NO: 40760 - DNA, 22 bp, Artificial Sequence
  chemically synthesized
tgggactggccagcagtgccca

SEQ ID NO: 40761 - DNA, 22 bp, Artificial Sequence
  chemically synthesized
gggactggccagcagtgcccag

SEQ ID NO: 40762 - DNA, 22 bp, Artificial Sequence
  chemically synthesized
ggactggccagcagtgcccaga

SEQ ID NO: 40763 - DNA, 22 bp, Artificial Sequence
  chemically synthesized
gccagcagtgcccagaaagtgt

SEQ ID NO: 40764 - DNA, 22 bp, Artificial Sequence
  chemically synthesized
ttgacttacatgagagtaaacg

SEQ ID NO: 40765 - DNA, 22 bp, Artificial Sequence
  chemically synthesized
acttacatgagagtaaacgcac

SEQ ID NO: 40766 - DNA, 22 bp, Artificial Sequence
  chemically synthesized
acatgagagtaaacgcacccac

SEQ ID NO: 40767 - DNA, 22 bp, Artificial Sequence
  chemically synthesized
catgagagtaaacgcacccaca

SEQ ID NO: 40768 - DNA, 22 bp, Artificial Sequence
  chemically synthesized
agttaatgattctctcagagac

SEQ ID NO: 40769 - DNA, 22 bp, Artificial Sequence
  chemically synthesized
atgattctctcagagacccatg

SEQ ID NO: 40770 - DNA, 22 bp, Artificial Sequence
  chemically synthesized
tctcagagacccatgccactgg

SEQ ID NO: 40771 - DNA, 22 bp, Artificial Sequence
  chemically synthesized
tcagagacccatgccactggct

SEQ ID NO: 40772 - DNA, 22 bp, Artificial Sequence
  chemically synthesized
agagacccatgccactggctca

SEQ ID NO: 40773 - DNA, 22 bp, Artificial Sequence
  chemically synthesized
gctcagcagggttcaaacatta

SEQ ID NO: 40774 - DNA, 22 bp, Artificial Sequence
  chemically synthesized
agcagggttcaaacattacctt

SEQ ID NO: 40775 - DNA, 22 bp, Artificial Sequence
  chemically synthesized
aaacattaccttgaatatagag

SEQ ID NO: 40776 - DNA, 22 bp, Artificial Sequence
  chemically synthesized
ccttgaatatagagtcttataa

SEQ ID NO: 40777 - DNA, 22 bp, Artificial Sequence
  chemically synthesized
gaatatagagtcttataaaata

SEQ ID NO: 40778 - DNA, 22 bp, Artificial Sequence
  chemically synthesized
aatatagagtcttataaaatat

SEQ ID NO: 40779 - DNA, 22 bp, Artificial Sequence
  chemically synthesized
ataaaatatttgagagtgcaat

SEQ ID NO: 40780 - DNA, 22 bp, Artificial Sequence
  chemically synthesized
taaaatatttgagagtgcaatg

SEQ ID NO: 40781 - DNA, 22 bp, Artificial Sequence
  chemically synthesized
gagagtgcaatgtcaatagatg

SEQ ID NO: 40782 - DNA, 22 bp, Artificial Sequence
  chemically synthesized
agagtgcaatgtcaatagatgc

SEQ ID NO: 40783 - DNA, 22 bp, Artificial Sequence
  chemically synthesized
ggaagtggtgaaagccatttcc

SEQ ID NO: 40784 - DNA, 22 bp, Artificial Sequence
  chemically synthesized
cccccctcagctgctccacatt

SEQ ID NO: 40785 - DNA, 22 bp, Artificial Sequence
  chemically synthesized
ccccctcagctgctccacattg

SEQ ID NO: 40786 - DNA, 22 bp, Artificial Sequence
  chemically synthesized
agctgctccacattgcctttat

SEQ ID NO: 40787 - DNA, 22 bp, Artificial Sequence
  chemically synthesized
ctccacattgcctttatgtctc

SEQ ID NO: 40788 - DNA, 22 bp, Artificial Sequence
  chemically synthesized
cacattgcctttatgtctcctt

SEQ ID NO: 40789 - DNA, 22 bp, Artificial Sequence
  chemically synthesized
cctttatgtctccttactcctt

SEQ ID NO: 40790 - DNA, 22 bp, Artificial Sequence
  chemically synthesized
tatgtctccttactccttccct

SEQ ID NO: 40791 - DNA, 22 bp, Artificial Sequence
  chemically synthesized
atgtctccttactccttccctc

SEQ ID NO: 40792 - DNA, 22 bp, Artificial Sequence
  chemically synthesized
tgtctccttactccttccctca

SEQ ID NO: 40793 - DNA, 22 bp, Artificial Sequence
  chemically synthesized
cttactccttccctcaccccta

SEQ ID NO: 40794 - DNA, 22 bp, Artificial Sequence
  chemically synthesized
actccttccctcacccctagac

SEQ ID NO: 40795 - DNA, 22 bp, Artificial Sequence
  chemically synthesized
ctccttccctcacccctagacc

SEQ ID NO: 40796 - DNA, 22 bp, Artificial Sequence
  chemically synthesized
cttccctcacccctagaccttc

SEQ ID NO: 40797 - DNA, 22 bp, Artificial Sequence
  chemically synthesized
ccctcacccctagaccttcatc

SEQ ID NO: 40798 - DNA, 22 bp, Artificial Sequence
  chemically synthesized
cctcacccctagaccttcatct

SEQ ID NO: 40799 - DNA, 22 bp, Artificial Sequence
  chemically synthesized
acccctagaccttcatctttcc

SEQ ID NO: 40800 - DNA, 22 bp, Artificial Sequence
  chemically synthesized
gaccttcatctttcctgattag

SEQ ID NO: 40801 - DNA, 22 bp, Artificial Sequence
  chemically synthesized
catctttcctgattagtcttgt

SEQ ID NO: 40802 - DNA, 22 bp, Artificial Sequence
  chemically synthesized
atctttcctgattagtcttgtt

SEQ ID NO: 40803 - DNA, 22 bp, Artificial Sequence
  chemically synthesized
tcctgattagtcttgtttcctc

SEQ ID NO: 40804 - DNA, 22 bp, Artificial Sequence
  chemically synthesized
cctgattagtcttgtttcctcc

SEQ ID NO: 40805 - DNA, 22 bp, Artificial Sequence
  chemically synthesized
ctgattagtcttgtttcctccc

SEQ ID NO: 40806 - DNA, 22 bp, Artificial Sequence
  chemically synthesized
attagtcttgtttcctcccctc

SEQ ID NO: 40807 - DNA, 22 bp, Artificial Sequence
  chemically synthesized
gtcttgtttcctcccctcttct

SEQ ID NO: 40808 - DNA, 22 bp, Artificial Sequence
  chemically synthesized
gtttcctcccctcttctttcat

SEQ ID NO: 40809 - DNA, 22 bp, Artificial Sequence
  chemically synthesized
tttcctcccctcttctttcatt

SEQ ID NO: 40810 - DNA, 22 bp, Artificial Sequence
  chemically synthesized
cctcccctcttctttcattctc

SEQ ID NO: 40811 - DNA, 22 bp, Artificial Sequence
  chemically synthesized
ctcccctcttctttcattctct

SEQ ID NO: 40812 - DNA, 22 bp, Artificial Sequence
  chemically synthesized
ccctcttctttcattctctttc

SEQ ID NO: 40813 - DNA, 22 bp, Artificial Sequence
  chemically synthesized
ttctttcattctctttcttttg

SEQ ID NO: 40814 - DNA, 22 bp, Artificial Sequence
  chemically synthesized
ctttcattctctttcttttgga

SEQ ID NO: 40815 - DNA, 22 bp, Artificial Sequence
  chemically synthesized
tttcattctctttcttttggat

SEQ ID NO: 40816 - DNA, 22 bp, Artificial Sequence
  chemically synthesized
tcattctctttcttttggataa

SEQ ID NO: 40817 - DNA, 22 bp, Artificial Sequence
  chemically synthesized
cattctctttcttttggataaa

SEQ ID NO: 40818 - DNA, 22 bp, Artificial Sequence
  chemically synthesized
attctctttcttttggataaaa

SEQ ID NO: 40819 - DNA, 22 bp, Artificial Sequence
  chemically synthesized
tctttcttttggataaaataaa

SEQ ID NO: 40820 - DNA, 22 bp, Artificial Sequence
  chemically synthesized
tttcttttggataaaataaaat

SEQ ID NO: 40821 - DNA, 22 bp, Artificial Sequence
  chemically synthesized
tcttttggataaaataaaatca

SEQ ID NO: 40822 - DNA, 22 bp, Artificial Sequence
  chemically synthesized
cttttggataaaataaaatcat

SEQ ID NO: 40823 - DNA, 22 bp, Artificial Sequence
  chemically synthesized
ttttggataaaataaaatcata

SEQ ID NO: 40824 - DNA, 22 bp, Artificial Sequence
  chemically synthesized
ttggataaaataaaatcataaa

SEQ ID NO: 40825 - DNA, 22 bp, Artificial Sequence
  chemically synthesized
tggataaaataaaatcataaaa

SEQ ID NO: 40826 - DNA, 22 bp, Artificial Sequence
  chemically synthesized
ggataaaataaaatcataaaag

SEQ ID NO: 40827 - DNA, 22 bp, Artificial Sequence
  chemically synthesized
gataaaataaaatcataaaagt

SEQ ID NO: 40828 - DNA, 22 bp, Artificial Sequence
  chemically synthesized
atatttgctggtaacttccatg

SEQ ID NO: 40829 - DNA, 22 bp, Artificial Sequence
  chemically synthesized
gctggtaacttccatgaccaga

SEQ ID NO: 40830 - DNA, 22 bp, Artificial Sequence
  chemically synthesized
ctggtaacttccatgaccagac

SEQ ID NO: 40831 - DNA, 22 bp, Artificial Sequence
  chemically synthesized
gtaacttccatgaccagaccct

SEQ ID NO: 40832 - DNA, 22 bp, Artificial Sequence
  chemically synthesized
ccatgaccagaccctctgccaa

SEQ ID NO: 40833 - DNA, 22 bp, Artificial Sequence
  chemically synthesized
catgaccagaccctctgccaag

SEQ ID NO: 40834 - DNA, 22 bp, Artificial Sequence
  chemically synthesized
tgccaagtgctgcacatccata

SEQ ID NO: 40835 - DNA, 22 bp, Artificial Sequence
  chemically synthesized
ccaagtgctgcacatccatagc

SEQ ID NO: 40836 - DNA, 22 bp, Artificial Sequence
  chemically synthesized
cacatccatagcctccctcaag

SEQ ID NO: 40837 - DNA, 22 bp, Artificial Sequence
  chemically synthesized
cctcaagctttccaacaggcag

SEQ ID NO: 40838 - DNA, 22 bp, Artificial Sequence
  chemically synthesized
aagctttccaacaggcagtgct

SEQ ID NO: 40839 - DNA, 22 bp, Artificial Sequence
  chemically synthesized
tccaacaggcagtgctgtacga

SEQ ID NO: 40840 - DNA, 22 bp, Artificial Sequence
  chemically synthesized
ccaacaggcagtgctgtacgag

SEQ ID NO: 40841 - DNA, 22 bp, Artificial Sequence
  chemically synthesized
caacaggcagtgctgtacgagg

SEQ ID NO: 40842 - DNA, 22 bp, Artificial Sequence
  chemically synthesized
tacgaggagggggctgaggcct

SEQ ID NO: 40843 - DNA, 22 bp, Artificial Sequence
  chemically synthesized
aggccttcccgaggttgtgtcg

SEQ ID NO: 40844 - DNA, 22 bp, Artificial Sequence
  chemically synthesized
cccgaggttgtgtcgctaccca

SEQ ID NO: 40845 - DNA, 22 bp, Artificial Sequence
  chemically synthesized
ccgaggttgtgtcgctacccag

SEQ ID NO: 40846 - DNA, 22 bp, Artificial Sequence
  chemically synthesized
tgtcgctacccaggggtgcagc

SEQ ID NO: 40847 - DNA, 22 bp, Artificial Sequence
  chemically synthesized
cccaggggtgcagctgatagac

SEQ ID NO: 40848 - DNA, 22 bp, Artificial Sequence
  chemically synthesized
atagacacaaccctttcaggtc

SEQ ID NO: 40849 - DNA, 22 bp, Artificial Sequence
  chemically synthesized
tcaggtcttagtttacgagcaa

SEQ ID NO: 40850 - DNA, 22 bp, Artificial Sequence
  chemically synthesized
caggtcttagtttacgagcaag

SEQ ID NO: 40851 - DNA, 22 bp, Artificial Sequence
  chemically synthesized
aggtcttagtttacgagcaagc

SEQ ID NO: 40852 - DNA, 22 bp, Artificial Sequence
  chemically synthesized
agtttacgagcaagctaggtat

SEQ ID NO: 40853 - DNA, 22 bp, Artificial Sequence
  chemically synthesized
gtttacgagcaagctaggtata

SEQ ID NO: 40854 - DNA, 22 bp, Artificial Sequence
  chemically synthesized
acgagcaagctaggtataaatg

SEQ ID NO: 40855 - DNA, 22 bp, Artificial Sequence
  chemically synthesized
cgagcaagctaggtataaatgt

SEQ ID NO: 40856 - DNA, 22 bp, Artificial Sequence
  chemically synthesized
ggtataaatgttaacatctcca

SEQ ID NO: 40857 - DNA, 22 bp, Artificial Sequence
  chemically synthesized
acatctccacatcctataccaa

SEQ ID NO: 40858 - DNA, 22 bp, Artificial Sequence
  chemically synthesized
cacatcctataccaaactgtgc

SEQ ID NO: 40859 - DNA, 22 bp, Artificial Sequence
  chemically synthesized
taccaaactgtgccgaaatgac

SEQ ID NO: 40860 - DNA, 22 bp, Artificial Sequence
  chemically synthesized
tgccgaaatgacaacataagtg

SEQ ID NO: 40861 - DNA, 22 bp, Artificial Sequence
  chemically synthesized
ttattatcttcaaaatttattt

SEQ ID NO: 40862 - DNA, 22 bp, Artificial Sequence
  chemically synthesized
tattatcttcaaaatttattta

SEQ ID NO: 40863 - DNA, 22 bp, Artificial Sequence
  chemically synthesized
attatcttcaaaatttatttat

SEQ ID NO: 40864 - DNA, 22 bp, Artificial Sequence
  chemically synthesized
ttatcttcaaaatttatttatt

SEQ ID NO: 40865 - DNA, 22 bp, Artificial Sequence
  chemically synthesized
tcttcaaaatttatttattcct

SEQ ID NO: 40866 - DNA, 22 bp, Artificial Sequence
  chemically synthesized
caaaatttatttattcctagtg

SEQ ID NO: 40867 - DNA, 22 bp, Artificial Sequence
  chemically synthesized
aaaatttatttattcctagtga

SEQ ID NO: 40868 - DNA, 22 bp, Artificial Sequence
  chemically synthesized
atttattcctagtgaactcaca

SEQ ID NO: 40869 - DNA, 22 bp, Artificial Sequence
  chemically synthesized
tttattcctagtgaactcacat

SEQ ID NO: 40870 - DNA, 22 bp, Artificial Sequence
  chemically synthesized
attcctagtgaactcacatgtt

SEQ ID NO: 40871 - DNA, 22 bp, Artificial Sequence
  chemically synthesized
ttcctagtgaactcacatgttt

SEQ ID NO: 40872 - DNA, 22 bp, Artificial Sequence
  chemically synthesized
ctagtgaactcacatgttttct

SEQ ID NO: 40873 - DNA, 22 bp, Artificial Sequence
  chemically synthesized
gtgaactcacatgttttctgta

SEQ ID NO: 40874 - DNA, 22 bp, Artificial Sequence
  chemically synthesized
acatgttttctgtaattataaa

SEQ ID NO: 40875 - DNA, 22 bp, Artificial Sequence
  chemically synthesized
tctgtaattataaattatgtta

SEQ ID NO: 40876 - DNA, 22 bp, Artificial Sequence
  chemically synthesized
ctgtaattataaattatgttat

SEQ ID NO: 40877 - DNA, 22 bp, Artificial Sequence
  chemically synthesized
tgtaattataaattatgttata

SEQ ID NO: 40878 - DNA, 22 bp, Artificial Sequence
  chemically synthesized
taattataaattatgttataag

SEQ ID NO: 40879 - DNA, 22 bp, Artificial Sequence
  chemically synthesized
taaattatgttataagatatca

SEQ ID NO: 40880 - DNA, 22 bp, Artificial Sequence
  chemically synthesized
tgttataagatatcaatccttc

SEQ ID NO: 40881 - DNA, 22 bp, Artificial Sequence
  chemically synthesized
taagatatcaatccttccagga

SEQ ID NO: 40882 - DNA, 22 bp, Artificial Sequence
  chemically synthesized
ccaggagggggtggtggctcat

SEQ ID NO: 40883 - DNA, 22 bp, Artificial Sequence
  chemically synthesized
caggagggggtggtggctcatg

SEQ ID NO: 40884 - DNA, 22 bp, Artificial Sequence
  chemically synthesized
atgcctataatcccagcatttt

SEQ ID NO: 40885 - DNA, 22 bp, Artificial Sequence
  chemically synthesized
taatcccagcattttgggaggc

SEQ ID NO: 40886 - DNA, 22 bp, Artificial Sequence
  chemically synthesized
tgggaggccacggcagatggat

SEQ ID NO: 40887 - DNA, 22 bp, Artificial Sequence
  chemically synthesized
gggaggccacggcagatggatc

SEQ ID NO: 40888 - DNA, 22 bp, Artificial Sequence
  chemically synthesized
ggaggccacggcagatggatca

SEQ ID NO: 40889 - DNA, 22 bp, Artificial Sequence
  chemically synthesized
aggccaggagtttgagacaagc

SEQ ID NO: 40890 - DNA, 22 bp, Artificial Sequence
  chemically synthesized
gagacaagcctgggcaacatgc

SEQ ID NO: 40891 - DNA, 22 bp, Artificial Sequence
  chemically synthesized
agacaagcctgggcaacatgcc

SEQ ID NO: 40892 - DNA, 22 bp, Artificial Sequence
  chemically synthesized
ggcaacatgccaaaaccctgtc

SEQ ID NO: 40893 - DNA, 22 bp, Artificial Sequence
  chemically synthesized
tctctacaaaaaatacaaaaat

SEQ ID NO: 40894 - DNA, 22 bp, Artificial Sequence
  chemically synthesized
tacaaaaaatacaaaaattagc

SEQ ID NO: 40895 - DNA, 22 bp, Artificial Sequence
  chemically synthesized
caaaaaatacaaaaattagctg

SEQ ID NO: 40896 - DNA, 22 bp, Artificial Sequence
  chemically synthesized
gctgggtgtggaggcacatgcc

SEQ ID NO: 40897 - DNA, 22 bp, Artificial Sequence
  chemically synthesized
ggtgtggaggcacatgccagtc

SEQ ID NO: 40898 - DNA, 22 bp, Artificial Sequence
  chemically synthesized
ctaagtaggctgaggcactaga

SEQ ID NO: 40899 - DNA, 22 bp, Artificial Sequence
  chemically synthesized
agtaggctgaggcactagaatt

SEQ ID NO: 40900 - DNA, 22 bp, Artificial Sequence
  chemically synthesized
aggcactagaattgcttgaaca

SEQ ID NO: 40901 - DNA, 22 bp, Artificial Sequence
  chemically synthesized
gaattgcttgaacacaggagat

SEQ ID NO: 40902 - DNA, 22 bp, Artificial Sequence
  chemically synthesized
cttgaacacaggagatggaggt

SEQ ID NO: 40903 - DNA, 22 bp, Artificial Sequence
  chemically synthesized
gaacacaggagatggaggttgc

SEQ ID NO: 40904 - DNA, 22 bp, Artificial Sequence
  chemically synthesized
aacacaggagatggaggttgca

SEQ ID NO: 40905 - DNA, 22 bp, Artificial Sequence
  chemically synthesized
cagtgagccaagaatgtgccac

SEQ ID NO: 40906 - DNA, 22 bp, Artificial Sequence
  chemically synthesized
cactccagcctgggtgacagag

SEQ ID NO: 40907 - DNA, 22 bp, Artificial Sequence
  chemically synthesized
cagcctgggtgacagagcaaga

SEQ ID NO: 40908 - DNA, 22 bp, Artificial Sequence
  chemically synthesized
ggtgacagagcaagaatgtctc

SEQ ID NO: 40909 - DNA, 22 bp, Artificial Sequence
  chemically synthesized
aggaaagaaaaaaaaataataa

SEQ ID NO: 40910 - DNA, 22 bp, Artificial Sequence
  chemically synthesized
ataaaatatcaatccttcctat

SEQ ID NO: 40911 - DNA, 22 bp, Artificial Sequence
  chemically synthesized
cctattctagtagttgtggctt

SEQ ID NO: 40912 - DNA, 22 bp, Artificial Sequence
  chemically synthesized
ctattctagtagttgtggctta

SEQ ID NO: 40913 - DNA, 22 bp, Artificial Sequence
  chemically synthesized
ttctagtagttgtggcttaaat

SEQ ID NO: 40914 - DNA, 22 bp, Artificial Sequence
  chemically synthesized
tagtagttgtggcttaaataaa

SEQ ID NO: 40915 - DNA, 22 bp, Artificial Sequence
  chemically synthesized
gtagttgtggcttaaataaata

SEQ ID NO: 40916 - DNA, 22 bp, Artificial Sequence
  chemically synthesized
tggcttaaataaataaataaat

SEQ ID NO: 40917 - DNA, 22 bp, Artificial Sequence
  chemically synthesized
aaataaataaataaatattttt

SEQ ID NO: 40918 - DNA, 22 bp, Artificial Sequence
  chemically synthesized
aataaataaataaatattttta

SEQ ID NO: 40919 - DNA, 22 bp, Artificial Sequence
  chemically synthesized
ttaaaaataaaacatagggtcg

SEQ ID NO: 40920 - DNA, 22 bp, Artificial Sequence
  chemically synthesized
taaaaataaaacatagggtcga

SEQ ID NO: 40921 - DNA, 22 bp, Artificial Sequence
  chemically synthesized
aaaaataaaacatagggtcgag

SEQ ID NO: 40922 - DNA, 22 bp, Artificial Sequence
  chemically synthesized
aaaataaaacatagggtcgagt

SEQ ID NO: 40923 - DNA, 22 bp, Artificial Sequence
  chemically synthesized
aactctgtaatcccagcacttt

SEQ ID NO: 40924 - DNA, 22 bp, Artificial Sequence
  chemically synthesized
tgtaatcccagcactttgggag

SEQ ID NO: 40925 - DNA, 22 bp, Artificial Sequence
  chemically synthesized
taatcccagcactttgggaggc

SEQ ID NO: 40926 - DNA, 22 bp, Artificial Sequence
  chemically synthesized
tgggaggccaagacaggtggat

SEQ ID NO: 40927 - DNA, 22 bp, Artificial Sequence
  chemically synthesized
gggaggccaagacaggtggatc

SEQ ID NO: 40928 - DNA, 22 bp, Artificial Sequence
  chemically synthesized
ggaggccaagacaggtggatca

SEQ ID NO: 40929 - DNA, 22 bp, Artificial Sequence
  chemically synthesized
gagaccagccaggccaatgtgg

SEQ ID NO: 40930 - DNA, 22 bp, Artificial Sequence
  chemically synthesized
agaccagccaggccaatgtggt

SEQ ID NO: 40931 - DNA, 22 bp, Artificial Sequence
  chemically synthesized
tactaaaaatacaaaaattagc

SEQ ID NO: 40932 - DNA, 22 bp, Artificial Sequence
  chemically synthesized
ctaaaaatacaaaaattagcca

SEQ ID NO: 40933 - DNA, 22 bp, Artificial Sequence
  chemically synthesized
aaaatacaaaaattagccaggc

SEQ ID NO: 40934 - DNA, 22 bp, Artificial Sequence
  chemically synthesized
gccaggcgtggtggtgggcacc

SEQ ID NO: 40935 - DNA, 22 bp, Artificial Sequence
  chemically synthesized
taatcccagctactagggaggc

SEQ ID NO: 40936 - DNA, 22 bp, Artificial Sequence
  chemically synthesized
ctagggaggctggagtattcac

SEQ ID NO: 40937 - DNA, 22 bp, Artificial Sequence
  chemically synthesized
gggaggctggagtattcacttg

SEQ ID NO: 40938 - DNA, 22 bp, Artificial Sequence
  chemically synthesized
gagtattcacttgaacccagga

SEQ ID NO: 40939 - DNA, 22 bp, Artificial Sequence
  chemically synthesized
acttgaacccaggaggtggaag

SEQ ID NO: 40940 - DNA, 22 bp, Artificial Sequence
  chemically synthesized
gaacccaggaggtggaagttgc

SEQ ID NO: 40941 - DNA, 22 bp, Artificial Sequence
  chemically synthesized
aacccaggaggtggaagttgca

SEQ ID NO: 40942 - DNA, 22 bp, Artificial Sequence
  chemically synthesized
cagtgagccaaaatcacgtcag

SEQ ID NO: 40943 - DNA, 22 bp, Artificial Sequence
  chemically synthesized
caaccggggtgagagtctcaat

SEQ ID NO: 40944 - DNA, 22 bp, Artificial Sequence
  chemically synthesized
aaccggggtgagagtctcaata

SEQ ID NO: 40945 - DNA, 22 bp, Artificial Sequence
  chemically synthesized
aataaaataaaataaaataaaa

SEQ ID NO: 40946 - DNA, 22 bp, Artificial Sequence
  chemically synthesized
tccgcaaatgaattcatggtgc

SEQ ID NO: 40947 - DNA, 22 bp, Artificial Sequence
  chemically synthesized
ccgcaaatgaattcatggtgca

SEQ ID NO: 40948 - DNA, 22 bp, Artificial Sequence
  chemically synthesized
cgcaaatgaattcatggtgcaa

SEQ ID NO: 40949 - DNA, 22 bp, Artificial Sequence
  chemically synthesized
atggtgcaatcttacattttcg

SEQ ID NO: 40950 - DNA, 22 bp, Artificial Sequence
  chemically synthesized
acattttcgttctcatgaagta

SEQ ID NO: 40951 - DNA, 22 bp, Artificial Sequence
  chemically synthesized
cattttcgttctcatgaagtaa

SEQ ID NO: 40952 - DNA, 22 bp, Artificial Sequence
  chemically synthesized
tcgttctcatgaagtaaagcaa

SEQ ID NO: 40953 - DNA, 22 bp, Artificial Sequence
  chemically synthesized
cgttctcatgaagtaaagcaag

SEQ ID NO: 40954 - DNA, 22 bp, Artificial Sequence
  chemically synthesized
gttctcatgaagtaaagcaaga

SEQ ID NO: 40955 - DNA, 22 bp, Artificial Sequence
  chemically synthesized
tcatgaagtaaagcaagagtgg

SEQ ID NO: 40956 - DNA, 22 bp, Artificial Sequence
  chemically synthesized
atgaagtaaagcaagagtggta

SEQ ID NO: 40957 - DNA, 22 bp, Artificial Sequence
  chemically synthesized
agtggaaagagtctatctctag

SEQ ID NO: 40958 - DNA, 22 bp, Artificial Sequence
  chemically synthesized
tctctagtgtagtcacgtcagt

SEQ ID NO: 40959 - DNA, 22 bp, Artificial Sequence
  chemically synthesized
tagtgtagtcacgtcagtggtt

SEQ ID NO: 40960 - DNA, 22 bp, Artificial Sequence
  chemically synthesized
gtgtagtcacgtcagtggttgt

SEQ ID NO: 40961 - DNA, 22 bp, Artificial Sequence
  chemically synthesized
tgtcaagatggttaggaggctc

SEQ ID NO: 40962 - DNA, 22 bp, Artificial Sequence
  chemically synthesized
ggaggctcctcccgtttaaaac

SEQ ID NO: 40963 - DNA, 22 bp, Artificial Sequence
  chemically synthesized
ctcccgtttaaaacagtatcca

SEQ ID NO: 40964 - DNA, 22 bp, Artificial Sequence
  chemically synthesized
ccgtttaaaacagtatccaagc

SEQ ID NO: 40965 - DNA, 22 bp, Artificial Sequence
  chemically synthesized
aaaacagtatccaagccccagt

SEQ ID NO: 40966 - DNA, 22 bp, Artificial Sequence
  chemically synthesized
aaacagtatccaagccccagtt

SEQ ID NO: 40967 - DNA, 22 bp, Artificial Sequence
  chemically synthesized
taaatcaattggggagacacgc

SEQ ID NO: 40968 - DNA, 22 bp, Artificial Sequence
  chemically synthesized
gggagacacgccaactctgatc

SEQ ID NO: 40969 - DNA, 22 bp, Artificial Sequence
  chemically synthesized
tgatcatcagcaatatctgagc

SEQ ID NO: 40970 - DNA, 22 bp, Artificial Sequence
  chemically synthesized
atcatcagcaatatctgagctc

SEQ ID NO: 40971 - DNA, 22 bp, Artificial Sequence
  chemically synthesized
agctccagtctcagatattgtg

SEQ ID NO: 40972 - DNA, 22 bp, Artificial Sequence
  chemically synthesized
cagtctcagatattgtgtgcag

SEQ ID NO: 40973 - DNA, 22 bp, Artificial Sequence
  chemically synthesized
agatattgtgtgcagttagtct

SEQ ID NO: 40974 - DNA, 22 bp, Artificial Sequence
  chemically synthesized
tgtgcagttagtctctgtcctg

SEQ ID NO: 40975 - DNA, 22 bp, Artificial Sequence
  chemically synthesized
gtctctgtcctgtaccctctac

SEQ ID NO: 40976 - DNA, 22 bp, Artificial Sequence
  chemically synthesized
tgtcctgtaccctctacctcct

SEQ ID NO: 40977 - DNA, 22 bp, Artificial Sequence
  chemically synthesized
tcctgtaccctctacctccttc

SEQ ID NO: 40978 - DNA, 22 bp, Artificial Sequence
  chemically synthesized
taccctctacctccttccctac

SEQ ID NO: 40979 - DNA, 22 bp, Artificial Sequence
  chemically synthesized
tacctccttccctaccagaaaa

SEQ ID NO: 40980 - DNA, 22 bp, Artificial Sequence
  chemically synthesized
cctccttccctaccagaaaaat

SEQ ID NO: 40981 - DNA, 22 bp, Artificial Sequence
  chemically synthesized
cttccctaccagaaaaatcacc

SEQ ID NO: 40982 - DNA, 22 bp, Artificial Sequence
  chemically synthesized
ccctaccagaaaaatcaccact

SEQ ID NO: 40983 - DNA, 22 bp, Artificial Sequence
  chemically synthesized
cctaccagaaaaatcaccactt

SEQ ID NO: 40984 - DNA, 22 bp, Artificial Sequence
  chemically synthesized
ccagaaaaatcaccactttagt

SEQ ID NO: 40985 - DNA, 22 bp, Artificial Sequence
  chemically synthesized
tagtccctggccaccgggacac

SEQ ID NO: 40986 - DNA, 22 bp, Artificial Sequence
  chemically synthesized
agtccctggccaccgggacacc

SEQ ID NO: 40987 - DNA, 22 bp, Artificial Sequence
  chemically synthesized
gtccctggccaccgggacaccc

SEQ ID NO: 40988 - DNA, 22 bp, Artificial Sequence
  chemically synthesized
gccaccgggacaccccaggagg

SEQ ID NO: 40989 - DNA, 22 bp, Artificial Sequence
  chemically synthesized
aggtagttatggcacttatggc

SEQ ID NO: 40990 - DNA, 22 bp, Artificial Sequence
  chemically synthesized
tggcacttatggctcccttgct

SEQ ID NO: 40991 - DNA, 22 bp, Artificial Sequence
  chemically synthesized
atggctcccttgctgctgatct

SEQ ID NO: 40992 - DNA, 22 bp, Artificial Sequence
  chemically synthesized
tggctcccttgctgctgatctg

SEQ ID NO: 40993 - DNA, 22 bp, Artificial Sequence
  chemically synthesized
ccttgctgctgatctggaactc

SEQ ID NO: 40994 - DNA, 22 bp, Artificial Sequence
  chemically synthesized
gctgctgatctggaactcaagc

SEQ ID NO: 40995 - DNA, 22 bp, Artificial Sequence
  chemically synthesized
ctgctgatctggaactcaagcc

SEQ ID NO: 40996 - DNA, 22 bp, Artificial Sequence
  chemically synthesized
ctgatctggaactcaagcccca

SEQ ID NO: 40997 - DNA, 22 bp, Artificial Sequence
  chemically synthesized
atctggaactcaagccccaaga

SEQ ID NO: 40998 - DNA, 22 bp, Artificial Sequence
  chemically synthesized
gaactcaagccccaagaagtcc

SEQ ID NO: 40999 - DNA, 22 bp, Artificial Sequence
  chemically synthesized
aagccccaagaagtccccttgg

SEQ ID NO: 41000 - DNA, 22 bp, Artificial Sequence
  chemically synthesized
ggatgatctgaatatacatttg

SEQ ID NO: 41001 - DNA, 22 bp, Artificial Sequence
  chemically synthesized
gatgatctgaatatacatttgg

SEQ ID NO: 41002 - DNA, 22 bp, Artificial Sequence
  chemically synthesized
aatatacatttgggacagatct

SEQ ID NO: 41003 - DNA, 22 bp, Artificial Sequence
  chemically synthesized
gggacagatctagggagtttct

SEQ ID NO: 41004 - DNA, 22 bp, Artificial Sequence
  chemically synthesized
ggacagatctagggagtttctg

SEQ ID NO: 41005 - DNA, 22 bp, Artificial Sequence
  chemically synthesized
gggagtttctgagcaacactta

SEQ ID NO: 41006 - DNA, 22 bp, Artificial Sequence
  chemically synthesized
ctgagcaacacttagactgggg

SEQ ID NO: 41007 - DNA, 22 bp, Artificial Sequence
  chemically synthesized
tgagcaacacttagactggggt

SEQ ID NO: 41008 - DNA, 22 bp, Artificial Sequence
  chemically synthesized
agcaacacttagactggggtct

SEQ ID NO: 41009 - DNA, 22 bp, Artificial Sequence
  chemically synthesized
agactggggtcttccattgatt

SEQ ID NO: 41010 - DNA, 22 bp, Artificial Sequence
  chemically synthesized
gactggggtcttccattgatta

SEQ ID NO: 41011 - DNA, 22 bp, Artificial Sequence
  chemically synthesized
gggtcttccattgattaaatcc

SEQ ID NO: 41012 - DNA, 22 bp, Artificial Sequence
  chemically synthesized
ccattgattaaatcctacttga

SEQ ID NO: 41013 - DNA, 22 bp, Artificial Sequence
  chemically synthesized
cattgattaaatcctacttgaa

SEQ ID NO: 41014 - DNA, 22 bp, Artificial Sequence
  chemically synthesized
attaaatcctacttgaattcgc

SEQ ID NO: 41015 - DNA, 22 bp, Artificial Sequence
  chemically synthesized
aatcctacttgaattcgctact

SEQ ID NO: 41016 - DNA, 22 bp, Artificial Sequence
  chemically synthesized
cttgaattcgctactttgggac

SEQ ID NO: 41017 - DNA, 22 bp, Artificial Sequence
  chemically synthesized
gaattcgctactttgggactca

SEQ ID NO: 41018 - DNA, 22 bp, Artificial Sequence
  chemically synthesized
aattcgctactttgggactcaa

SEQ ID NO: 41019 - DNA, 22 bp, Artificial Sequence
  chemically synthesized
gctactttgggactcaagtcta

SEQ ID NO: 41020 - DNA, 22 bp, Artificial Sequence
  chemically synthesized
ctttgggactcaagtctaaggg

SEQ ID NO: 41021 - DNA, 22 bp, Artificial Sequence
  chemically synthesized
tgggactcaagtctaagggact

SEQ ID NO: 41022 - DNA, 22 bp, Artificial Sequence
  chemically synthesized
gggactcaagtctaagggactg

SEQ ID NO: 41023 - DNA, 22 bp, Artificial Sequence
  chemically synthesized
ggactcaagtctaagggactga

SEQ ID NO: 41024 - DNA, 22 bp, Artificial Sequence
  chemically synthesized
aagtctaagggactgagactga

SEQ ID NO: 41025 - DNA, 22 bp, Artificial Sequence
  chemically synthesized
agggactgagactgagacagga

SEQ ID NO: 41026 - DNA, 22 bp, Artificial Sequence
  chemically synthesized
agactgagacaggagagcacaa

SEQ ID NO: 41027 - DNA, 22 bp, Artificial Sequence
  chemically synthesized
agacaggagagcacaagactaa

SEQ ID NO: 41028 - DNA, 22 bp, Artificial Sequence
  chemically synthesized
actttggtctcttgatcttttc

SEQ ID NO: 41029 - DNA, 22 bp, Artificial Sequence
  chemically synthesized
tggtctcttgatcttttcttac

SEQ ID NO: 41030 - DNA, 22 bp, Artificial Sequence
  chemically synthesized
ggtctcttgatcttttcttacc

SEQ ID NO: 41031 - DNA, 22 bp, Artificial Sequence
  chemically synthesized
gtctcttgatcttttcttacct

SEQ ID NO: 41032 - DNA, 22 bp, Artificial Sequence
  chemically synthesized
ttgatcttttcttaccttgcaa

SEQ ID NO: 41033 - DNA, 22 bp, Artificial Sequence
  chemically synthesized
gatcttttcttaccttgcaact

SEQ ID NO: 41034 - DNA, 22 bp, Artificial Sequence
  chemically synthesized
atcttttcttaccttgcaactg

SEQ ID NO: 41035 - DNA, 22 bp, Artificial Sequence
  chemically synthesized
ttcttaccttgcaactgtcaat

SEQ ID NO: 41036 - DNA, 22 bp, Artificial Sequence
  chemically synthesized
tcttaccttgcaactgtcaatg

SEQ ID NO: 41037 - DNA, 22 bp, Artificial Sequence
  chemically synthesized
cttaccttgcaactgtcaatgc

SEQ ID NO: 41038 - DNA, 22 bp, Artificial Sequence
  chemically synthesized
ttaccttgcaactgtcaatgcc

SEQ ID NO: 41039 - DNA, 22 bp, Artificial Sequence
  chemically synthesized
accttgcaactgtcaatgcctc

SEQ ID NO: 41040 - DNA, 22 bp, Artificial Sequence
  chemically synthesized
ccttgcaactgtcaatgcctcc

SEQ ID NO: 41041 - DNA, 22 bp, Artificial Sequence
  chemically synthesized
gcaactgtcaatgcctccagcc

SEQ ID NO: 41042 - DNA, 22 bp, Artificial Sequence
  chemically synthesized
caactgtcaatgcctccagcca

SEQ ID NO: 41043 - DNA, 22 bp, Artificial Sequence
  chemically synthesized
tcaatgcctccagccaaatgcc

SEQ ID NO: 41044 - DNA, 22 bp, Artificial Sequence
  chemically synthesized
cagccaaatgcccagcacagag

SEQ ID NO: 41045 - DNA, 22 bp, Artificial Sequence
  chemically synthesized
agtggatttgactcttccattc

SEQ ID NO: 41046 - DNA, 22 bp, Artificial Sequence
  chemically synthesized
gactcttccattcagaaactca

SEQ ID NO: 41047 - DNA, 22 bp, Artificial Sequence
  chemically synthesized
actcttccattcagaaactcat

SEQ ID NO: 41048 - DNA, 22 bp, Artificial Sequence
  chemically synthesized
ttccattcagaaactcatagcg

SEQ ID NO: 41049 - DNA, 22 bp, Artificial Sequence
  chemically synthesized
ccattcagaaactcatagcgat

SEQ ID NO: 41050 - DNA, 22 bp, Artificial Sequence
  chemically synthesized
cattcagaaactcatagcgatt

SEQ ID NO: 41051 - DNA, 22 bp, Artificial Sequence
  chemically synthesized
agaaactcatagcgattgcaca

SEQ ID NO: 41052 - DNA, 22 bp, Artificial Sequence
  chemically synthesized
atagcgattgcacacttcattc

SEQ ID NO: 41053 - DNA, 22 bp, Artificial Sequence
  chemically synthesized
cacacttcattctcaatcacag

SEQ ID NO: 41054 - DNA, 22 bp, Artificial Sequence
  chemically synthesized
cattctcaatcacagggagctg

SEQ ID NO: 41055 - DNA, 22 bp, Artificial Sequence
  chemically synthesized
attctcaatcacagggagctgg

SEQ ID NO: 41056 - DNA, 22 bp, Artificial Sequence
  chemically synthesized
tcaatcacagggagctgggctt

SEQ ID NO: 41057 - DNA, 22 bp, Artificial Sequence
  chemically synthesized
aatcacagggagctgggcttcc

SEQ ID NO: 41058 - DNA, 22 bp, Artificial Sequence
  chemically synthesized
ggcttccttgagaaagccagcc

SEQ ID NO: 41059 - DNA, 22 bp, Artificial Sequence
  chemically synthesized
ccttgagaaagccagccccaaa

SEQ ID NO: 41060 - DNA, 22 bp, Artificial Sequence
  chemically synthesized
cttgagaaagccagccccaaag

SEQ ID NO: 41061 - DNA, 22 bp, Artificial Sequence
  chemically synthesized
gagaaagccagccccaaaggta

SEQ ID NO: 41062 - DNA, 22 bp, Artificial Sequence
  chemically synthesized
agaaagccagccccaaaggtac

SEQ ID NO: 41063 - DNA, 22 bp, Artificial Sequence
  chemically synthesized
tgtttaaaaagatgaaagaaat

SEQ ID NO: 41064 - DNA, 22 bp, Artificial Sequence
  chemically synthesized
aaaaagatgaaagaaatggtaa

SEQ ID NO: 41065 - DNA, 22 bp, Artificial Sequence
  chemically synthesized
aaaagatgaaagaaatggtaac

SEQ ID NO: 41066 - DNA, 22 bp, Artificial Sequence
  chemically synthesized
cgtccacaacatgttcacaagg

SEQ ID NO: 41067 - DNA, 22 bp, Artificial Sequence
  chemically synthesized
acaaggaaactccagaagaaca

SEQ ID NO: 41068 - DNA, 22 bp, Artificial Sequence
  chemically synthesized
cagaagaacagagcagtggtga

SEQ ID NO: 41069 - DNA, 22 bp, Artificial Sequence
  chemically synthesized
ctgtctgtccgtgaggctgtag

SEQ ID NO: 41070 - DNA, 22 bp, Artificial Sequence
  chemically synthesized
tctgtccgtgaggctgtagaac

SEQ ID NO: 41071 - DNA, 22 bp, Artificial Sequence
  chemically synthesized
tccgtgaggctgtagaacacaa

SEQ ID NO: 41072 - DNA, 22 bp, Artificial Sequence
  chemically synthesized
tagaacacaaggcagctcccaa

SEQ ID NO: 41073 - DNA, 22 bp, Artificial Sequence
  chemically synthesized
ccaatgctgccagactctctga

SEQ ID NO: 41074 - DNA, 22 bp, Artificial Sequence
  chemically synthesized
ccagactctctgaaccctggag

SEQ ID NO: 41075 - DNA, 22 bp, Artificial Sequence
  chemically synthesized
tctgaaccctggagagtgtaaa

SEQ ID NO: 41076 - DNA, 22 bp, Artificial Sequence
  chemically synthesized
tgaaccctggagagtgtaaacg

SEQ ID NO: 41077 - DNA, 22 bp, Artificial Sequence
  chemically synthesized
aaccctggagagtgtaaacgtc

SEQ ID NO: 41078 - DNA, 22 bp, Artificial Sequence
  chemically synthesized
gagagtgtaaacgtcatataag

SEQ ID NO: 41079 - DNA, 22 bp, Artificial Sequence
  chemically synthesized
tgttccaaaaacctggatttaa

SEQ ID NO: 41080 - DNA, 22 bp, Artificial Sequence
  chemically synthesized
caaaaacctggatttaacaatc

SEQ ID NO: 41081 - DNA, 22 bp, Artificial Sequence
  chemically synthesized
gatttaacaatctgagctttgt

SEQ ID NO: 41082 - DNA, 22 bp, Artificial Sequence
  chemically synthesized
aacaatctgagctttgtcatgg

SEQ ID NO: 41083 - DNA, 22 bp, Artificial Sequence
  chemically synthesized
acaatctgagctttgtcatggt

SEQ ID NO: 41084 - DNA, 22 bp, Artificial Sequence
  chemically synthesized
agctttgtcatggtgctttgcg

SEQ ID NO: 41085 - DNA, 22 bp, Artificial Sequence
  chemically synthesized
tgtcatggtgctttgcggttgg

SEQ ID NO: 41086 - DNA, 22 bp, Artificial Sequence
  chemically synthesized
gtcatggtgctttgcggttggt

SEQ ID NO: 41087 - DNA, 22 bp, Artificial Sequence
  chemically synthesized
tcatggtgctttgcggttggtt

SEQ ID NO: 41088 - DNA, 22 bp, Artificial Sequence
  chemically synthesized
tgcggttggttgttgtttcttt

SEQ ID NO: 41089 - DNA, 22 bp, Artificial Sequence
  chemically synthesized
gcggttggttgttgtttcttta

SEQ ID NO: 41090 - DNA, 22 bp, Artificial Sequence
  chemically synthesized
cggttggttgttgtttctttac

SEQ ID NO: 41091 - DNA, 22 bp, Artificial Sequence
  chemically synthesized
gttgttgtttctttaccttttt

SEQ ID NO: 41092 - DNA, 22 bp, Artificial Sequence
  chemically synthesized
ttgtttctttacctttttcttt

SEQ ID NO: 41093 - DNA, 22 bp, Artificial Sequence
  chemically synthesized
tttctttacctttttctttgct

SEQ ID NO: 41094 - DNA, 22 bp, Artificial Sequence
  chemically synthesized
ctttacctttttctttgctttt

SEQ ID NO: 41095 - DNA, 22 bp, Artificial Sequence
  chemically synthesized
tttacctttttctttgctttta

SEQ ID NO: 41096 - DNA, 22 bp, Artificial Sequence
  chemically synthesized
tacctttttctttgcttttaaa

SEQ ID NO: 41097 - DNA, 22 bp, Artificial Sequence
  chemically synthesized
acctttttctttgcttttaaaa

SEQ ID NO: 41098 - DNA, 22 bp, Artificial Sequence
  chemically synthesized
cctttttctttgcttttaaaac

SEQ ID NO: 41099 - DNA, 22 bp, Artificial Sequence
  chemically synthesized
tttctttgcttttaaaaccata

SEQ ID NO: 41100 - DNA, 22 bp, Artificial Sequence
  chemically synthesized
ttctttgcttttaaaaccataa

SEQ ID NO: 41101 - DNA, 22 bp, Artificial Sequence
  chemically synthesized
tctttgcttttaaaaccataaa

SEQ ID NO: 41102 - DNA, 22 bp, Artificial Sequence
  chemically synthesized
ctttgcttttaaaaccataaag

SEQ ID NO: 41103 - DNA, 22 bp, Artificial Sequence
  chemically synthesized
tttgcttttaaaaccataaaga

SEQ ID NO: 41104 - DNA, 22 bp, Artificial Sequence
  chemically synthesized
tgcttttaaaaccataaagaat

SEQ ID NO: 41105 - DNA, 22 bp, Artificial Sequence
  chemically synthesized
gcttttaaaaccataaagaata

SEQ ID NO: 41106 - DNA, 22 bp, Artificial Sequence
  chemically synthesized
cttttaaaaccataaagaataa

SEQ ID NO: 41107 - DNA, 22 bp, Artificial Sequence
  chemically synthesized
ttaaaaccataaagaataatgt

SEQ ID NO: 41108 - DNA, 22 bp, Artificial Sequence
  chemically synthesized
taaaaccataaagaataatgtt

SEQ ID NO: 41109 - DNA, 22 bp, Artificial Sequence
  chemically synthesized
aaaaccataaagaataatgttt

SEQ ID NO: 41110 - DNA, 22 bp, Artificial Sequence
  chemically synthesized
aaaccataaagaataatgttta

SEQ ID NO: 41111 - DNA, 22 bp, Artificial Sequence
  chemically synthesized
aaatgtagagtctgagaaatgc

SEQ ID NO: 41112 - DNA, 22 bp, Artificial Sequence
  chemically synthesized
aatgtagagtctgagaaatgca

SEQ ID NO: 41113 - DNA, 22 bp, Artificial Sequence
  chemically synthesized
agaaatgcaattgctattgttt

SEQ ID NO: 41114 - DNA, 22 bp, Artificial Sequence
  chemically synthesized
ctattgtttttatattttcaga

SEQ ID NO: 41115 - DNA, 22 bp, Artificial Sequence
  chemically synthesized
ttgtttttatattttcagactt

SEQ ID NO: 41116 - DNA, 22 bp, Artificial Sequence
  chemically synthesized
tttttatattttcagacttttt

SEQ ID NO: 41117 - DNA, 22 bp, Artificial Sequence
  chemically synthesized
ttatattttcagactttttgta

SEQ ID NO: 41118 - DNA, 22 bp, Artificial Sequence
  chemically synthesized
tatattttcagactttttgtat

SEQ ID NO: 41119 - DNA, 22 bp, Artificial Sequence
  chemically synthesized
atattttcagactttttgtatg

SEQ ID NO: 41120 - DNA, 22 bp, Artificial Sequence
  chemically synthesized
tattttcagactttttgtatgc

SEQ ID NO: 41121 - DNA, 22 bp, Artificial Sequence
  chemically synthesized
tcagactttttgtatgcttctt

SEQ ID NO: 41122 - DNA, 22 bp, Artificial Sequence
  chemically synthesized
cagactttttgtatgcttcttt

SEQ ID NO: 41123 - DNA, 22 bp, Artificial Sequence
  chemically synthesized
agactttttgtatgcttctttc

SEQ ID NO: 41124 - DNA, 22 bp, Artificial Sequence
  chemically synthesized
tttgtatgcttctttcactaat

SEQ ID NO: 41125 - DNA, 22 bp, Artificial Sequence
  chemically synthesized
ttgtatgcttctttcactaatt

SEQ ID NO: 41126 - DNA, 22 bp, Artificial Sequence
  chemically synthesized
tgtatgcttctttcactaatta

SEQ ID NO: 41127 - DNA, 22 bp, Artificial Sequence
  chemically synthesized
gtatgcttctttcactaattac

SEQ ID NO: 41128 - DNA, 22 bp, Artificial Sequence
  chemically synthesized
tatgcttctttcactaattaca

SEQ ID NO: 41129 - DNA, 22 bp, Artificial Sequence
  chemically synthesized
ctttcactaattacatcatatc

SEQ ID NO: 41130 - DNA, 22 bp, Artificial Sequence
  chemically synthesized
tttcactaattacatcatatca

SEQ ID NO: 41131 - DNA, 22 bp, Artificial Sequence
  chemically synthesized
tcactaattacatcatatcaca

SEQ ID NO: 41132 - DNA, 22 bp, Artificial Sequence
  chemically synthesized
cactaattacatcatatcacaa

SEQ ID NO: 41133 - DNA, 22 bp, Artificial Sequence
  chemically synthesized
actaattacatcatatcacaaa

SEQ ID NO: 41134 - DNA, 22 bp, Artificial Sequence
  chemically synthesized
attacatcatatcacaaaattt

SEQ ID NO: 41135 - DNA, 22 bp, Artificial Sequence
  chemically synthesized
catcatatcacaaaatttcaca

SEQ ID NO: 41136 - DNA, 22 bp, Artificial Sequence
  chemically synthesized
cacaccctgattttttcactca

SEQ ID NO: 41137 - DNA, 22 bp, Artificial Sequence
  chemically synthesized
acaccctgattttttcactcaa

SEQ ID NO: 41138 - DNA, 22 bp, Artificial Sequence
  chemically synthesized
attttttcactcaacattacat

SEQ ID NO: 41139 - DNA, 22 bp, Artificial Sequence
  chemically synthesized
tttcactcaacattacataatg

SEQ ID NO: 41140 - DNA, 22 bp, Artificial Sequence
  chemically synthesized
ttcactcaacattacataatga

SEQ ID NO: 41141 - DNA, 22 bp, Artificial Sequence
  chemically synthesized
tcactcaacattacataatgag

SEQ ID NO: 41142 - DNA, 22 bp, Artificial Sequence
  chemically synthesized
cactcaacattacataatgagt

SEQ ID NO: 41143 - DNA, 22 bp, Artificial Sequence
  chemically synthesized
actcaacattacataatgagtt

SEQ ID NO: 41144 - DNA, 22 bp, Artificial Sequence
  chemically synthesized
aacattacataatgagttttgt

SEQ ID NO: 41145 - DNA, 22 bp, Artificial Sequence
  chemically synthesized
cataatgagttttgtatagtgc

SEQ ID NO: 41146 - DNA, 22 bp, Artificial Sequence
  chemically synthesized
tgtatagtgctatgatcttcat

SEQ ID NO: 41147 - DNA, 22 bp, Artificial Sequence
  chemically synthesized
gtatagtgctatgatcttcata

SEQ ID NO: 41148 - DNA, 22 bp, Artificial Sequence
  chemically synthesized
tatagtgctatgatcttcataa

SEQ ID NO: 41149 - DNA, 22 bp, Artificial Sequence
  chemically synthesized
tgatcttcataactaatatttt

SEQ ID NO: 41150 - DNA, 22 bp, Artificial Sequence
  chemically synthesized
cataactaatattttaaaggag

SEQ ID NO: 41151 - DNA, 22 bp, Artificial Sequence
  chemically synthesized
ataactaatattttaaaggaga

SEQ ID NO: 41152 - DNA, 22 bp, Artificial Sequence
  chemically synthesized
atattttaaaggagagctactg

SEQ ID NO: 41153 - DNA, 22 bp, Artificial Sequence
  chemically synthesized
taaaggagagctactgattaat

SEQ ID NO: 41154 - DNA, 22 bp, Artificial Sequence
  chemically synthesized
aaaggagagctactgattaatg

SEQ ID NO: 41155 - DNA, 22 bp, Artificial Sequence
  chemically synthesized
aaggagagctactgattaatga

SEQ ID NO: 41156 - DNA, 22 bp, Artificial Sequence
  chemically synthesized
ctgattaatgagcatgaggttt

SEQ ID NO: 41157 - DNA, 22 bp, Artificial Sequence
  chemically synthesized
attaatgagcatgaggtttcct

SEQ ID NO: 41158 - DNA, 22 bp, Artificial Sequence
  chemically synthesized
atgagcatgaggtttcctttgg

SEQ ID NO: 41159 - DNA, 22 bp, Artificial Sequence
  chemically synthesized
cctttggggatgaggaaaatat

SEQ ID NO: 41160 - DNA, 22 bp, Artificial Sequence
  chemically synthesized
ctttggggatgaggaaaatatt

SEQ ID NO: 41161 - DNA, 22 bp, Artificial Sequence
  chemically synthesized
tggggatgaggaaaatattctg

SEQ ID NO: 41162 - DNA, 22 bp, Artificial Sequence
  chemically synthesized
ggggatgaggaaaatattctgg

SEQ ID NO: 41163 - DNA, 22 bp, Artificial Sequence
  chemically synthesized
gggatgaggaaaatattctgga

SEQ ID NO: 41164 - DNA, 22 bp, Artificial Sequence
  chemically synthesized
tggaaatatgatgatggttgca

SEQ ID NO: 41165 - DNA, 22 bp, Artificial Sequence
  chemically synthesized
gaaatatgatgatggttgcaca

SEQ ID NO: 41166 - DNA, 22 bp, Artificial Sequence
  chemically synthesized
cacaccactgtgaatgtactaa

SEQ ID NO: 41167 - DNA, 22 bp, Artificial Sequence
  chemically synthesized
tgaatgtactaaatgccacttg

SEQ ID NO: 41168 - DNA, 22 bp, Artificial Sequence
  chemically synthesized
aatgccacttggtggtaccctg

SEQ ID NO: 41169 - DNA, 22 bp, Artificial Sequence
  chemically synthesized
ggtggtaccctgcaaaaatggt

SEQ ID NO: 41170 - DNA, 22 bp, Artificial Sequence
  chemically synthesized
gtggtaccctgcaaaaatggtt

SEQ ID NO: 41171 - DNA, 22 bp, Artificial Sequence
  chemically synthesized
caaaaatggttaaaatagtaac

SEQ ID NO: 41172 - DNA, 22 bp, Artificial Sequence
  chemically synthesized
aaatagtaactcttacgctgtg

SEQ ID NO: 41173 - DNA, 22 bp, Artificial Sequence
  chemically synthesized
ttacgctgtgtacattttattg

SEQ ID NO: 41174 - DNA, 22 bp, Artificial Sequence
  chemically synthesized
acgctgtgtacattttattgca

SEQ ID NO: 41175 - DNA, 22 bp, Artificial Sequence
  chemically synthesized
cgctgtgtacattttattgcaa

SEQ ID NO: 41176 - DNA, 22 bp, Artificial Sequence
  chemically synthesized
tgtacattttattgcaataaaa

SEQ ID NO: 41177 - DNA, 22 bp, Artificial Sequence
  chemically synthesized
tattgcaataaaaaagaatagt

SEQ ID NO: 41178 - DNA, 22 bp, Artificial Sequence
  chemically synthesized
attgcaataaaaaagaatagtc

SEQ ID NO: 41179 - DNA, 22 bp, Artificial Sequence
  chemically synthesized
ttgcaataaaaaagaatagtca

SEQ ID NO: 41180 - DNA, 22 bp, Artificial Sequence
  chemically synthesized
caataaaaaagaatagtcatca

SEQ ID NO: 41181 - DNA, 22 bp, Artificial Sequence
  chemically synthesized
actaagcattatcctttccagg

SEQ ID NO: 41182 - DNA, 22 bp, Artificial Sequence
  chemically synthesized
ctaagcattatcctttccaggc

SEQ ID NO: 41183 - DNA, 22 bp, Artificial Sequence
  chemically synthesized
agcattatcctttccaggcaca

SEQ ID NO: 41184 - DNA, 22 bp, Artificial Sequence
  chemically synthesized
tcctttccaggcacaagcttat

SEQ ID NO: 41185 - DNA, 22 bp, Artificial Sequence
  chemically synthesized
tccaggcacaagcttataatgt

SEQ ID NO: 41186 - DNA, 22 bp, Artificial Sequence
  chemically synthesized
ccaggcacaagcttataatgtg

SEQ ID NO: 41187 - DNA, 22 bp, Artificial Sequence
  chemically synthesized
caggcacaagcttataatgtgg

SEQ ID NO: 41188 - DNA, 22 bp, Artificial Sequence
  chemically synthesized
ataatgtggtgtatctcacttc

SEQ ID NO: 41189 - DNA, 22 bp, Artificial Sequence
  chemically synthesized
taatgtggtgtatctcacttca

SEQ ID NO: 41190 - DNA, 22 bp, Artificial Sequence
  chemically synthesized
acttcatcctcacaacagtcct

SEQ ID NO: 41191 - DNA, 22 bp, Artificial Sequence
  chemically synthesized
catcctcacaacagtcctatga

SEQ ID NO: 41192 - DNA, 22 bp, Artificial Sequence
  chemically synthesized
atcctcacaacagtcctatgaa

SEQ ID NO: 41193 - DNA, 22 bp, Artificial Sequence
  chemically synthesized
acaacagtcctatgaaacaggc

SEQ ID NO: 41194 - DNA, 22 bp, Artificial Sequence
  chemically synthesized
tgaaacaggcagttccatcact

SEQ ID NO: 41195 - DNA, 22 bp, Artificial Sequence
  chemically synthesized
catcactcctgctctacagtta

SEQ ID NO: 41196 - DNA, 22 bp, Artificial Sequence
  chemically synthesized
ctgctctacagttaaggaaact

SEQ ID NO: 41197 - DNA, 22 bp, Artificial Sequence
  chemically synthesized
ctctacagttaaggaaactgag

SEQ ID NO: 41198 - DNA, 22 bp, Artificial Sequence
  chemically synthesized
tacagttaaggaaactgaggtg

SEQ ID NO: 41199 - DNA, 22 bp, Artificial Sequence
  chemically synthesized
cagttaaggaaactgaggtgta

SEQ ID NO: 41200 - DNA, 22 bp, Artificial Sequence
  chemically synthesized
aggaaactgaggtgtaaggagg

SEQ ID NO: 41201 - DNA, 22 bp, Artificial Sequence
  chemically synthesized
aggtgtaaggaggttgtctagt

SEQ ID NO: 41202 - DNA, 22 bp, Artificial Sequence
  chemically synthesized
tctagttcaacctgagcctggg

SEQ ID NO: 41203 - DNA, 22 bp, Artificial Sequence
  chemically synthesized
gttcaacctgagcctgggtctg

SEQ ID NO: 41204 - DNA, 22 bp, Artificial Sequence
  chemically synthesized
aacctgagcctgggtctgcgga

SEQ ID NO: 41205 - DNA, 22 bp, Artificial Sequence
  chemically synthesized
agcctgggtctgcggagtcact

SEQ ID NO: 41206 - DNA, 22 bp, Artificial Sequence
  chemically synthesized
ggtctgcggagtcactgcccaa

SEQ ID NO: 41207 - DNA, 22 bp, Artificial Sequence
  chemically synthesized
cggagtcactgcccaaatgctt

SEQ ID NO: 41208 - DNA, 22 bp, Artificial Sequence
  chemically synthesized
cccaaatgcttcctccccgtgc

SEQ ID NO: 41209 - DNA, 22 bp, Artificial Sequence
  chemically synthesized
cctccccgtgcgcgttggcccc

SEQ ID NO: 41210 - DNA, 22 bp, Artificial Sequence
  chemically synthesized
ctccccgtgcgcgttggccccc

SEQ ID NO: 41211 - DNA, 22 bp, Artificial Sequence
  chemically synthesized
cccgtgcgcgttggcccccctc

SEQ ID NO: 41212 - DNA, 22 bp, Artificial Sequence
  chemically synthesized
gcccccctcttgcttccaaccc

SEQ ID NO: 41213 - DNA, 22 bp, Artificial Sequence
  chemically synthesized
ttgcttccaaccctccacatct

SEQ ID NO: 41214 - DNA, 22 bp, Artificial Sequence
  chemically synthesized
gcttccaaccctccacatcttt

SEQ ID NO: 41215 - DNA, 22 bp, Artificial Sequence
  chemically synthesized
cttccaaccctccacatctttg

SEQ ID NO: 41216 - DNA, 22 bp, Artificial Sequence
  chemically synthesized
ccaaccctccacatctttgttc

SEQ ID NO: 41217 - DNA, 22 bp, Artificial Sequence
  chemically synthesized
caaccctccacatctttgttca

SEQ ID NO: 41218 - DNA, 22 bp, Artificial Sequence
  chemically synthesized
cacatctttgttcataaagttc

SEQ ID NO: 41219 - DNA, 22 bp, Artificial Sequence
  chemically synthesized
tgttcataaagttcattcttat

SEQ ID NO: 41220 - DNA, 22 bp, Artificial Sequence
  chemically synthesized
gttcataaagttcattcttatt

SEQ ID NO: 41221 - DNA, 22 bp, Artificial Sequence
  chemically synthesized
ttcataaagttcattcttattc

SEQ ID NO: 41222 - DNA, 22 bp, Artificial Sequence
  chemically synthesized
ataaagttcattcttattcctt

SEQ ID NO: 41223 - DNA, 22 bp, Artificial Sequence
  chemically synthesized
attcttattccttaatattttc

SEQ ID NO: 41224 - DNA, 22 bp, Artificial Sequence
  chemically synthesized
ttattccttaatattttctgag

SEQ ID NO: 41225 - DNA, 22 bp, Artificial Sequence
  chemically synthesized
attccttaatattttctgagcc

SEQ ID NO: 41226 - DNA, 22 bp, Artificial Sequence
  chemically synthesized
ttccttaatattttctgagcct

SEQ ID NO: 41227 - DNA, 22 bp, Artificial Sequence
  chemically synthesized
cttaatattttctgagcctaag

SEQ ID NO: 41228 - DNA, 22 bp, Artificial Sequence
  chemically synthesized
aatattttctgagcctaagttc

SEQ ID NO: 41229 - DNA, 22 bp, Artificial Sequence
  chemically synthesized
atattttctgagcctaagttcc

SEQ ID NO: 41230 - DNA, 22 bp, Artificial Sequence
  chemically synthesized
tctgagcctaagttcccataaa

SEQ ID NO: 41231 - DNA, 22 bp, Artificial Sequence
  chemically synthesized
ctgagcctaagttcccataaat

SEQ ID NO: 41232 - DNA, 22 bp, Artificial Sequence
  chemically synthesized
tgagcctaagttcccataaatt

SEQ ID NO: 41233 - DNA, 22 bp, Artificial Sequence
  chemically synthesized
agcctaagttcccataaattat

SEQ ID NO: 41234 - DNA, 22 bp, Artificial Sequence
  chemically synthesized
agttcccataaattatatagac

SEQ ID NO: 41235 - DNA, 22 bp, Artificial Sequence
  chemically synthesized
ccataaattatatagacatatt

SEQ ID NO: 41236 - DNA, 22 bp, Artificial Sequence
  chemically synthesized
tatagacatatttctgtctccc

SEQ ID NO: 41237 - DNA, 22 bp, Artificial Sequence
  chemically synthesized
ctgtctcccaataacactgcca

SEQ ID NO: 41238 - DNA, 22 bp, Artificial Sequence
  chemically synthesized
tgtctcccaataacactgccaa

SEQ ID NO: 41239 - DNA, 22 bp, Artificial Sequence
  chemically synthesized
tctcccaataacactgccaatt

SEQ ID NO: 41240 - DNA, 22 bp, Artificial Sequence
  chemically synthesized
ccaataacactgccaatttatt

SEQ ID NO: 41241 - DNA, 22 bp, Artificial Sequence
  chemically synthesized
ccaatttattttctagaaggtt

SEQ ID NO: 41242 - DNA, 22 bp, Artificial Sequence
  chemically synthesized
attttctagaaggttatgacag

SEQ ID NO: 41243 - DNA, 22 bp, Artificial Sequence
  chemically synthesized
ttttctagaaggttatgacagt

SEQ ID NO: 41244 - DNA, 22 bp, Artificial Sequence
  chemically synthesized
tctagaaggttatgacagtgta

SEQ ID NO: 41245 - DNA, 22 bp, Artificial Sequence
  chemically synthesized
ctagaaggttatgacagtgtaa

SEQ ID NO: 41246 - DNA, 22 bp, Artificial Sequence
  chemically synthesized
tagaaggttatgacagtgtaaa

SEQ ID NO: 41247 - DNA, 22 bp, Artificial Sequence
  chemically synthesized
gaaggttatgacagtgtaaaat

SEQ ID NO: 41248 - DNA, 22 bp, Artificial Sequence
  chemically synthesized
tgacagtgtaaaatgtcactag

SEQ ID NO: 41249 - DNA, 22 bp, Artificial Sequence
  chemically synthesized
gaaaacaatcacttcaccacac

SEQ ID NO: 41250 - DNA, 22 bp, Artificial Sequence
  chemically synthesized
caccacacttgtatgagtgttc

SEQ ID NO: 41251 - DNA, 22 bp, Artificial Sequence
  chemically synthesized
accacacttgtatgagtgttca

SEQ ID NO: 41252 - DNA, 22 bp, Artificial Sequence
  chemically synthesized
gtatgagtgttcaatttttaaa

SEQ ID NO: 41253 - DNA, 22 bp, Artificial Sequence
  chemically synthesized
tatgagtgttcaatttttaaat

SEQ ID NO: 41254 - DNA, 22 bp, Artificial Sequence
  chemically synthesized
aatttttaaatattagctaatc

SEQ ID NO: 41255 - DNA, 22 bp, Artificial Sequence
  chemically synthesized
ttaaatattagctaatctaaca

SEQ ID NO: 41256 - DNA, 22 bp, Artificial Sequence
  chemically synthesized
taaatattagctaatctaacag

SEQ ID NO: 41257 - DNA, 22 bp, Artificial Sequence
  chemically synthesized
aaatattagctaatctaacagg

SEQ ID NO: 41258 - DNA, 22 bp, Artificial Sequence
  chemically synthesized
aatattagctaatctaacaggt

SEQ ID NO: 41259 - DNA, 22 bp, Artificial Sequence
  chemically synthesized
gctaatctaacaggttgaaatt

SEQ ID NO: 41260 - DNA, 22 bp, Artificial Sequence
  chemically synthesized
atctaacaggttgaaattgtcc

SEQ ID NO: 41261 - DNA, 22 bp, Artificial Sequence
  chemically synthesized
acaggttgaaattgtcctgatt

SEQ ID NO: 41262 - DNA, 22 bp, Artificial Sequence
  chemically synthesized
aaattgtcctgattcattttct

SEQ ID NO: 41263 - DNA, 22 bp, Artificial Sequence
  chemically synthesized
tcctgattcattttctaattta

SEQ ID NO: 41264 - DNA, 22 bp, Artificial Sequence
  chemically synthesized
attcattttctaatttatactt

SEQ ID NO: 41265 - DNA, 22 bp, Artificial Sequence
  chemically synthesized
attttctaatttatacttcttt

SEQ ID NO: 41266 - DNA, 22 bp, Artificial Sequence
  chemically synthesized
tctaatttatacttctttgaca

SEQ ID NO: 41267 - DNA, 22 bp, Artificial Sequence
  chemically synthesized
ctaatttatacttctttgacaa

SEQ ID NO: 41268 - DNA, 22 bp, Artificial Sequence
  chemically synthesized
taatttatacttctttgacaat

SEQ ID NO: 41269 - DNA, 22 bp, Artificial Sequence
  chemically synthesized
atttatacttctttgacaattt

SEQ ID NO: 41270 - DNA, 22 bp, Artificial Sequence
  chemically synthesized
atacttctttgacaatttggga

SEQ ID NO: 41271 - DNA, 22 bp, Artificial Sequence
  chemically synthesized
tacttctttgacaatttgggag

SEQ ID NO: 41272 - DNA, 22 bp, Artificial Sequence
  chemically synthesized
ctttgacaatttgggagagtga

SEQ ID NO: 41273 - DNA, 22 bp, Artificial Sequence
  chemically synthesized
tttgacaatttgggagagtgaa

SEQ ID NO: 41274 - DNA, 22 bp, Artificial Sequence
  chemically synthesized
tgacaatttgggagagtgaaga

SEQ ID NO: 41275 - DNA, 22 bp, Artificial Sequence
  chemically synthesized
gacaatttgggagagtgaagat

SEQ ID NO: 41276 - DNA, 22 bp, Artificial Sequence
  chemically synthesized
acaatttgggagagtgaagatt

SEQ ID NO: 41277 - DNA, 22 bp, Artificial Sequence
  chemically synthesized
gggagagtgaagattctcctgg

SEQ ID NO: 41278 - DNA, 22 bp, Artificial Sequence
  chemically synthesized
ggagagtgaagattctcctggt

SEQ ID NO: 41279 - DNA, 22 bp, Artificial Sequence
  chemically synthesized
tcctggttgtgtttattctttt

SEQ ID NO: 41280 - DNA, 22 bp, Artificial Sequence
  chemically synthesized
ctggttgtgtttattcttttgt

SEQ ID NO: 41281 - DNA, 22 bp, Artificial Sequence
  chemically synthesized
gttgtgtttattcttttgtgaa

SEQ ID NO: 41282 - DNA, 22 bp, Artificial Sequence
  chemically synthesized
tgtttattcttttgtgaaaaac

SEQ ID NO: 41283 - DNA, 22 bp, Artificial Sequence
  chemically synthesized
attcttttgtgaaaaactgctt

SEQ ID NO: 41284 - DNA, 22 bp, Artificial Sequence
  chemically synthesized
ttcttttgtgaaaaactgcttt

SEQ ID NO: 41285 - DNA, 22 bp, Artificial Sequence
  chemically synthesized
ttttgtgaaaaactgctttatt

SEQ ID NO: 41286 - DNA, 22 bp, Artificial Sequence
  chemically synthesized
ttgtgaaaaactgctttatttt

SEQ ID NO: 41287 - DNA, 22 bp, Artificial Sequence
  chemically synthesized
tgtgaaaaactgctttattttc

SEQ ID NO: 41288 - DNA, 22 bp, Artificial Sequence
  chemically synthesized
gtgaaaaactgctttattttct

SEQ ID NO: 41289 - DNA, 22 bp, Artificial Sequence
  chemically synthesized
tgaaaaactgctttattttctt

SEQ ID NO: 41290 - DNA, 22 bp, Artificial Sequence
  chemically synthesized
ctttattttctttgccaaattc

SEQ ID NO: 41291 - DNA, 22 bp, Artificial Sequence
  chemically synthesized
tattttctttgccaaattcaaa

SEQ ID NO: 41292 - DNA, 22 bp, Artificial Sequence
  chemically synthesized
attttctttgccaaattcaaat

SEQ ID NO: 41293 - DNA, 22 bp, Artificial Sequence
  chemically synthesized
ttttctttgccaaattcaaata

SEQ ID NO: 41294 - DNA, 22 bp, Artificial Sequence
  chemically synthesized
tctttgccaaattcaaatagaa

SEQ ID NO: 41295 - DNA, 22 bp, Artificial Sequence
  chemically synthesized
ctttgccaaattcaaatagaac

SEQ ID NO: 41296 - DNA, 22 bp, Artificial Sequence
  chemically synthesized
tttgccaaattcaaatagaacg

SEQ ID NO: 41297 - DNA, 22 bp, Artificial Sequence
  chemically synthesized
tgccaaattcaaatagaacggt

SEQ ID NO: 41298 - DNA, 22 bp, Artificial Sequence
  chemically synthesized
gccaaattcaaatagaacggtt

SEQ ID NO: 41299 - DNA, 22 bp, Artificial Sequence
  chemically synthesized
ccaaattcaaatagaacggttg

SEQ ID NO: 41300 - DNA, 22 bp, Artificial Sequence
  chemically synthesized
aaatagaacggttgcaaaattg

SEQ ID NO: 41301 - DNA, 22 bp, Artificial Sequence
  chemically synthesized
caaaattgccagaggaaatgct

SEQ ID NO: 41302 - DNA, 22 bp, Artificial Sequence
  chemically synthesized
ccagaggaaatgctgtttttcc

SEQ ID NO: 41303 - DNA, 22 bp, Artificial Sequence
  chemically synthesized
tttttccagatggacacaccca

SEQ ID NO: 41304 - DNA, 22 bp, Artificial Sequence
  chemically synthesized
ttccagatggacacacccaggg

SEQ ID NO: 41305 - DNA, 22 bp, Artificial Sequence
  chemically synthesized
tccagatggacacacccaggga

SEQ ID NO: 41306 - DNA, 22 bp, Artificial Sequence
  chemically synthesized
ccagatggacacacccagggat

SEQ ID NO: 41307 - DNA, 22 bp, Artificial Sequence
  chemically synthesized
cagatggacacacccagggatg

SEQ ID NO: 41308 - DNA, 22 bp, Artificial Sequence
  chemically synthesized
cagtgttctcacaaataatcca

SEQ ID NO: 41309 - DNA, 22 bp, Artificial Sequence
  chemically synthesized
agtgttctcacaaataatccag

SEQ ID NO: 41310 - DNA, 22 bp, Artificial Sequence
  chemically synthesized
tcacaaataatccagttttcta

SEQ ID NO: 41311 - DNA, 22 bp, Artificial Sequence
  chemically synthesized
acaaataatccagttttctaat

SEQ ID NO: 41312 - DNA, 22 bp, Artificial Sequence
  chemically synthesized
tctaattttgcaagcccagctt

SEQ ID NO: 41313 - DNA, 22 bp, Artificial Sequence
  chemically synthesized
ctaattttgcaagcccagcttt

SEQ ID NO: 41314 - DNA, 22 bp, Artificial Sequence
  chemically synthesized
taattttgcaagcccagctttc

SEQ ID NO: 41315 - DNA, 22 bp, Artificial Sequence
  chemically synthesized
attttgcaagcccagctttcat

SEQ ID NO: 41316 - DNA, 22 bp, Artificial Sequence
  chemically synthesized
tgcaagcccagctttcattaga

SEQ ID NO: 41317 - DNA, 22 bp, Artificial Sequence
  chemically synthesized
gcaagcccagctttcattagaa

SEQ ID NO: 41318 - DNA, 22 bp, Artificial Sequence
  chemically synthesized
caagcccagctttcattagaat

SEQ ID NO: 41319 - DNA, 22 bp, Artificial Sequence
  chemically synthesized
tcattagaattttgcaaaaatc

SEQ ID NO: 41320 - DNA, 22 bp, Artificial Sequence
  chemically synthesized
cattagaattttgcaaaaatcc

SEQ ID NO: 41321 - DNA, 22 bp, Artificial Sequence
  chemically synthesized
attagaattttgcaaaaatcct

SEQ ID NO: 41322 - DNA, 22 bp, Artificial Sequence
  chemically synthesized
gaattttgcaaaaatccttgct

SEQ ID NO: 41323 - DNA, 22 bp, Artificial Sequence
  chemically synthesized
tgcaaaaatccttgctttgcga

SEQ ID NO: 41324 - DNA, 22 bp, Artificial Sequence
  chemically synthesized
gcaaaaatccttgctttgcgag

SEQ ID NO: 41325 - DNA, 22 bp, Artificial Sequence
  chemically synthesized
caaaaatccttgctttgcgagc

SEQ ID NO: 41326 - DNA, 22 bp, Artificial Sequence
  chemically synthesized
gctttgcgagcatggcacaggc

SEQ ID NO: 41327 - DNA, 22 bp, Artificial Sequence
  chemically synthesized
ctttgcgagcatggcacaggca

SEQ ID NO: 41328 - DNA, 22 bp, Artificial Sequence
  chemically synthesized
tgcgagcatggcacaggcaaga

SEQ ID NO: 41329 - DNA, 22 bp, Artificial Sequence
  chemically synthesized
gcgagcatggcacaggcaagag

SEQ ID NO: 41330 - DNA, 22 bp, Artificial Sequence
  chemically synthesized
cgagcatggcacaggcaagaga

SEQ ID NO: 41331 - DNA, 22 bp, Artificial Sequence
  chemically synthesized
tctctttcttcccccagagcct

SEQ ID NO: 41332 - DNA, 22 bp, Artificial Sequence
  chemically synthesized
tctttcttcccccagagccttt

SEQ ID NO: 41333 - DNA, 22 bp, Artificial Sequence
  chemically synthesized
tttcttcccccagagcctttga

SEQ ID NO: 41334 - DNA, 22 bp, Artificial Sequence
  chemically synthesized
tcttcccccagagcctttgact

SEQ ID NO: 41335 - DNA, 22 bp, Artificial Sequence
  chemically synthesized
cttcccccagagcctttgactg

SEQ ID NO: 41336 - DNA, 22 bp, Artificial Sequence
  chemically synthesized
ttcccccagagcctttgactgc

SEQ ID NO: 41337 - DNA, 22 bp, Artificial Sequence
  chemically synthesized
cccccagagcctttgactgcac

SEQ ID NO: 41338 - DNA, 22 bp, Artificial Sequence
  chemically synthesized
ccccagagcctttgactgcact

SEQ ID NO: 41339 - DNA, 22 bp, Artificial Sequence
  chemically synthesized
tgactgcacttagatcattgac

SEQ ID NO: 41340 - DNA, 22 bp, Artificial Sequence
  chemically synthesized
gactgcacttagatcattgact

SEQ ID NO: 41341 - DNA, 22 bp, Artificial Sequence
  chemically synthesized
actgcacttagatcattgactt

SEQ ID NO: 41342 - DNA, 22 bp, Artificial Sequence
  chemically synthesized
cacttagatcattgactttggt

SEQ ID NO: 41343 - DNA, 22 bp, Artificial Sequence
  chemically synthesized
agatcattgactttggttcaga

SEQ ID NO: 41344 - DNA, 22 bp, Artificial Sequence
  chemically synthesized
gatcattgactttggttcagaa

SEQ ID NO: 41345 - DNA, 22 bp, Artificial Sequence
  chemically synthesized
actttggttcagaaacctgact

SEQ ID NO: 41346 - DNA, 22 bp, Artificial Sequence
  chemically synthesized
tggttcagaaacctgactgcat

SEQ ID NO: 41347 - DNA, 22 bp, Artificial Sequence
  chemically synthesized
ggttcagaaacctgactgcatc

SEQ ID NO: 41348 - DNA, 22 bp, Artificial Sequence
  chemically synthesized
gttcagaaacctgactgcatct

SEQ ID NO: 41349 - DNA, 22 bp, Artificial Sequence
  chemically synthesized
agaaacctgactgcatctggag

SEQ ID NO: 41350 - DNA, 22 bp, Artificial Sequence
  chemically synthesized
actgcatctggagttgacatga

SEQ ID NO: 41351 - DNA, 22 bp, Artificial Sequence
  chemically synthesized
catctggagttgacatgagcag

SEQ ID NO: 41352 - DNA, 22 bp, Artificial Sequence
  chemically synthesized
gagttgacatgagcagcatgga

SEQ ID NO: 41353 - DNA, 22 bp, Artificial Sequence
  chemically synthesized
acatgagcagcatggaagatgt

SEQ ID NO: 41354 - DNA, 22 bp, Artificial Sequence
  chemically synthesized
gtcccagcacctcactccagag

SEQ ID NO: 41355 - DNA, 22 bp, Artificial Sequence
  chemically synthesized
tcccagcacctcactccagagg

SEQ ID NO: 41356 - DNA, 22 bp, Artificial Sequence
  chemically synthesized
actccagaggccagctcagctc

SEQ ID NO: 41357 - DNA, 22 bp, Artificial Sequence
  chemically synthesized
cagaggccagctcagctcaatc

SEQ ID NO: 41358 - DNA, 22 bp, Artificial Sequence
  chemically synthesized
agctcaatctgggcagagctgc

SEQ ID NO: 41359 - DNA, 22 bp, Artificial Sequence
  chemically synthesized
aatctgggcagagctgcatgat

SEQ ID NO: 41360 - DNA, 22 bp, Artificial Sequence
  chemically synthesized
ggcagagctgcatgatggaagt

SEQ ID NO: 41361 - DNA, 22 bp, Artificial Sequence
  chemically synthesized
catgatggaagtttctgactac

SEQ ID NO: 41362 - DNA, 22 bp, Artificial Sequence
  chemically synthesized
ctgactaccaagcatcgggcag

SEQ ID NO: 41363 - DNA, 22 bp, Artificial Sequence
  chemically synthesized
tgactaccaagcatcgggcaga

SEQ ID NO: 41364 - DNA, 22 bp, Artificial Sequence
  chemically synthesized
actaccaagcatcgggcagagg

SEQ ID NO: 41365 - DNA, 22 bp, Artificial Sequence
  chemically synthesized
ccaagcatcgggcagagggtgc

SEQ ID NO: 41366 - DNA, 22 bp, Artificial Sequence
  chemically synthesized
gactacatagttgtgtgaggga

SEQ ID NO: 41367 - DNA, 22 bp, Artificial Sequence
  chemically synthesized
catagttgtgtgagggagcacc

SEQ ID NO: 41368 - DNA, 22 bp, Artificial Sequence
  chemically synthesized
tgtgagggagcaccgttctcta

SEQ ID NO: 41369 - DNA, 22 bp, Artificial Sequence
  chemically synthesized
tctagaatctgctatttgagca

SEQ ID NO: 41370 - DNA, 22 bp, Artificial Sequence
  chemically synthesized
tagaatctgctatttgagcaag

SEQ ID NO: 41371 - DNA, 22 bp, Artificial Sequence
  chemically synthesized
gaatctgctatttgagcaaggc

SEQ ID NO: 41372 - DNA, 22 bp, Artificial Sequence
  chemically synthesized
ctatttgagcaaggcaaacatc

SEQ ID NO: 41373 - DNA, 22 bp, Artificial Sequence
  chemically synthesized
tttgagcaaggcaaacatcctg

SEQ ID NO: 41374 - DNA, 22 bp, Artificial Sequence
  chemically synthesized
gagcaaggcaaacatcctgata

SEQ ID NO: 41375 - DNA, 22 bp, Artificial Sequence
  chemically synthesized
agcaaggcaaacatcctgataa

SEQ ID NO: 41376 - DNA, 22 bp, Artificial Sequence
  chemically synthesized
ataatggtgaaaacctaccgca

SEQ ID NO: 41377 - DNA, 22 bp, Artificial Sequence
  chemically synthesized
ccgcaagttgccaggaaagttg

SEQ ID NO: 41378 - DNA, 22 bp, Artificial Sequence
  chemically synthesized
ccaggaaagttgatgtggtctg

SEQ ID NO: 41379 - DNA, 22 bp, Artificial Sequence
  chemically synthesized
atgtggtctgcgagtaggtgct

SEQ ID NO: 41380 - DNA, 22 bp, Artificial Sequence
  chemically synthesized
cgagtaggtgctgccatccagt

SEQ ID NO: 41381 - DNA, 22 bp, Artificial Sequence
  chemically synthesized
ccatccagtggccgacatagag

SEQ ID NO: 41382 - DNA, 22 bp, Artificial Sequence
  chemically synthesized
tgagggcaggtaggccacaggt

SEQ ID NO: 41383 - DNA, 22 bp, Artificial Sequence
  chemically synthesized
agggcaggtaggccacaggtga

SEQ ID NO: 41384 - DNA, 22 bp, Artificial Sequence
  chemically synthesized
aagccctccctgatggggcctt

SEQ ID NO: 41385 - DNA, 22 bp, Artificial Sequence
  chemically synthesized
cctgatggggccttggggagag

SEQ ID NO: 41386 - DNA, 22 bp, Artificial Sequence
  chemically synthesized
atggggccttggggagagggca

SEQ ID NO: 41387 - DNA, 22 bp, Artificial Sequence
  chemically synthesized
ggggagagggcagcagggtaag

SEQ ID NO: 41388 - DNA, 22 bp, Artificial Sequence
  chemically synthesized
gggagagggcagcagggtaagt

SEQ ID NO: 41389 - DNA, 22 bp, Artificial Sequence
  chemically synthesized
attgtggatgacgactgacctg

SEQ ID NO: 41390 - DNA, 22 bp, Artificial Sequence
  chemically synthesized
tggatgacgactgacctggaaa

SEQ ID NO: 41391 - DNA, 22 bp, Artificial Sequence
  chemically synthesized
acctggaaaatccccttggcct

SEQ ID NO: 41392 - DNA, 22 bp, Artificial Sequence
  chemically synthesized
gaaaatccccttggcctcaaca

SEQ ID NO: 41393 - DNA, 22 bp, Artificial Sequence
  chemically synthesized
ggcctcaacacctccaaactct

SEQ ID NO: 41394 - DNA, 22 bp, Artificial Sequence
  chemically synthesized
gcctcaacacctccaaactctg

SEQ ID NO: 41395 - DNA, 22 bp, Artificial Sequence
  chemically synthesized
aacacctccaaactctgcattt

SEQ ID NO: 41396 - DNA, 22 bp, Artificial Sequence
  chemically synthesized
caaactctgcatttgatccaag

SEQ ID NO: 41397 - DNA, 22 bp, Artificial Sequence
  chemically synthesized
tgcatttgatccaagtcaggga

SEQ ID NO: 41398 - DNA, 22 bp, Artificial Sequence
  chemically synthesized
catttgatccaagtcagggaac

SEQ ID NO: 41399 - DNA, 22 bp, Artificial Sequence
  chemically synthesized
gatccaagtcagggaacacctg

SEQ ID NO: 41400 - DNA, 22 bp, Artificial Sequence
  chemically synthesized
atccaagtcagggaacacctgg

SEQ ID NO: 41401 - DNA, 22 bp, Artificial Sequence
  chemically synthesized
gaaacatgaaggggagagcagg

SEQ ID NO: 41402 - DNA, 22 bp, Artificial Sequence
  chemically synthesized
tgacctccctctcagaggctga

SEQ ID NO: 41403 - DNA, 22 bp, Artificial Sequence
  chemically synthesized
gacctccctctcagaggctgag

SEQ ID NO: 41404 - DNA, 22 bp, Artificial Sequence
  chemically synthesized
acctccctctcagaggctgaga

SEQ ID NO: 41405 - DNA, 22 bp, Artificial Sequence
  chemically synthesized
cctctcagaggctgagaacgcc

SEQ ID NO: 41406 - DNA, 22 bp, Artificial Sequence
  chemically synthesized
tcagaggctgagaacgccaatt

SEQ ID NO: 41407 - DNA, 22 bp, Artificial Sequence
  chemically synthesized
agaggctgagaacgccaattga

SEQ ID NO: 41408 - DNA, 22 bp, Artificial Sequence
  chemically synthesized
agaacgccaattgacctgatgt

SEQ ID NO: 41409 - DNA, 22 bp, Artificial Sequence
  chemically synthesized
acctgatgtcattattgacatg

SEQ ID NO: 41410 - DNA, 22 bp, Artificial Sequence
  chemically synthesized
atgtcattattgacatgtagaa

SEQ ID NO: 41411 - DNA, 22 bp, Artificial Sequence
  chemically synthesized
ttgacatgtagaaaattgatga

SEQ ID NO: 41412 - DNA, 22 bp, Artificial Sequence
  chemically synthesized
acatgtagaaaattgatgaaca

SEQ ID NO: 41413 - DNA, 22 bp, Artificial Sequence
  chemically synthesized
atgaacaggcctgagttatgtt

SEQ ID NO: 41414 - DNA, 22 bp, Artificial Sequence
  chemically synthesized
agttatgttttgtggcacctca

SEQ ID NO: 41415 - DNA, 22 bp, Artificial Sequence
  chemically synthesized
tgttttgtggcacctcatggtc

SEQ ID NO: 41416 - DNA, 22 bp, Artificial Sequence
  chemically synthesized
tgtggcacctcatggtctagtt

SEQ ID NO: 41417 - DNA, 22 bp, Artificial Sequence
  chemically synthesized
gtggcacctcatggtctagtta

SEQ ID NO: 41418 - DNA, 22 bp, Artificial Sequence
  chemically synthesized
tggcacctcatggtctagttag

SEQ ID NO: 41419 - DNA, 22 bp, Artificial Sequence
  chemically synthesized
atggtctagttagtgttctgag

SEQ ID NO: 41420 - DNA, 22 bp, Artificial Sequence
  chemically synthesized
gttagtgttctgagaatcattt

SEQ ID NO: 41421 - DNA, 22 bp, Artificial Sequence
  chemically synthesized
gtgttctgagaatcattttctc

SEQ ID NO: 41422 - DNA, 22 bp, Artificial Sequence
  chemically synthesized
tgagaatcattttctcagtgga

SEQ ID NO: 41423 - DNA, 22 bp, Artificial Sequence
  chemically synthesized
agaatcattttctcagtggacc

SEQ ID NO: 41424 - DNA, 22 bp, Artificial Sequence
  chemically synthesized
tctcagtggacctgcaggtgag

SEQ ID NO: 41425 - DNA, 22 bp, Artificial Sequence
  chemically synthesized
ctcagtggacctgcaggtgaga

SEQ ID NO: 41426 - DNA, 22 bp, Artificial Sequence
  chemically synthesized
tcagtggacctgcaggtgagac

SEQ ID NO: 41427 - DNA, 22 bp, Artificial Sequence
  chemically synthesized
agtggacctgcaggtgagacca

SEQ ID NO: 41428 - DNA, 22 bp, Artificial Sequence
  chemically synthesized
caggtgagaccaggcgaggcag

SEQ ID NO: 41429 - DNA, 22 bp, Artificial Sequence
  chemically synthesized
gtgggggatggtggttagaaat

SEQ ID NO: 41430 - DNA, 22 bp, Artificial Sequence
  chemically synthesized
gaaatgtgtggatggttgtggg

SEQ ID NO: 41431 - DNA, 22 bp, Artificial Sequence
  chemically synthesized
tggggcagaagaaacagcaagt

SEQ ID NO: 41432 - DNA, 22 bp, Artificial Sequence
  chemically synthesized
tgggccagctacaaactggtta

SEQ ID NO: 41433 - DNA, 22 bp, Artificial Sequence
  chemically synthesized
ggccagctacaaactggttata

SEQ ID NO: 41434 - DNA, 22 bp, Artificial Sequence
  chemically synthesized
caaactggttatatgatgtcta

SEQ ID NO: 41435 - DNA, 22 bp, Artificial Sequence
  chemically synthesized
gttatatgatgtctactgatga

SEQ ID NO: 41436 - DNA, 22 bp, Artificial Sequence
  chemically synthesized
tatgatgtctactgatgatgat

SEQ ID NO: 41437 - DNA, 22 bp, Artificial Sequence
  chemically synthesized
ctgatgatgatagtgatggtgg

SEQ ID NO: 41438 - DNA, 22 bp, Artificial Sequence
  chemically synthesized
atgatgatagtgatggtggtgg

SEQ ID NO: 41439 - DNA, 22 bp, Artificial Sequence
  chemically synthesized
tgatggtggtggaatgatgatg

SEQ ID NO: 41440 - DNA, 22 bp, Artificial Sequence
  chemically synthesized
gtgatggtggtagtggtcgtgg

SEQ ID NO: 41441 - DNA, 22 bp, Artificial Sequence
  chemically synthesized
atggtggtggtaatgataatga

SEQ ID NO: 41442 - DNA, 22 bp, Artificial Sequence
  chemically synthesized
tcatgatgatagcggtggtgat

SEQ ID NO: 41443 - DNA, 22 bp, Artificial Sequence
  chemically synthesized
agggtgatgataatagtgacag

SEQ ID NO: 41444 - DNA, 22 bp, Artificial Sequence
  chemically synthesized
agtagtaatgatggtgatggtg

SEQ ID NO: 41445 - DNA, 22 bp, Artificial Sequence
  chemically synthesized
tggtgatgatggtggtggtagt

SEQ ID NO: 41446 - DNA, 22 bp, Artificial Sequence
  chemically synthesized
agggtgatgataatagtgatag

SEQ ID NO: 41447 - DNA, 22 bp, Artificial Sequence
  chemically synthesized
tcactattatcatcaccctcaa

SEQ ID NO: 41448 - DNA, 22 bp, Artificial Sequence
  chemically synthesized
ttatcatcaccctcaacatcat

SEQ ID NO: 41449 - DNA, 22 bp, Artificial Sequence
  chemically synthesized
tcatcaccctcaacatcatcac

SEQ ID NO: 41450 - DNA, 22 bp, Artificial Sequence
  chemically synthesized
aacatcatcaccatcatcacta

SEQ ID NO: 41451 - DNA, 22 bp, Artificial Sequence
  chemically synthesized
tcatcaccaccaccatcatcgt

SEQ ID NO: 41452 - DNA, 22 bp, Artificial Sequence
  chemically synthesized
ctaccactaccaccaccatcat

SEQ ID NO: 41453 - DNA, 22 bp, Artificial Sequence
  chemically synthesized
ccactaccaccaccatcatcac

SEQ ID NO: 41454 - DNA, 22 bp, Artificial Sequence
  chemically synthesized
ccaccaccatcatcaccacagc

SEQ ID NO: 41455 - DNA, 22 bp, Artificial Sequence
  chemically synthesized
ctactcagcaccaccatcatca

SEQ ID NO: 41456 - DNA, 22 bp, Artificial Sequence
  chemically synthesized
ctcagcaccaccatcatcattc

SEQ ID NO: 41457 - DNA, 22 bp, Artificial Sequence
  chemically synthesized
agcaccaccatcatcattccac

SEQ ID NO: 41458 - DNA, 22 bp, Artificial Sequence
  chemically synthesized
caccaccatcaccatcattcca

SEQ ID NO: 41459 - DNA, 22 bp, Artificial Sequence
  chemically synthesized
caccatcaccattatcattacc

SEQ ID NO: 41460 - DNA, 22 bp, Artificial Sequence
  chemically synthesized
tcattaccaccaccactgtcac

SEQ ID NO: 41461 - DNA, 22 bp, Artificial Sequence
  chemically synthesized
ccaccaccactgtcactattat

SEQ ID NO: 41462 - DNA, 22 bp, Artificial Sequence
  chemically synthesized
tcactattatcatcaccctcaa

SEQ ID NO: 41463 - DNA, 22 bp, Artificial Sequence
  chemically synthesized
ttatcatcaccctcaacatcat

SEQ ID NO: 41464 - DNA, 22 bp, Artificial Sequence
  chemically synthesized
tcatcaccctcaacatcatcac

SEQ ID NO: 41465 - DNA, 22 bp, Artificial Sequence
  chemically synthesized
aacatcatcaccaccaccatca

SEQ ID NO: 41466 - DNA, 22 bp, Artificial Sequence
  chemically synthesized
ctaccaccaccaccaccatcac

SEQ ID NO: 41467 - DNA, 22 bp, Artificial Sequence
  chemically synthesized
ccaccaccaccaccatcaccat

SEQ ID NO: 41468 - DNA, 22 bp, Artificial Sequence
  chemically synthesized
taccaccatcaccattatcatc

SEQ ID NO: 41469 - DNA, 22 bp, Artificial Sequence
  chemically synthesized
ccaccatcaccattatcatcac

SEQ ID NO: 41470 - DNA, 22 bp, Artificial Sequence
  chemically synthesized
tcatcaccatcaccatcaccac

SEQ ID NO: 41471 - DNA, 22 bp, Artificial Sequence
  chemically synthesized
tcatcatgataatcattatcat

SEQ ID NO: 41472 - DNA, 22 bp, Artificial Sequence
  chemically synthesized
tcattaccaccaccattagcat

SEQ ID NO: 41473 - DNA, 22 bp, Artificial Sequence
  chemically synthesized
ccaccaccattagcattatcat

SEQ ID NO: 41474 - DNA, 22 bp, Artificial Sequence
  chemically synthesized
gcattatcattaccaccaccat

SEQ ID NO: 41475 - DNA, 22 bp, Artificial Sequence
  chemically synthesized
tcattaccaccaccatcactat

SEQ ID NO: 41476 - DNA, 22 bp, Artificial Sequence
  chemically synthesized
ccaccaccatcactatcactat

SEQ ID NO: 41477 - DNA, 22 bp, Artificial Sequence
  chemically synthesized
tcactatcaccatcaccacgac

SEQ ID NO: 41478 - DNA, 22 bp, Artificial Sequence
  chemically synthesized
tcaccatcaccacgaccactac

SEQ ID NO: 41479 - DNA, 22 bp, Artificial Sequence
  chemically synthesized
ccaccatcaccaacaccatcat

SEQ ID NO: 41480 - DNA, 22 bp, Artificial Sequence
  chemically synthesized
ctacccaccaccaccatcatca

SEQ ID NO: 41481 - DNA, 22 bp, Artificial Sequence
  chemically synthesized
cccaccaccaccatcatcatca

SEQ ID NO: 41482 - DNA, 22 bp, Artificial Sequence
  chemically synthesized
caccaccatcacaattattacc

SEQ ID NO: 41483 - DNA, 22 bp, Artificial Sequence
  chemically synthesized
ttaccaccaccaccatcaccac

SEQ ID NO: 41484 - DNA, 22 bp, Artificial Sequence
  chemically synthesized
ccaccaccaccatcaccaccac

SEQ ID NO: 41485 - DNA, 22 bp, Artificial Sequence
  chemically synthesized
tcatcatcagtagacatcatat

SEQ ID NO: 41486 - DNA, 22 bp, Artificial Sequence
  chemically synthesized
gtagctggcccagagcctactt

SEQ ID NO: 41487 - DNA, 22 bp, Artificial Sequence
  chemically synthesized
tagctggcccagagcctacttg

SEQ ID NO: 41488 - DNA, 22 bp, Artificial Sequence
  chemically synthesized
gcccagagcctacttgctgttt

SEQ ID NO: 41489 - DNA, 22 bp, Artificial Sequence
  chemically synthesized
cttgctgtttcttctgccccac

SEQ ID NO: 41490 - DNA, 22 bp, Artificial Sequence
  chemically synthesized
gctgtttcttctgccccacaac

SEQ ID NO: 41491 - DNA, 22 bp, Artificial Sequence
  chemically synthesized
ctgtttcttctgccccacaacc

SEQ ID NO: 41492 - DNA, 22 bp, Artificial Sequence
  chemically synthesized
tttcttctgccccacaaccatc

SEQ ID NO: 41493 - DNA, 22 bp, Artificial Sequence
  chemically synthesized
cttctgccccacaaccatccac

SEQ ID NO: 41494 - DNA, 22 bp, Artificial Sequence
  chemically synthesized
ttctgccccacaaccatccaca

SEQ ID NO: 41495 - DNA, 22 bp, Artificial Sequence
  chemically synthesized
ctgccccacaaccatccacaca

SEQ ID NO: 41496 - DNA, 22 bp, Artificial Sequence
  chemically synthesized
tgccccacaaccatccacacat

SEQ ID NO: 41497 - DNA, 22 bp, Artificial Sequence
  chemically synthesized
ccccacaaccatccacacattt

SEQ ID NO: 41498 - DNA, 22 bp, Artificial Sequence
  chemically synthesized
ctaaccaccatcccccactagg

SEQ ID NO: 41499 - DNA, 22 bp, Artificial Sequence
  chemically synthesized
taaccaccatcccccactaggc

SEQ ID NO: 41500 - DNA, 22 bp, Artificial Sequence
  chemically synthesized
accaccatcccccactaggctt

SEQ ID NO: 41501 - DNA, 22 bp, Artificial Sequence
  chemically synthesized
ggcttctgcctcgcctggtctc

SEQ ID NO: 41502 - DNA, 22 bp, Artificial Sequence
  chemically synthesized
ctgcctcgcctggtctcacctg

SEQ ID NO: 41503 - DNA, 22 bp, Artificial Sequence
  chemically synthesized
tgcctcgcctggtctcacctgc

SEQ ID NO: 41504 - DNA, 22 bp, Artificial Sequence
  chemically synthesized
cctcgcctggtctcacctgcag

SEQ ID NO: 41505 - DNA, 22 bp, Artificial Sequence
  chemically synthesized
gcctggtctcacctgcaggtcc

SEQ ID NO: 41506 - DNA, 22 bp, Artificial Sequence
  chemically synthesized
gtctcacctgcaggtccactga

SEQ ID NO: 41507 - DNA, 22 bp, Artificial Sequence
  chemically synthesized
acctgcaggtccactgagaaaa

SEQ ID NO: 41508 - DNA, 22 bp, Artificial Sequence
  chemically synthesized
caggtccactgagaaaatgatt

SEQ ID NO: 41509 - DNA, 22 bp, Artificial Sequence
  chemically synthesized
agaaaatgattctcagaacact

SEQ ID NO: 41510 - DNA, 22 bp, Artificial Sequence
  chemically synthesized
tcagaacactaactagaccatg

SEQ ID NO: 41511 - DNA, 22 bp, Artificial Sequence
  chemically synthesized
agaacactaactagaccatgag

SEQ ID NO: 41512 - DNA, 22 bp, Artificial Sequence
  chemically synthesized
actagaccatgaggtgccacaa

SEQ ID NO: 41513 - DNA, 22 bp, Artificial Sequence
  chemically synthesized
gaccatgaggtgccacaaaaca

SEQ ID NO: 41514 - DNA, 22 bp, Artificial Sequence
  chemically synthesized
aggcctgttcatcaattttcta

SEQ ID NO: 41515 - DNA, 22 bp, Artificial Sequence
  chemically synthesized
ttcatcaattttctacatgtca

SEQ ID NO: 41516 - DNA, 22 bp, Artificial Sequence
  chemically synthesized
atcaattttctacatgtcaata

SEQ ID NO: 41517 - DNA, 22 bp, Artificial Sequence
  chemically synthesized
tctacatgtcaataatgacatc

SEQ ID NO: 41518 - DNA, 22 bp, Artificial Sequence
  chemically synthesized
ctacatgtcaataatgacatca

SEQ ID NO: 41519 - DNA, 22 bp, Artificial Sequence
  chemically synthesized
tacatgtcaataatgacatcag

SEQ ID NO: 41520 - DNA, 22 bp, Artificial Sequence
  chemically synthesized
catgtcaataatgacatcaggt

SEQ ID NO: 41521 - DNA, 22 bp, Artificial Sequence
  chemically synthesized
gcgttctcagcctctgagaggg

SEQ ID NO: 41522 - DNA, 22 bp, Artificial Sequence
  chemically synthesized
tcagcctctgagagggaggtca

SEQ ID NO: 41523 - DNA, 22 bp, Artificial Sequence
  chemically synthesized
agcctctgagagggaggtcaaa

SEQ ID NO: 41524 - DNA, 22 bp, Artificial Sequence
  chemically synthesized
tgagagggaggtcaaagttttc

SEQ ID NO: 41525 - DNA, 22 bp, Artificial Sequence
  chemically synthesized
agagggaggtcaaagttttcct

SEQ ID NO: 41526 - DNA, 22 bp, Artificial Sequence
  chemically synthesized
tcctgctctccccttcatgttt

SEQ ID NO: 41527 - DNA, 22 bp, Artificial Sequence
  chemically synthesized
cctgctctccccttcatgtttc

SEQ ID NO: 41528 - DNA, 22 bp, Artificial Sequence
  chemically synthesized
ctgctctccccttcatgtttcc

SEQ ID NO: 41529 - DNA, 22 bp, Artificial Sequence
  chemically synthesized
ctctccccttcatgtttccagg

SEQ ID NO: 41530 - DNA, 22 bp, Artificial Sequence
  chemically synthesized
tccccttcatgtttccaggtgt

SEQ ID NO: 41531 - DNA, 22 bp, Artificial Sequence
  chemically synthesized
cccttcatgtttccaggtgttc

SEQ ID NO: 41532 - DNA, 22 bp, Artificial Sequence
  chemically synthesized
catgtttccaggtgttccctga

SEQ ID NO: 41533 - DNA, 22 bp, Artificial Sequence
  chemically synthesized
atgtttccaggtgttccctgac

SEQ ID NO: 41534 - DNA, 22 bp, Artificial Sequence
  chemically synthesized
ccaggtgttccctgacttggat

SEQ ID NO: 41535 - DNA, 22 bp, Artificial Sequence
  chemically synthesized
caggtgttccctgacttggatc

SEQ ID NO: 41536 - DNA, 22 bp, Artificial Sequence
  chemically synthesized
cctgacttggatcaaatgcaga

SEQ ID NO: 41537 - DNA, 22 bp, Artificial Sequence
  chemically synthesized
acttggatcaaatgcagagttt

SEQ ID NO: 41538 - DNA, 22 bp, Artificial Sequence
  chemically synthesized
ggatcaaatgcagagtttggag

SEQ ID NO: 41539 - DNA, 22 bp, Artificial Sequence
  chemically synthesized
gatcaaatgcagagtttggagg

SEQ ID NO: 41540 - DNA, 22 bp, Artificial Sequence
  chemically synthesized
ggaggtgttgaggccaagggga

SEQ ID NO: 41541 - DNA, 22 bp, Artificial Sequence
  chemically synthesized
gaggtgttgaggccaaggggat

SEQ ID NO: 41542 - DNA, 22 bp, Artificial Sequence
  chemically synthesized
aggccaaggggattttccaggt

SEQ ID NO: 41543 - DNA, 22 bp, Artificial Sequence
  chemically synthesized
tccaggtcagtcgtcatccaca

SEQ ID NO: 41544 - DNA, 22 bp, Artificial Sequence
  chemically synthesized
ccaggtcagtcgtcatccacaa

SEQ ID NO: 41545 - DNA, 22 bp, Artificial Sequence
  chemically synthesized
caggtcagtcgtcatccacaat

SEQ ID NO: 41546 - DNA, 22 bp, Artificial Sequence
  chemically synthesized
atcctgccgctggacttaccct

SEQ ID NO: 41547 - DNA, 22 bp, Artificial Sequence
  chemically synthesized
ccgctggacttaccctgctgcc

SEQ ID NO: 41548 - DNA, 22 bp, Artificial Sequence
  chemically synthesized
gacttaccctgctgccctctcc

SEQ ID NO: 41549 - DNA, 22 bp, Artificial Sequence
  chemically synthesized
accctgctgccctctccccaag

SEQ ID NO: 41550 - DNA, 22 bp, Artificial Sequence
  chemically synthesized
ccctgctgccctctccccaagg

SEQ ID NO: 41551 - DNA, 22 bp, Artificial Sequence
  chemically synthesized
ctgccctctccccaaggcccca

SEQ ID NO: 41552 - DNA, 22 bp, Artificial Sequence
  chemically synthesized
ccctctccccaaggccccatca

SEQ ID NO: 41553 - DNA, 22 bp, Artificial Sequence
  chemically synthesized
tccccaaggccccatcagggag

SEQ ID NO: 41554 - DNA, 22 bp, Artificial Sequence
  chemically synthesized
cccaaggccccatcagggaggg

SEQ ID NO: 41555 - DNA, 22 bp, Artificial Sequence
  chemically synthesized
caatcctcttgtcacctgtggc

SEQ ID NO: 41556 - DNA, 22 bp, Artificial Sequence
  chemically synthesized
aatcctcttgtcacctgtggcc

SEQ ID NO: 41557 - DNA, 22 bp, Artificial Sequence
  chemically synthesized
ttgtcacctgtggcctacctgc

SEQ ID NO: 41558 - DNA, 22 bp, Artificial Sequence
  chemically synthesized
gtcacctgtggcctacctgccc

SEQ ID NO: 41559 - DNA, 22 bp, Artificial Sequence
  chemically synthesized
tcacctgtggcctacctgccct

SEQ ID NO: 41560 - DNA, 22 bp, Artificial Sequence
  chemically synthesized
tggcctacctgccctcagagat

SEQ ID NO: 41561 - DNA, 22 bp, Artificial Sequence
  chemically synthesized
cctgccctcagagatgacatct

SEQ ID NO: 41562 - DNA, 22 bp, Artificial Sequence
  chemically synthesized
ccctcagagatgacatctctat

SEQ ID NO: 41563 - DNA, 22 bp, Artificial Sequence
  chemically synthesized
agagatgacatctctatgtcgg

SEQ ID NO: 41564 - DNA, 22 bp, Artificial Sequence
  chemically synthesized
tatgtcggccactggatggcag

SEQ ID NO: 41565 - DNA, 22 bp, Artificial Sequence
  chemically synthesized
tgtcggccactggatggcagca

SEQ ID NO: 41566 - DNA, 22 bp, Artificial Sequence
  chemically synthesized
gatggcagcacctactcgcaga

SEQ ID NO: 41567 - DNA, 22 bp, Artificial Sequence
  chemically synthesized
ctcgcagaccacatcaactttc

SEQ ID NO: 41568 - DNA, 22 bp, Artificial Sequence
  chemically synthesized
gcagaccacatcaactttcctg

SEQ ID NO: 41569 - DNA, 22 bp, Artificial Sequence
  chemically synthesized
tcctggcaacttgcggtaggtt

SEQ ID NO: 41570 - DNA, 22 bp, Artificial Sequence
  chemically synthesized
cctggcaacttgcggtaggttt

SEQ ID NO: 41571 - DNA, 22 bp, Artificial Sequence
  chemically synthesized
ctggcaacttgcggtaggtttt

SEQ ID NO: 41572 - DNA, 22 bp, Artificial Sequence
  chemically synthesized
gcaacttgcggtaggttttcac

SEQ ID NO: 41573 - DNA, 22 bp, Artificial Sequence
  chemically synthesized
gcggtaggttttcaccattatc

SEQ ID NO: 41574 - DNA, 22 bp, Artificial Sequence
  chemically synthesized
cggtaggttttcaccattatca

SEQ ID NO: 41575 - DNA, 22 bp, Artificial Sequence
  chemically synthesized
tcaccattatcaggatgtttgc

SEQ ID NO: 41576 - DNA, 22 bp, Artificial Sequence
  chemically synthesized
caccattatcaggatgtttgcc

SEQ ID NO: 41577 - DNA, 22 bp, Artificial Sequence
  chemically synthesized
accattatcaggatgtttgcct

SEQ ID NO: 41578 - DNA, 22 bp, Artificial Sequence
  chemically synthesized
tcaggatgtttgccttgctcaa

SEQ ID NO: 41579 - DNA, 22 bp, Artificial Sequence
  chemically synthesized
gccttgctcaaatagcagattc

SEQ ID NO: 41580 - DNA, 22 bp, Artificial Sequence
  chemically synthesized
ccttgctcaaatagcagattct

SEQ ID NO: 41581 - DNA, 22 bp, Artificial Sequence
  chemically synthesized
gctcaaatagcagattctagag

SEQ ID NO: 41582 - DNA, 22 bp, Artificial Sequence
  chemically synthesized
ctcaaatagcagattctagaga

SEQ ID NO: 41583 - DNA, 22 bp, Artificial Sequence
  chemically synthesized
aaatagcagattctagagaacg

SEQ ID NO: 41584 - DNA, 22 bp, Artificial Sequence
  chemically synthesized
tagagaacggtgctccctcaca

SEQ ID NO: 41585 - DNA, 22 bp, Artificial Sequence
  chemically synthesized
gagaacggtgctccctcacaca

SEQ ID NO: 41586 - DNA, 22 bp, Artificial Sequence
  chemically synthesized
cctcacacaactatgtagtcca

SEQ ID NO: 41587 - DNA, 22 bp, Artificial Sequence
  chemically synthesized
acacaactatgtagtccaggtg

SEQ ID NO: 41588 - DNA, 22 bp, Artificial Sequence
  chemically synthesized
tgtagtccaggtgatgcaccct

SEQ ID NO: 41589 - DNA, 22 bp, Artificial Sequence
  chemically synthesized
tgcccgatgcttggtagtcaga

SEQ ID NO: 41590 - DNA, 22 bp, Artificial Sequence
  chemically synthesized
cccgatgcttggtagtcagaaa

SEQ ID NO: 41591 - DNA, 22 bp, Artificial Sequence
  chemically synthesized
ggtagtcagaaacttccatcat

SEQ ID NO: 41592 - DNA, 22 bp, Artificial Sequence
  chemically synthesized
gtagtcagaaacttccatcatg

SEQ ID NO: 41593 - DNA, 22 bp, Artificial Sequence
  chemically synthesized
ccatcatgcagctctgcccaga

SEQ ID NO: 41594 - DNA, 22 bp, Artificial Sequence
  chemically synthesized
catcatgcagctctgcccagat

SEQ ID NO: 41595 - DNA, 22 bp, Artificial Sequence
  chemically synthesized
tgcccagattgagctgagctgg

SEQ ID NO: 41596 - DNA, 22 bp, Artificial Sequence
  chemically synthesized
cccagattgagctgagctggcc

SEQ ID NO: 41597 - DNA, 22 bp, Artificial Sequence
  chemically synthesized
agctgagctggcctctggagtg

SEQ ID NO: 41598 - DNA, 22 bp, Artificial Sequence
  chemically synthesized
agctggcctctggagtgaggtg

SEQ ID NO: 41599 - DNA, 22 bp, Artificial Sequence
  chemically synthesized
gcctctggagtgaggtgctggg

SEQ ID NO: 41600 - DNA, 22 bp, Artificial Sequence
  chemically synthesized
tggagtgaggtgctgggacaaa

SEQ ID NO: 41601 - DNA, 22 bp, Artificial Sequence
  chemically synthesized
gagtgaggtgctgggacaaaca

SEQ ID NO: 41602 - DNA, 22 bp, Artificial Sequence
  chemically synthesized
ggacaaacatcttccatgctgc

SEQ ID NO: 41603 - DNA, 22 bp, Artificial Sequence
  chemically synthesized
ccatgctgctcatgtcaactcc

SEQ ID NO: 41604 - DNA, 22 bp, Artificial Sequence
  chemically synthesized
catgctgctcatgtcaactcca

SEQ ID NO: 41605 - DNA, 22 bp, Artificial Sequence
  chemically synthesized
ctcatgtcaactccagatgcag

SEQ ID NO: 41606 - DNA, 22 bp, Artificial Sequence
  chemically synthesized
atgtcaactccagatgcagtca

SEQ ID NO: 41607 - DNA, 22 bp, Artificial Sequence
  chemically synthesized
cagatgcagtcaggtttctgaa

SEQ ID NO: 41608 - DNA, 22 bp, Artificial Sequence
  chemically synthesized
ctgaaccaaagtcaatgatcta

SEQ ID NO: 41609 - DNA, 22 bp, Artificial Sequence
  chemically synthesized
tgaaccaaagtcaatgatctaa

SEQ ID NO: 41610 - DNA, 22 bp, Artificial Sequence
  chemically synthesized
aaccaaagtcaatgatctaagt

SEQ ID NO: 41611 - DNA, 22 bp, Artificial Sequence
  chemically synthesized
agtgcagtcaaaggctctgggg

SEQ ID NO: 41612 - DNA, 22 bp, Artificial Sequence
  chemically synthesized
tgggggaagaaagagagagtgc

SEQ ID NO: 41613 - DNA, 22 bp, Artificial Sequence
  chemically synthesized
ggggaagaaagagagagtgcct

SEQ ID NO: 41614 - DNA, 22 bp, Artificial Sequence
  chemically synthesized
atctcttgcctgtgccatgctc

SEQ ID NO: 41615 - DNA, 22 bp, Artificial Sequence
  chemically synthesized
ttgcctgtgccatgctcgcaaa

SEQ ID NO: 41616 - DNA, 22 bp, Artificial Sequence
  chemically synthesized
gcctgtgccatgctcgcaaagc

SEQ ID NO: 41617 - DNA, 22 bp, Artificial Sequence
  chemically synthesized
cctgtgccatgctcgcaaagca

SEQ ID NO: 41618 - DNA, 22 bp, Artificial Sequence
  chemically synthesized
tgccatgctcgcaaagcaagga

SEQ ID NO: 41619 - DNA, 22 bp, Artificial Sequence
  chemically synthesized
gcaaagcaaggatttttgcaaa

SEQ ID NO: 41620 - DNA, 22 bp, Artificial Sequence
  chemically synthesized
ttgcaaaattctaatgaaagct

SEQ ID NO: 41621 - DNA, 22 bp, Artificial Sequence
  chemically synthesized
tgcaaaattctaatgaaagctg

SEQ ID NO: 41622 - DNA, 22 bp, Artificial Sequence
  chemically synthesized
gcaaaattctaatgaaagctgg

SEQ ID NO: 41623 - DNA, 22 bp, Artificial Sequence
  chemically synthesized
caaaattctaatgaaagctggg

SEQ ID NO: 41624 - DNA, 22 bp, Artificial Sequence
  chemically synthesized
taatgaaagctgggcttgcaaa

SEQ ID NO: 41625 - DNA, 22 bp, Artificial Sequence
  chemically synthesized
atgaaagctgggcttgcaaaat

SEQ ID NO: 41626 - DNA, 22 bp, Artificial Sequence
  chemically synthesized
ggcttgcaaaattagaaaactg

SEQ ID NO: 41627 - DNA, 22 bp, Artificial Sequence
  chemically synthesized
gcaaaattagaaaactggatta

SEQ ID NO: 41628 - DNA, 22 bp, Artificial Sequence
  chemically synthesized
caaaattagaaaactggattat

SEQ ID NO: 41629 - DNA, 22 bp, Artificial Sequence
  chemically synthesized
gaaaactggattatttgtgaga

SEQ ID NO: 41630 - DNA, 22 bp, Artificial Sequence
  chemically synthesized
gattatttgtgagaacactgaa

SEQ ID NO: 41631 - DNA, 22 bp, Artificial Sequence
  chemically synthesized
tttgtgagaacactgaaacatc

SEQ ID NO: 41632 - DNA, 22 bp, Artificial Sequence
  chemically synthesized
gtgagaacactgaaacatccct

SEQ ID NO: 41633 - DNA, 22 bp, Artificial Sequence
  chemically synthesized
tgagaacactgaaacatccctg

SEQ ID NO: 41634 - DNA, 22 bp, Artificial Sequence
  chemically synthesized
aaacatccctgggtgtgtccat

SEQ ID NO: 41635 - DNA, 22 bp, Artificial Sequence
  chemically synthesized
ggtgtgtccatctggaaaaaca

SEQ ID NO: 41636 - DNA, 22 bp, Artificial Sequence
  chemically synthesized
gaaaaacagcatttcctctggc

SEQ ID NO: 41637 - DNA, 22 bp, Artificial Sequence
  chemically synthesized
cctctggcaattttgcaaccgt

SEQ ID NO: 41638 - DNA, 22 bp, Artificial Sequence
  chemically synthesized
ctctggcaattttgcaaccgtt

SEQ ID NO: 41639 - DNA, 22 bp, Artificial Sequence
  chemically synthesized
tggcaattttgcaaccgttcta

SEQ ID NO: 41640 - DNA, 22 bp, Artificial Sequence
  chemically synthesized
gcaattttgcaaccgttctatt

SEQ ID NO: 41641 - DNA, 22 bp, Artificial Sequence
  chemically synthesized
tgcaaccgttctatttgaattt

SEQ ID NO: 41642 - DNA, 22 bp, Artificial Sequence
  chemically synthesized
gcaaccgttctatttgaatttg

SEQ ID NO: 41643 - DNA, 22 bp, Artificial Sequence
  chemically synthesized
caaccgttctatttgaatttgg

SEQ ID NO: 41644 - DNA, 22 bp, Artificial Sequence
  chemically synthesized
tatttgaatttggcaaagaaaa

SEQ ID NO: 41645 - DNA, 22 bp, Artificial Sequence
  chemically synthesized
tttgaatttggcaaagaaaata

SEQ ID NO: 41646 - DNA, 22 bp, Artificial Sequence
  chemically synthesized
gaatttggcaaagaaaataaag

SEQ ID NO: 41647 - DNA, 22 bp, Artificial Sequence
  chemically synthesized
aatttggcaaagaaaataaagc

SEQ ID NO: 41648 - DNA, 22 bp, Artificial Sequence
  chemically synthesized
ggcaaagaaaataaagcagttt

SEQ ID NO: 41649 - DNA, 22 bp, Artificial Sequence
  chemically synthesized
gcaaagaaaataaagcagtttt

SEQ ID NO: 41650 - DNA, 22 bp, Artificial Sequence
  chemically synthesized
ttcacaaaagaataaacacaac

SEQ ID NO: 41651 - DNA, 22 bp, Artificial Sequence
  chemically synthesized
tcacaaaagaataaacacaacc

SEQ ID NO: 41652 - DNA, 22 bp, Artificial Sequence
  chemically synthesized
cacaaaagaataaacacaacca

SEQ ID NO: 41653 - DNA, 22 bp, Artificial Sequence
  chemically synthesized
acaaaagaataaacacaaccag

SEQ ID NO: 41654 - DNA, 22 bp, Artificial Sequence
  chemically synthesized
cactctcccaaattgtcaaaga

SEQ ID NO: 41655 - DNA, 22 bp, Artificial Sequence
  chemically synthesized
actctcccaaattgtcaaagaa

SEQ ID NO: 41656 - DNA, 22 bp, Artificial Sequence
  chemically synthesized
tcccaaattgtcaaagaagtat

SEQ ID NO: 41657 - DNA, 22 bp, Artificial Sequence
  chemically synthesized
ccaaattgtcaaagaagtataa

SEQ ID NO: 41658 - DNA, 22 bp, Artificial Sequence
  chemically synthesized
tcaaagaagtataaattagaaa

SEQ ID NO: 41659 - DNA, 22 bp, Artificial Sequence
  chemically synthesized
gaaaatgaatcaggacaatttc

SEQ ID NO: 41660 - DNA, 22 bp, Artificial Sequence
  chemically synthesized
caacctgttagattagctaata

SEQ ID NO: 41661 - DNA, 22 bp, Artificial Sequence
  chemically synthesized
aacctgttagattagctaatat

SEQ ID NO: 41662 - DNA, 22 bp, Artificial Sequence
  chemically synthesized
ttagattagctaatatttaaaa

SEQ ID NO: 41663 - DNA, 22 bp, Artificial Sequence
  chemically synthesized
gattagctaatatttaaaaatt

SEQ ID NO: 41664 - DNA, 22 bp, Artificial Sequence
  chemically synthesized
gctaatatttaaaaattgaaca

SEQ ID NO: 41665 - DNA, 22 bp, Artificial Sequence
  chemically synthesized
atatttaaaaattgaacactca

SEQ ID NO: 41666 - DNA, 22 bp, Artificial Sequence
  chemically synthesized
aaaaattgaacactcatacaag

SEQ ID NO: 41667 - DNA, 22 bp, Artificial Sequence
  chemically synthesized
aaaattgaacactcatacaagt

SEQ ID NO: 41668 - DNA, 22 bp, Artificial Sequence
  chemically synthesized
aacactcatacaagtgtggtga

SEQ ID NO: 41669 - DNA, 22 bp, Artificial Sequence
  chemically synthesized
atacaagtgtggtgaagtgatt

SEQ ID NO: 41670 - DNA, 22 bp, Artificial Sequence
  chemically synthesized
ttttctagtgacattttacact

SEQ ID NO: 41671 - DNA, 22 bp, Artificial Sequence
  chemically synthesized
tctagtgacattttacactgtc

SEQ ID NO: 41672 - DNA, 22 bp, Artificial Sequence
  chemically synthesized
ctagtgacattttacactgtca

SEQ ID NO: 41673 - DNA, 22 bp, Artificial Sequence
  chemically synthesized
tagtgacattttacactgtcat

SEQ ID NO: 41674 - DNA, 22 bp, Artificial Sequence
  chemically synthesized
gtgacattttacactgtcataa

SEQ ID NO: 41675 - DNA, 22 bp, Artificial Sequence
  chemically synthesized
tacactgtcataaccttctaga

SEQ ID NO: 41676 - DNA, 22 bp, Artificial Sequence
  chemically synthesized
acactgtcataaccttctagaa

SEQ ID NO: 41677 - DNA, 22 bp, Artificial Sequence
  chemically synthesized
cactgtcataaccttctagaaa

SEQ ID NO: 41678 - DNA, 22 bp, Artificial Sequence
  chemically synthesized
tcataaccttctagaaaataaa

SEQ ID NO: 41679 - DNA, 22 bp, Artificial Sequence
  chemically synthesized
ctagaaaataaattggcagtgt

SEQ ID NO: 41680 - DNA, 22 bp, Artificial Sequence
  chemically synthesized
tagaaaataaattggcagtgtt

SEQ ID NO: 41681 - DNA, 22 bp, Artificial Sequence
  chemically synthesized
gaaaataaattggcagtgttat

SEQ ID NO: 41682 - DNA, 22 bp, Artificial Sequence
  chemically synthesized
gcagtgttattgggagacagaa

SEQ ID NO: 41683 - DNA, 22 bp, Artificial Sequence
  chemically synthesized
ttgggagacagaaatatgtcta

SEQ ID NO: 41684 - DNA, 22 bp, Artificial Sequence
  chemically synthesized
ggagacagaaatatgtctatat

SEQ ID NO: 41685 - DNA, 22 bp, Artificial Sequence
  chemically synthesized
tataatttatgggaacttaggc

SEQ ID NO: 41686 - DNA, 22 bp, Artificial Sequence
  chemically synthesized
atgggaacttaggctcagaaaa

SEQ ID NO: 41687 - DNA, 22 bp, Artificial Sequence
  chemically synthesized
tgggaacttaggctcagaaaat

SEQ ID NO: 41688 - DNA, 22 bp, Artificial Sequence
  chemically synthesized
aggctcagaaaatattaaggaa

SEQ ID NO: 41689 - DNA, 22 bp, Artificial Sequence
  chemically synthesized
ggctcagaaaatattaaggaat

SEQ ID NO: 41690 - DNA, 22 bp, Artificial Sequence
  chemically synthesized
agaaaatattaaggaataagaa

SEQ ID NO: 41691 - DNA, 22 bp, Artificial Sequence
  chemically synthesized
aggaataagaatgaactttatg

SEQ ID NO: 41692 - DNA, 22 bp, Artificial Sequence
  chemically synthesized
tatgaacaaagatgtggagggt

SEQ ID NO: 41693 - DNA, 22 bp, Artificial Sequence
  chemically synthesized
atgaacaaagatgtggagggtt

SEQ ID NO: 41694 - DNA, 22 bp, Artificial Sequence
  chemically synthesized
tgaacaaagatgtggagggttg

SEQ ID NO: 41695 - DNA, 22 bp, Artificial Sequence
  chemically synthesized
gaagcaagaggggggccaacgc

SEQ ID NO: 41696 - DNA, 22 bp, Artificial Sequence
  chemically synthesized
gggcagtgactccgcagaccca

SEQ ID NO: 41697 - DNA, 22 bp, Artificial Sequence
  chemically synthesized
ggcagtgactccgcagacccag

SEQ ID NO: 41698 - DNA, 22 bp, Artificial Sequence
  chemically synthesized
cgcagacccaggctcaggttga

SEQ ID NO: 41699 - DNA, 22 bp, Artificial Sequence
  chemically synthesized
aggttgaactagacaacctcct

SEQ ID NO: 41700 - DNA, 22 bp, Artificial Sequence
  chemically synthesized
aactagacaacctccttacacc

SEQ ID NO: 41701 - DNA, 22 bp, Artificial Sequence
  chemically synthesized
gacaacctccttacacctcagt

SEQ ID NO: 41702 - DNA, 22 bp, Artificial Sequence
  chemically synthesized
cttacacctcagtttccttaac

SEQ ID NO: 41703 - DNA, 22 bp, Artificial Sequence
  chemically synthesized
acacctcagtttccttaactgt

SEQ ID NO: 41704 - DNA, 22 bp, Artificial Sequence
  chemically synthesized
cacctcagtttccttaactgta

SEQ ID NO: 41705 - DNA, 22 bp, Artificial Sequence
  chemically synthesized
agtttccttaactgtagagcag

SEQ ID NO: 41706 - DNA, 22 bp, Artificial Sequence
  chemically synthesized
ccttaactgtagagcaggagtg

SEQ ID NO: 41707 - DNA, 22 bp, Artificial Sequence
  chemically synthesized
cttaactgtagagcaggagtga

SEQ ID NO: 41708 - DNA, 22 bp, Artificial Sequence
  chemically synthesized
aactgtagagcaggagtgatgg

SEQ ID NO: 41709 - DNA, 22 bp, Artificial Sequence
  chemically synthesized
actgtagagcaggagtgatgga

SEQ ID NO: 41710 - DNA, 22 bp, Artificial Sequence
  chemically synthesized
tagagcaggagtgatggaactg

SEQ ID NO: 41711 - DNA, 22 bp, Artificial Sequence
  chemically synthesized
cctgtttcataggactgttgtg

SEQ ID NO: 41712 - DNA, 22 bp, Artificial Sequence
  chemically synthesized
tttcataggactgttgtgagga

SEQ ID NO: 41713 - DNA, 22 bp, Artificial Sequence
  chemically synthesized
cataggactgttgtgaggatga

SEQ ID NO: 41714 - DNA, 22 bp, Artificial Sequence
  chemically synthesized
ataggactgttgtgaggatgaa

SEQ ID NO: 41715 - DNA, 22 bp, Artificial Sequence
  chemically synthesized
ttgtgaggatgaagtgagatac

SEQ ID NO: 41716 - DNA, 22 bp, Artificial Sequence
  chemically synthesized
tgaggatgaagtgagatacacc

SEQ ID NO: 41717 - DNA, 22 bp, Artificial Sequence
  chemically synthesized
taagcttgtgcctggaaaggat

SEQ ID NO: 41718 - DNA, 22 bp, Artificial Sequence
  chemically synthesized
gtgcctggaaaggataatgctt

SEQ ID NO: 41719 - DNA, 22 bp, Artificial Sequence
  chemically synthesized
tgcctggaaaggataatgctta

SEQ ID NO: 41720 - DNA, 22 bp, Artificial Sequence
  chemically synthesized
gaaaggataatgcttagtaaat

SEQ ID NO: 41721 - DNA, 22 bp, Artificial Sequence
  chemically synthesized
agtaaatgatgactattctttt

SEQ ID NO: 41722 - DNA, 22 bp, Artificial Sequence
  chemically synthesized
gtaaatgatgactattcttttt

SEQ ID NO: 41723 - DNA, 22 bp, Artificial Sequence
  chemically synthesized
ttcttttttattgcaataaaat

SEQ ID NO: 41724 - DNA, 22 bp, Artificial Sequence
  chemically synthesized
ttttttattgcaataaaatgta

SEQ ID NO: 41725 - DNA, 22 bp, Artificial Sequence
  chemically synthesized
ttttattgcaataaaatgtaca

SEQ ID NO: 41726 - DNA, 22 bp, Artificial Sequence
  chemically synthesized
tttattgcaataaaatgtacac

SEQ ID NO: 41727 - DNA, 22 bp, Artificial Sequence
  chemically synthesized
ttattgcaataaaatgtacaca

SEQ ID NO: 41728 - DNA, 22 bp, Artificial Sequence
  chemically synthesized
tattgcaataaaatgtacacag

SEQ ID NO: 41729 - DNA, 22 bp, Artificial Sequence
  chemically synthesized
attgcaataaaatgtacacagc

SEQ ID NO: 41730 - DNA, 22 bp, Artificial Sequence
  chemically synthesized
ttgcaataaaatgtacacagcg

SEQ ID NO: 41731 - DNA, 22 bp, Artificial Sequence
  chemically synthesized
caataaaatgtacacagcgtaa

SEQ ID NO: 41732 - DNA, 22 bp, Artificial Sequence
  chemically synthesized
ctattttaaccatttttgcagg

SEQ ID NO: 41733 - DNA, 22 bp, Artificial Sequence
  chemically synthesized
ttttaaccatttttgcagggta

SEQ ID NO: 41734 - DNA, 22 bp, Artificial Sequence
  chemically synthesized
taaccatttttgcagggtacca

SEQ ID NO: 41735 - DNA, 22 bp, Artificial Sequence
  chemically synthesized
aaccatttttgcagggtaccac

SEQ ID NO: 41736 - DNA, 22 bp, Artificial Sequence
  chemically synthesized
accatttttgcagggtaccacc

SEQ ID NO: 41737 - DNA, 22 bp, Artificial Sequence
  chemically synthesized
ttgcagggtaccaccaagtggc

SEQ ID NO: 41738 - DNA, 22 bp, Artificial Sequence
  chemically synthesized
tgcagggtaccaccaagtggca

SEQ ID NO: 41739 - DNA, 22 bp, Artificial Sequence
  chemically synthesized
gcagggtaccaccaagtggcat

SEQ ID NO: 41740 - DNA, 22 bp, Artificial Sequence
  chemically synthesized
cagggtaccaccaagtggcatt

SEQ ID NO: 41741 - DNA, 22 bp, Artificial Sequence
  chemically synthesized
agtacattcacagtggtgtgca

SEQ ID NO: 41742 - DNA, 22 bp, Artificial Sequence
  chemically synthesized
gtacattcacagtggtgtgcaa

SEQ ID NO: 41743 - DNA, 22 bp, Artificial Sequence
  chemically synthesized
acagtggtgtgcaaccatcatc

SEQ ID NO: 41744 - DNA, 22 bp, Artificial Sequence
  chemically synthesized
ccagaatattttcctcatcccc

SEQ ID NO: 41745 - DNA, 22 bp, Artificial Sequence
  chemically synthesized
cagaatattttcctcatcccca

SEQ ID NO: 41746 - DNA, 22 bp, Artificial Sequence
  chemically synthesized
tcctcatccccaaaggaaacct

SEQ ID NO: 41747 - DNA, 22 bp, Artificial Sequence
  chemically synthesized
cctcatccccaaaggaaacctc

SEQ ID NO: 41748 - DNA, 22 bp, Artificial Sequence
  chemically synthesized
ctcatccccaaaggaaacctca

SEQ ID NO: 41749 - DNA, 22 bp, Artificial Sequence
  chemically synthesized
atccccaaaggaaacctcatgc

SEQ ID NO: 41750 - DNA, 22 bp, Artificial Sequence
  chemically synthesized
atgctcattaatcagtagctct

SEQ ID NO: 41751 - DNA, 22 bp, Artificial Sequence
  chemically synthesized
attaatcagtagctctccttta

SEQ ID NO: 41752 - DNA, 22 bp, Artificial Sequence
  chemically synthesized
atcagtagctctcctttaaaat

SEQ ID NO: 41753 - DNA, 22 bp, Artificial Sequence
  chemically synthesized
tcctttaaaatattagttatga

SEQ ID NO: 41754 - DNA, 22 bp, Artificial Sequence
  chemically synthesized
ctttaaaatattagttatgaag

SEQ ID NO: 41755 - DNA, 22 bp, Artificial Sequence
  chemically synthesized
taaaatattagttatgaagatc

SEQ ID NO: 41756 - DNA, 22 bp, Artificial Sequence
  chemically synthesized
aaaatattagttatgaagatca

SEQ ID NO: 41757 - DNA, 22 bp, Artificial Sequence
  chemically synthesized
aaatattagttatgaagatcat

SEQ ID NO: 41758 - DNA, 22 bp, Artificial Sequence
  chemically synthesized
gttatgaagatcatagcactat

SEQ ID NO: 41759 - DNA, 22 bp, Artificial Sequence
  chemically synthesized
tgaagatcatagcactatacaa

SEQ ID NO: 41760 - DNA, 22 bp, Artificial Sequence
  chemically synthesized
tacaaaactcattatgtaatgt

SEQ ID NO: 41761 - DNA, 22 bp, Artificial Sequence
  chemically synthesized
attatgtaatgttgagtgaaaa

SEQ ID NO: 41762 - DNA, 22 bp, Artificial Sequence
  chemically synthesized
tgtaatgttgagtgaaaaaatc

SEQ ID NO: 41763 - DNA, 22 bp, Artificial Sequence
  chemically synthesized
agtgaaaaaatcagggtgtgaa

SEQ ID NO: 41764 - DNA, 22 bp, Artificial Sequence
  chemically synthesized
tgtgatatgatgtaattagtga

SEQ ID NO: 41765 - DNA, 22 bp, Artificial Sequence
  chemically synthesized
gtgatatgatgtaattagtgaa

SEQ ID NO: 41766 - DNA, 22 bp, Artificial Sequence
  chemically synthesized
tgatatgatgtaattagtgaaa

SEQ ID NO: 41767 - DNA, 22 bp, Artificial Sequence
  chemically synthesized
gtgaaagaagcatacaaaaagt

SEQ ID NO: 41768 - DNA, 22 bp, Artificial Sequence
  chemically synthesized
aaaatataaaaacaatagcaat

SEQ ID NO: 41769 - DNA, 22 bp, Artificial Sequence
  chemically synthesized
catttctcagactctacattta

SEQ ID NO: 41770 - DNA, 22 bp, Artificial Sequence
  chemically synthesized
ctcagactctacatttaaacat

SEQ ID NO: 41771 - DNA, 22 bp, Artificial Sequence
  chemically synthesized
tcagactctacatttaaacatt

SEQ ID NO: 41772 - DNA, 22 bp, Artificial Sequence
  chemically synthesized
agactctacatttaaacattat

SEQ ID NO: 41773 - DNA, 22 bp, Artificial Sequence
  chemically synthesized
tacatttaaacattattcttta

SEQ ID NO: 41774 - DNA, 22 bp, Artificial Sequence
  chemically synthesized
catttaaacattattctttatg

SEQ ID NO: 41775 - DNA, 22 bp, Artificial Sequence
  chemically synthesized
aaacattattctttatggtttt

SEQ ID NO: 41776 - DNA, 22 bp, Artificial Sequence
  chemically synthesized
aacattattctttatggtttta

SEQ ID NO: 41777 - DNA, 22 bp, Artificial Sequence
  chemically synthesized
ttctttatggttttaaaagcaa

SEQ ID NO: 41778 - DNA, 22 bp, Artificial Sequence
  chemically synthesized
tttatggttttaaaagcaaaga

SEQ ID NO: 41779 - DNA, 22 bp, Artificial Sequence
  chemically synthesized
tatggttttaaaagcaaagaaa

SEQ ID NO: 41780 - DNA, 22 bp, Artificial Sequence
  chemically synthesized
atggttttaaaagcaaagaaaa

SEQ ID NO: 41781 - DNA, 22 bp, Artificial Sequence
  chemically synthesized
tggttttaaaagcaaagaaaaa

SEQ ID NO: 41782 - DNA, 22 bp, Artificial Sequence
  chemically synthesized
taaaagcaaagaaaaaggtaaa

SEQ ID NO: 41783 - DNA, 22 bp, Artificial Sequence
  chemically synthesized
aaaagcaaagaaaaaggtaaag

SEQ ID NO: 41784 - DNA, 22 bp, Artificial Sequence
  chemically synthesized
aaagcaaagaaaaaggtaaaga

SEQ ID NO: 41785 - DNA, 22 bp, Artificial Sequence
  chemically synthesized
agattgttaaatccaggttttt

SEQ ID NO: 41786 - DNA, 22 bp, Artificial Sequence
  chemically synthesized
ttaaatccaggtttttggaaca

SEQ ID NO: 41787 - DNA, 22 bp, Artificial Sequence
  chemically synthesized
aatccaggtttttggaacatag

SEQ ID NO: 41788 - DNA, 22 bp, Artificial Sequence
  chemically synthesized
ttggaacatagactcttatatg

SEQ ID NO: 41789 - DNA, 22 bp, Artificial Sequence
  chemically synthesized
tggaacatagactcttatatga

SEQ ID NO: 41790 - DNA, 22 bp, Artificial Sequence
  chemically synthesized
ggaacatagactcttatatgac

SEQ ID NO: 41791 - DNA, 22 bp, Artificial Sequence
  chemically synthesized
gaacatagactcttatatgacg

SEQ ID NO: 41792 - DNA, 22 bp, Artificial Sequence
  chemically synthesized
ttatatgacgtttacactctcc

SEQ ID NO: 41793 - DNA, 22 bp, Artificial Sequence
  chemically synthesized
atatgacgtttacactctccag

SEQ ID NO: 41794 - DNA, 22 bp, Artificial Sequence
  chemically synthesized
tatgacgtttacactctccagg

SEQ ID NO: 41795 - DNA, 22 bp, Artificial Sequence
  chemically synthesized
acactctccagggttcagagag

SEQ ID NO: 41796 - DNA, 22 bp, Artificial Sequence
  chemically synthesized
cactctccagggttcagagagt

SEQ ID NO: 41797 - DNA, 22 bp, Artificial Sequence
  chemically synthesized
tccagggttcagagagtctggc

SEQ ID NO: 41798 - DNA, 22 bp, Artificial Sequence
  chemically synthesized
cagggttcagagagtctggcag

SEQ ID NO: 41799 - DNA, 22 bp, Artificial Sequence
  chemically synthesized
agagagtctggcagcattggga

SEQ ID NO: 41800 - DNA, 22 bp, Artificial Sequence
  chemically synthesized
gcagcattgggagctgccttgt

SEQ ID NO: 41801 - DNA, 22 bp, Artificial Sequence
  chemically synthesized
ggagctgccttgtgttctacag

SEQ ID NO: 41802 - DNA, 22 bp, Artificial Sequence
  chemically synthesized
ccttgtgttctacagcctcacg

SEQ ID NO: 41803 - DNA, 22 bp, Artificial Sequence
  chemically synthesized
gtgttctacagcctcacggaca

SEQ ID NO: 41804 - DNA, 22 bp, Artificial Sequence
  chemically synthesized
tgttctacagcctcacggacag

SEQ ID NO: 41805 - DNA, 22 bp, Artificial Sequence
  chemically synthesized
tacagcctcacggacagacagg

SEQ ID NO: 41806 - DNA, 22 bp, Artificial Sequence
  chemically synthesized
cagcctcacggacagacaggag

SEQ ID NO: 41807 - DNA, 22 bp, Artificial Sequence
  chemically synthesized
acggacagacaggaggtccatc

SEQ ID NO: 41808 - DNA, 22 bp, Artificial Sequence
  chemically synthesized
ctctgttcttctggagtttcct

SEQ ID NO: 41809 - DNA, 22 bp, Artificial Sequence
  chemically synthesized
tgttcttctggagtttccttgt

SEQ ID NO: 41810 - DNA, 22 bp, Artificial Sequence
  chemically synthesized
ttcttctggagtttccttgtga

SEQ ID NO: 41811 - DNA, 22 bp, Artificial Sequence
  chemically synthesized
ttctggagtttccttgtgaaca

SEQ ID NO: 41812 - DNA, 22 bp, Artificial Sequence
  chemically synthesized
ctggagtttccttgtgaacatg

SEQ ID NO: 41813 - DNA, 22 bp, Artificial Sequence
  chemically synthesized
tggagtttccttgtgaacatgt

SEQ ID NO: 41814 - DNA, 22 bp, Artificial Sequence
  chemically synthesized
gagtttccttgtgaacatgttg

SEQ ID NO: 41815 - DNA, 22 bp, Artificial Sequence
  chemically synthesized
ccttgtgaacatgttgtggacg

SEQ ID NO: 41816 - DNA, 22 bp, Artificial Sequence
  chemically synthesized
cttgtgaacatgttgtggacgt

SEQ ID NO: 41817 - DNA, 22 bp, Artificial Sequence
  chemically synthesized
gtgaacatgttgtggacgtagt

SEQ ID NO: 41818 - DNA, 22 bp, Artificial Sequence
  chemically synthesized
tgaacatgttgtggacgtagtt

SEQ ID NO: 41819 - DNA, 22 bp, Artificial Sequence
  chemically synthesized
tggacgtagttaccatttcttt

SEQ ID NO: 41820 - DNA, 22 bp, Artificial Sequence
  chemically synthesized
ccatttctttcatctttttaaa

SEQ ID NO: 41821 - DNA, 22 bp, Artificial Sequence
  chemically synthesized
ctttcatctttttaaacacagg

SEQ ID NO: 41822 - DNA, 22 bp, Artificial Sequence
  chemically synthesized
tttcatctttttaaacacaggt

SEQ ID NO: 41823 - DNA, 22 bp, Artificial Sequence
  chemically synthesized
tcatctttttaaacacaggtac

SEQ ID NO: 41824 - DNA, 22 bp, Artificial Sequence
  chemically synthesized
catctttttaaacacaggtacc

SEQ ID NO: 41825 - DNA, 22 bp, Artificial Sequence
  chemically synthesized
atctttttaaacacaggtacct

SEQ ID NO: 41826 - DNA, 22 bp, Artificial Sequence
  chemically synthesized
tttaaacacaggtacctttggg

SEQ ID NO: 41827 - DNA, 22 bp, Artificial Sequence
  chemically synthesized
ttaaacacaggtacctttgggg

SEQ ID NO: 41828 - DNA, 22 bp, Artificial Sequence
  chemically synthesized
taaacacaggtacctttggggc

SEQ ID NO: 41829 - DNA, 22 bp, Artificial Sequence
  chemically synthesized
aaacacaggtacctttggggct

SEQ ID NO: 41830 - DNA, 22 bp, Artificial Sequence
  chemically synthesized
aacacaggtacctttggggctg

SEQ ID NO: 41831 - DNA, 22 bp, Artificial Sequence
  chemically synthesized
tggggctggctttctcaaggaa

SEQ ID NO: 41832 - DNA, 22 bp, Artificial Sequence
  chemically synthesized
ggggctggctttctcaaggaag

SEQ ID NO: 41833 - DNA, 22 bp, Artificial Sequence
  chemically synthesized
gggctggctttctcaaggaagc

SEQ ID NO: 41834 - DNA, 22 bp, Artificial Sequence
  chemically synthesized
gctttctcaaggaagcccagct

SEQ ID NO: 41835 - DNA, 22 bp, Artificial Sequence
  chemically synthesized
tctcaaggaagcccagctccct

SEQ ID NO: 41836 - DNA, 22 bp, Artificial Sequence
  chemically synthesized
ctcaaggaagcccagctccctg

SEQ ID NO: 41837 - DNA, 22 bp, Artificial Sequence
  chemically synthesized
tcaaggaagcccagctccctgt

SEQ ID NO: 41838 - DNA, 22 bp, Artificial Sequence
  chemically synthesized
aaggaagcccagctccctgtga

SEQ ID NO: 41839 - DNA, 22 bp, Artificial Sequence
  chemically synthesized
cctgtgattgagaatgaagtgt

SEQ ID NO: 41840 - DNA, 22 bp, Artificial Sequence
  chemically synthesized
tgattgagaatgaagtgtgcaa

SEQ ID NO: 41841 - DNA, 22 bp, Artificial Sequence
  chemically synthesized
agaatgaagtgtgcaatcgcta

SEQ ID NO: 41842 - DNA, 22 bp, Artificial Sequence
  chemically synthesized
tgagtttctgaatggaagagtc

SEQ ID NO: 41843 - DNA, 22 bp, Artificial Sequence
  chemically synthesized
ctgaatggaagagtcaaatcca

SEQ ID NO: 41844 - DNA, 22 bp, Artificial Sequence
  chemically synthesized
tgaatggaagagtcaaatccac

SEQ ID NO: 41845 - DNA, 22 bp, Artificial Sequence
  chemically synthesized
aatggaagagtcaaatccactg

SEQ ID NO: 41846 - DNA, 22 bp, Artificial Sequence
  chemically synthesized
agctctgtgctgggcatttggc

SEQ ID NO: 41847 - DNA, 22 bp, Artificial Sequence
  chemically synthesized
tgtgctgggcatttggctggag

SEQ ID NO: 41848 - DNA, 22 bp, Artificial Sequence
  chemically synthesized
tgctgggcatttggctggaggc

SEQ ID NO: 41849 - DNA, 22 bp, Artificial Sequence
  chemically synthesized
ggcatttggctggaggcattga

SEQ ID NO: 41850 - DNA, 22 bp, Artificial Sequence
  chemically synthesized
ggctggaggcattgacagttgc

SEQ ID NO: 41851 - DNA, 22 bp, Artificial Sequence
  chemically synthesized
gctggaggcattgacagttgca

SEQ ID NO: 41852 - DNA, 22 bp, Artificial Sequence
  chemically synthesized
gaggcattgacagttgcaaggt

SEQ ID NO: 41853 - DNA, 22 bp, Artificial Sequence
  chemically synthesized
acagttgcaaggtaagaaaaga

SEQ ID NO: 41854 - DNA, 22 bp, Artificial Sequence
  chemically synthesized
caaggtaagaaaagatcaagag

SEQ ID NO: 41855 - DNA, 22 bp, Artificial Sequence
  chemically synthesized
gtcttgtgctctcctgtctcag

SEQ ID NO: 41856 - DNA, 22 bp, Artificial Sequence
  chemically synthesized
gtgctctcctgtctcagtctca

SEQ ID NO: 41857 - DNA, 22 bp, Artificial Sequence
  chemically synthesized
tgctctcctgtctcagtctcag

SEQ ID NO: 41858 - DNA, 22 bp, Artificial Sequence
  chemically synthesized
tcctgtctcagtctcagtccct

SEQ ID NO: 41859 - DNA, 22 bp, Artificial Sequence
  chemically synthesized
ctgtctcagtctcagtccctta

SEQ ID NO: 41860 - DNA, 22 bp, Artificial Sequence
  chemically synthesized
tctcagtctcagtcccttagac

SEQ ID NO: 41861 - DNA, 22 bp, Artificial Sequence
  chemically synthesized
agtctcagtcccttagacttga

SEQ ID NO: 41862 - DNA, 22 bp, Artificial Sequence
  chemically synthesized
agtcccttagacttgagtccca

SEQ ID NO: 41863 - DNA, 22 bp, Artificial Sequence
  chemically synthesized
agacttgagtcccaaagtagcg

SEQ ID NO: 41864 - DNA, 22 bp, Artificial Sequence
  chemically synthesized
gacttgagtcccaaagtagcga

SEQ ID NO: 41865 - DNA, 22 bp, Artificial Sequence
  chemically synthesized
gagtcccaaagtagcgaattca

SEQ ID NO: 41866 - DNA, 22 bp, Artificial Sequence
  chemically synthesized
agtcccaaagtagcgaattcaa

SEQ ID NO: 41867 - DNA, 22 bp, Artificial Sequence
  chemically synthesized
aagtaggatttaatcaatggaa

SEQ ID NO: 41868 - DNA, 22 bp, Artificial Sequence
  chemically synthesized
aatcaatggaagaccccagtct

SEQ ID NO: 41869 - DNA, 22 bp, Artificial Sequence
  chemically synthesized
atcaatggaagaccccagtcta

SEQ ID NO: 41870 - DNA, 22 bp, Artificial Sequence
  chemically synthesized
agtgttgctcagaaactcccta

SEQ ID NO: 41871 - DNA, 22 bp, Artificial Sequence
  chemically synthesized
ctcagaaactccctagatctgt

SEQ ID NO: 41872 - DNA, 22 bp, Artificial Sequence
  chemically synthesized
agaaactccctagatctgtccc

SEQ ID NO: 41873 - DNA, 22 bp, Artificial Sequence
  chemically synthesized
cctagatctgtcccaaatgtat

SEQ ID NO: 41874 - DNA, 22 bp, Artificial Sequence
  chemically synthesized
gatctgtcccaaatgtatattc

SEQ ID NO: 41875 - DNA, 22 bp, Artificial Sequence
  chemically synthesized
tcccaaatgtatattcagatca

SEQ ID NO: 41876 - DNA, 22 bp, Artificial Sequence
  chemically synthesized
agatcatccaaggggacttctt

SEQ ID NO: 41877 - DNA, 22 bp, Artificial Sequence
  chemically synthesized
cttggggcttgagttccagatc

SEQ ID NO: 41878 - DNA, 22 bp, Artificial Sequence
  chemically synthesized
ttggggcttgagttccagatca

SEQ ID NO: 41879 - DNA, 22 bp, Artificial Sequence
  chemically synthesized
ggggcttgagttccagatcagc

SEQ ID NO: 41880 - DNA, 22 bp, Artificial Sequence
  chemically synthesized
gggcttgagttccagatcagca

SEQ ID NO: 41881 - DNA, 22 bp, Artificial Sequence
  chemically synthesized
gagttccagatcagcagcaagg

SEQ ID NO: 41882 - DNA, 22 bp, Artificial Sequence
  chemically synthesized
agttccagatcagcagcaaggg

SEQ ID NO: 41883 - DNA, 22 bp, Artificial Sequence
  chemically synthesized
cagatcagcagcaagggagcca

SEQ ID NO: 41884 - DNA, 22 bp, Artificial Sequence
  chemically synthesized
cctcagaccactcaccctcctg

SEQ ID NO: 41885 - DNA, 22 bp, Artificial Sequence
  chemically synthesized
agaccactcaccctcctggggt

SEQ ID NO: 41886 - DNA, 22 bp, Artificial Sequence
  chemically synthesized
accctcctggggtgtcccggtg

SEQ ID NO: 41887 - DNA, 22 bp, Artificial Sequence
  chemically synthesized
ctggggtgtcccggtggccagg

SEQ ID NO: 41888 - DNA, 22 bp, Artificial Sequence
  chemically synthesized
gggtgtcccggtggccagggac

SEQ ID NO: 41889 - DNA, 22 bp, Artificial Sequence
  chemically synthesized
aagtggtgatttttctggtagg

SEQ ID NO: 41890 - DNA, 22 bp, Artificial Sequence
  chemically synthesized
ttctggtagggaaggaggtaga

SEQ ID NO: 41891 - DNA, 22 bp, Artificial Sequence
  chemically synthesized
tctggtagggaaggaggtagag

SEQ ID NO: 41892 - DNA, 22 bp, Artificial Sequence
  chemically synthesized
ctggtagggaaggaggtagagg

SEQ ID NO: 41893 - DNA, 22 bp, Artificial Sequence
  chemically synthesized
tggtagggaaggaggtagaggg

SEQ ID NO: 41894 - DNA, 22 bp, Artificial Sequence
  chemically synthesized
gtagggaaggaggtagagggta

SEQ ID NO: 41895 - DNA, 22 bp, Artificial Sequence
  chemically synthesized
actgcacacaatatctgagact

SEQ ID NO: 41896 - DNA, 22 bp, Artificial Sequence
  chemically synthesized
cacacaatatctgagactggag

SEQ ID NO: 41897 - DNA, 22 bp, Artificial Sequence
  chemically synthesized
agactggagctcagatattgct

SEQ ID NO: 41898 - DNA, 22 bp, Artificial Sequence
  chemically synthesized
gagctcagatattgctgatgat

SEQ ID NO: 41899 - DNA, 22 bp, Artificial Sequence
  chemically synthesized
agatattgctgatgatcagagt

SEQ ID NO: 41900 - DNA, 22 bp, Artificial Sequence
  chemically synthesized
ctgatgatcagagttggcgtgt

SEQ ID NO: 41901 - DNA, 22 bp, Artificial Sequence
  chemically synthesized
atgatcagagttggcgtgtctc

SEQ ID NO: 41902 - DNA, 22 bp, Artificial Sequence
  chemically synthesized
gcgtgtctccccaattgattta

SEQ ID NO: 41903 - DNA, 22 bp, Artificial Sequence
  chemically synthesized
cccaattgatttacaactgggg

SEQ ID NO: 41904 - DNA, 22 bp, Artificial Sequence
  chemically synthesized
atttacaactggggcttggata

SEQ ID NO: 41905 - DNA, 22 bp, Artificial Sequence
  chemically synthesized
acaactggggcttggatactgt

SEQ ID NO: 41906 - DNA, 22 bp, Artificial Sequence
  chemically synthesized
caactggggcttggatactgtt

SEQ ID NO: 41907 - DNA, 22 bp, Artificial Sequence
  chemically synthesized
gggcttggatactgttttaaac

SEQ ID NO: 41908 - DNA, 22 bp, Artificial Sequence
  chemically synthesized
ggatactgttttaaacgggagg

SEQ ID NO: 41909 - DNA, 22 bp, Artificial Sequence
  chemically synthesized
gatactgttttaaacgggagga

SEQ ID NO: 41910 - DNA, 22 bp, Artificial Sequence
  chemically synthesized
ttttaaacgggaggagcctcct

SEQ ID NO: 41911 - DNA, 22 bp, Artificial Sequence
  chemically synthesized
taaacgggaggagcctcctaac

SEQ ID NO: 41912 - DNA, 22 bp, Artificial Sequence
  chemically synthesized
aaacgggaggagcctcctaacc

SEQ ID NO: 41913 - DNA, 22 bp, Artificial Sequence
  chemically synthesized
aacgggaggagcctcctaacca

SEQ ID NO: 41914 - DNA, 22 bp, Artificial Sequence
  chemically synthesized
ctaaccatcttgacacaaccac

SEQ ID NO: 41915 - DNA, 22 bp, Artificial Sequence
  chemically synthesized
accatcttgacacaaccactga

SEQ ID NO: 41916 - DNA, 22 bp, Artificial Sequence
  chemically synthesized
gacacaaccactgacgtgacta

SEQ ID NO: 41917 - DNA, 22 bp, Artificial Sequence
  chemically synthesized
acacaaccactgacgtgactac

SEQ ID NO: 41918 - DNA, 22 bp, Artificial Sequence
  chemically synthesized
acgtgactacactagagataga

SEQ ID NO: 41919 - DNA, 22 bp, Artificial Sequence
  chemically synthesized
cactagagatagactctttcca

SEQ ID NO: 41920 - DNA, 22 bp, Artificial Sequence
  chemically synthesized
gagatagactctttccacttaa

SEQ ID NO: 41921 - DNA, 22 bp, Artificial Sequence
  chemically synthesized
tttccacttaattctaccactc

SEQ ID NO: 41922 - DNA, 22 bp, Artificial Sequence
  chemically synthesized
tccacttaattctaccactctt

SEQ ID NO: 41923 - DNA, 22 bp, Artificial Sequence
  chemically synthesized
ccacttaattctaccactcttg

SEQ ID NO: 41924 - DNA, 22 bp, Artificial Sequence
  chemically synthesized
cacttaattctaccactcttgc

SEQ ID NO: 41925 - DNA, 22 bp, Artificial Sequence
  chemically synthesized
aattctaccactcttgctttac

SEQ ID NO: 41926 - DNA, 22 bp, Artificial Sequence
  chemically synthesized
attctaccactcttgctttact

SEQ ID NO: 41927 - DNA, 22 bp, Artificial Sequence
  chemically synthesized
taccactcttgctttacttcat

SEQ ID NO: 41928 - DNA, 22 bp, Artificial Sequence
  chemically synthesized
ccactcttgctttacttcatga

SEQ ID NO: 41929 - DNA, 22 bp, Artificial Sequence
  chemically synthesized
ttgctttacttcatgagaacga

SEQ ID NO: 41930 - DNA, 22 bp, Artificial Sequence
  chemically synthesized
gctttacttcatgagaacgaaa

SEQ ID NO: 41931 - DNA, 22 bp, Artificial Sequence
  chemically synthesized
ctttacttcatgagaacgaaaa

SEQ ID NO: 41932 - DNA, 22 bp, Artificial Sequence
  chemically synthesized
tacttcatgagaacgaaaatgt

SEQ ID NO: 41933 - DNA, 22 bp, Artificial Sequence
  chemically synthesized
acttcatgagaacgaaaatgta

SEQ ID NO: 41934 - DNA, 22 bp, Artificial Sequence
  chemically synthesized
cttcatgagaacgaaaatgtaa

SEQ ID NO: 41935 - DNA, 22 bp, Artificial Sequence
  chemically synthesized
catgagaacgaaaatgtaagat

SEQ ID NO: 41936 - DNA, 22 bp, Artificial Sequence
  chemically synthesized
atgagaacgaaaatgtaagatt

SEQ ID NO: 41937 - DNA, 22 bp, Artificial Sequence
  chemically synthesized
caccatgaattcatttgcggaa

SEQ ID NO: 41938 - DNA, 22 bp, Artificial Sequence
  chemically synthesized
atttgcggaaagattgatacta

SEQ ID NO: 41939 - DNA, 22 bp, Artificial Sequence
  chemically synthesized
gcggaaagattgatactatgct

SEQ ID NO: 41940 - DNA, 22 bp, Artificial Sequence
  chemically synthesized
cggaaagattgatactatgctt

SEQ ID NO: 41941 - DNA, 22 bp, Artificial Sequence
  chemically synthesized
atactatgcttttattttattt

SEQ ID NO: 41942 - DNA, 22 bp, Artificial Sequence
  chemically synthesized
tgcttttattttattttatttt

SEQ ID NO: 41943 - DNA, 22 bp, Artificial Sequence
  chemically synthesized
ttattttattttattttatttt

SEQ ID NO: 41944 - DNA, 22 bp, Artificial Sequence
  chemically synthesized
tattttattttattttatttta

SEQ ID NO: 41945 - DNA, 22 bp, Artificial Sequence
  chemically synthesized
attttattttattttattttat

SEQ ID NO: 41946 - DNA, 22 bp, Artificial Sequence
  chemically synthesized
ttttattttattttattttatt

SEQ ID NO: 41947 - DNA, 22 bp, Artificial Sequence
  chemically synthesized
tattttattttattttatttta

SEQ ID NO: 41948 - DNA, 22 bp, Artificial Sequence
  chemically synthesized
attttattttattttattttat

SEQ ID NO: 41949 - DNA, 22 bp, Artificial Sequence
  chemically synthesized
ttttattttattttattttatt

SEQ ID NO: 41950 - DNA, 22 bp, Artificial Sequence
  chemically synthesized
tattttattttattttatttta

SEQ ID NO: 41951 - DNA, 22 bp, Artificial Sequence
  chemically synthesized
attttattttattttattttat

SEQ ID NO: 41952 - DNA, 22 bp, Artificial Sequence
  chemically synthesized
ttttattttattttattttatt

SEQ ID NO: 41953 - DNA, 22 bp, Artificial Sequence
  chemically synthesized
tattttattttattttatttta

SEQ ID NO: 41954 - DNA, 22 bp, Artificial Sequence
  chemically synthesized
attttattttattttattttat

SEQ ID NO: 41955 - DNA, 22 bp, Artificial Sequence
  chemically synthesized
ttttattttattttattttatt

SEQ ID NO: 41956 - DNA, 22 bp, Artificial Sequence
  chemically synthesized
tattttattttattttatttta

SEQ ID NO: 41957 - DNA, 22 bp, Artificial Sequence
  chemically synthesized
attttattttattttattttat

SEQ ID NO: 41958 - DNA, 22 bp, Artificial Sequence
  chemically synthesized
ttttattttattttattttatt

SEQ ID NO: 41959 - DNA, 22 bp, Artificial Sequence
  chemically synthesized
tattttattttattttattgag

SEQ ID NO: 41960 - DNA, 22 bp, Artificial Sequence
  chemically synthesized
attttattttattttattgaga

SEQ ID NO: 41961 - DNA, 22 bp, Artificial Sequence
  chemically synthesized
ttttattttattttattgagac

SEQ ID NO: 41962 - DNA, 22 bp, Artificial Sequence
  chemically synthesized
tattttattttattgagactct

SEQ ID NO: 41963 - DNA, 22 bp, Artificial Sequence
  chemically synthesized
attttattttattgagactctc

SEQ ID NO: 41964 - DNA, 22 bp, Artificial Sequence
  chemically synthesized
ttttattttattgagactctca

SEQ ID NO: 41965 - DNA, 22 bp, Artificial Sequence
  chemically synthesized
tattttattgagactctcaccc

SEQ ID NO: 41966 - DNA, 22 bp, Artificial Sequence
  chemically synthesized
attttattgagactctcacccc

SEQ ID NO: 41967 - DNA, 22 bp, Artificial Sequence
  chemically synthesized
ttttattgagactctcaccccg

SEQ ID NO: 41968 - DNA, 22 bp, Artificial Sequence
  chemically synthesized
tattgagactctcaccccggtt

SEQ ID NO: 41969 - DNA, 22 bp, Artificial Sequence
  chemically synthesized
attgagactctcaccccggttg

SEQ ID NO: 41970 - DNA, 22 bp, Artificial Sequence
  chemically synthesized
ttgagactctcaccccggttga

SEQ ID NO: 41971 - DNA, 22 bp, Artificial Sequence
  chemically synthesized
agactctcaccccggttgaagt

SEQ ID NO: 41972 - DNA, 22 bp, Artificial Sequence
  chemically synthesized
tcaccccggttgaagtgcactg

SEQ ID NO: 41973 - DNA, 22 bp, Artificial Sequence
  chemically synthesized
accccggttgaagtgcactgac

SEQ ID NO: 41974 - DNA, 22 bp, Artificial Sequence
  chemically synthesized
aagtgcactgacgtgattttgg

SEQ ID NO: 41975 - DNA, 22 bp, Artificial Sequence
  chemically synthesized
acgtgattttggctcactgcaa

SEQ ID NO: 41976 - DNA, 22 bp, Artificial Sequence
  chemically synthesized
tggctcactgcaacttccacct

SEQ ID NO: 41977 - DNA, 22 bp, Artificial Sequence
  chemically synthesized
ggctcactgcaacttccacctc

SEQ ID NO: 41978 - DNA, 22 bp, Artificial Sequence
  chemically synthesized
gctcactgcaacttccacctcc

SEQ ID NO: 41979 - DNA, 22 bp, Artificial Sequence
  chemically synthesized
actgcaacttccacctcctggg

SEQ ID NO: 41980 - DNA, 22 bp, Artificial Sequence
  chemically synthesized
caacttccacctcctgggttca

SEQ ID NO: 41981 - DNA, 22 bp, Artificial Sequence
  chemically synthesized
ccacctcctgggttcaagtgaa

SEQ ID NO: 41982 - DNA, 22 bp, Artificial Sequence
  chemically synthesized
cacctcctgggttcaagtgaat

SEQ ID NO: 41983 - DNA, 22 bp, Artificial Sequence
  chemically synthesized
ctgggttcaagtgaatactcca

SEQ ID NO: 41984 - DNA, 22 bp, Artificial Sequence
  chemically synthesized
ggttcaagtgaatactccagcc

SEQ ID NO: 41985 - DNA, 22 bp, Artificial Sequence
  chemically synthesized
aagtgaatactccagcctccct

SEQ ID NO: 41986 - DNA, 22 bp, Artificial Sequence
  chemically synthesized
cagcctccctagtagctgggat

SEQ ID NO: 41987 - DNA, 22 bp, Artificial Sequence
  chemically synthesized
cctagtagctgggattacaggt

SEQ ID NO: 41988 - DNA, 22 bp, Artificial Sequence
  chemically synthesized
gtagctgggattacaggtgccc

SEQ ID NO: 41989 - DNA, 22 bp, Artificial Sequence
  chemically synthesized
ggattacaggtgcccaccacca

SEQ ID NO: 41990 - DNA, 22 bp, Artificial Sequence
  chemically synthesized
caggtgcccaccaccacgcctg

SEQ ID NO: 41991 - DNA, 22 bp, Artificial Sequence
  chemically synthesized
gctaatttttgtatttttagta

SEQ ID NO: 41992 - DNA, 22 bp, Artificial Sequence
  chemically synthesized
atttttgtatttttagtagaga

SEQ ID NO: 41993 - DNA, 22 bp, Artificial Sequence
  chemically synthesized
ttgtatttttagtagagatggg

SEQ ID NO: 41994 - DNA, 22 bp, Artificial Sequence
  chemically synthesized
tgtatttttagtagagatgggg

SEQ ID NO: 41995 - DNA, 22 bp, Artificial Sequence
  chemically synthesized
gtatttttagtagagatggggt

SEQ ID NO: 41996 - DNA, 22 bp, Artificial Sequence
  chemically synthesized
tatttttagtagagatggggtt

SEQ ID NO: 41997 - DNA, 22 bp, Artificial Sequence
  chemically synthesized
ttagtagagatggggtttcacc

SEQ ID NO: 41998 - DNA, 22 bp, Artificial Sequence
  chemically synthesized
tagtagagatggggtttcacca

SEQ ID NO: 41999 - DNA, 22 bp, Artificial Sequence
  chemically synthesized
agtagagatggggtttcaccac

SEQ ID NO: 42000 - DNA, 22 bp, Artificial Sequence
  chemically synthesized
gtagagatggggtttcaccaca

SEQ ID NO: 42001 - DNA, 22 bp, Artificial Sequence
  chemically synthesized
caccacattggcctggctggtc

SEQ ID NO: 42002 - DNA, 22 bp, Artificial Sequence
  chemically synthesized
accacattggcctggctggtct

SEQ ID NO: 42003 - DNA, 22 bp, Artificial Sequence
  chemically synthesized
gcctggctggtctcaaactcct

SEQ ID NO: 42004 - DNA, 22 bp, Artificial Sequence
  chemically synthesized
gctggtctcaaactcctgacct

SEQ ID NO: 42005 - DNA, 22 bp, Artificial Sequence
  chemically synthesized
gtctcaaactcctgaccttgtg

SEQ ID NO: 42006 - DNA, 22 bp, Artificial Sequence
  chemically synthesized
aaactcctgaccttgtgatcca

SEQ ID NO: 42007 - DNA, 22 bp, Artificial Sequence
  chemically synthesized
ctgaccttgtgatccacctgtc

SEQ ID NO: 42008 - DNA, 22 bp, Artificial Sequence
  chemically synthesized
accttgtgatccacctgtcttg

SEQ ID NO: 42009 - DNA, 22 bp, Artificial Sequence
  chemically synthesized
gtgatccacctgtcttggcctc

SEQ ID NO: 42010 - DNA, 22 bp, Artificial Sequence
  chemically synthesized
tgatccacctgtcttggcctcc

SEQ ID NO: 42011 - DNA, 22 bp, Artificial Sequence
  chemically synthesized
tcttggcctcccaaagtgctgg

SEQ ID NO: 42012 - DNA, 22 bp, Artificial Sequence
  chemically synthesized
ggcctcccaaagtgctgggatt

SEQ ID NO: 42013 - DNA, 22 bp, Artificial Sequence
  chemically synthesized
gcctcccaaagtgctgggatta

SEQ ID NO: 42014 - DNA, 22 bp, Artificial Sequence
  chemically synthesized
ccaaagtgctgggattacagag

SEQ ID NO: 42015 - DNA, 22 bp, Artificial Sequence
  chemically synthesized
ggattacagagttgagccaccg

SEQ ID NO: 42016 - DNA, 22 bp, Artificial Sequence
  chemically synthesized
cagagttgagccaccgcactcg

SEQ ID NO: 42017 - DNA, 22 bp, Artificial Sequence
  chemically synthesized
agccaccgcactcgaccctatg

SEQ ID NO: 42018 - DNA, 22 bp, Artificial Sequence
  chemically synthesized
gaccctatgttttatttttaaa

SEQ ID NO: 42019 - DNA, 22 bp, Artificial Sequence
  chemically synthesized
tgttttatttttaaaaatattt

SEQ ID NO: 42020 - DNA, 22 bp, Artificial Sequence
  chemically synthesized
tatttttaaaaatatttattta

SEQ ID NO: 42021 - DNA, 22 bp, Artificial Sequence
  chemically synthesized
atttttaaaaatatttatttat

SEQ ID NO: 42022 - DNA, 22 bp, Artificial Sequence
  chemically synthesized
tttttaaaaatatttatttatt

SEQ ID NO: 42023 - DNA, 22 bp, Artificial Sequence
  chemically synthesized
ttaaaaatatttatttatttat

SEQ ID NO: 42024 - DNA, 22 bp, Artificial Sequence
  chemically synthesized
taaaaatatttatttatttatt

SEQ ID NO: 42025 - DNA, 22 bp, Artificial Sequence
  chemically synthesized
aaaaatatttatttatttattt

SEQ ID NO: 42026 - DNA, 22 bp, Artificial Sequence
  chemically synthesized
aaaatatttatttatttattta

SEQ ID NO: 42027 - DNA, 22 bp, Artificial Sequence
  chemically synthesized
atttatttatttaagccacaac

SEQ ID NO: 42028 - DNA, 22 bp, Artificial Sequence
  chemically synthesized
tttatttatttaagccacaact

SEQ ID NO: 42029 - DNA, 22 bp, Artificial Sequence
  chemically synthesized
atttatttaagccacaactact

SEQ ID NO: 42030 - DNA, 22 bp, Artificial Sequence
  chemically synthesized
tttatttaagccacaactacta

SEQ ID NO: 42031 - DNA, 22 bp, Artificial Sequence
  chemically synthesized
atttaagccacaactactagaa

SEQ ID NO: 42032 - DNA, 22 bp, Artificial Sequence
  chemically synthesized
tttaagccacaactactagaat

SEQ ID NO: 42033 - DNA, 22 bp, Artificial Sequence
  chemically synthesized
aagccacaactactagaatagg

SEQ ID NO: 42034 - DNA, 22 bp, Artificial Sequence
  chemically synthesized
agccacaactactagaatagga

SEQ ID NO: 42035 - DNA, 22 bp, Artificial Sequence
  chemically synthesized
ctagaataggaaggattgatat

SEQ ID NO: 42036 - DNA, 22 bp, Artificial Sequence
  chemically synthesized
gaataggaaggattgatatttt

SEQ ID NO: 42037 - DNA, 22 bp, Artificial Sequence
  chemically synthesized
atattttattaattttatttgg

SEQ ID NO: 42038 - DNA, 22 bp, Artificial Sequence
  chemically synthesized
tattaattttatttggtattta

SEQ ID NO: 42039 - DNA, 22 bp, Artificial Sequence
  chemically synthesized
attaattttatttggtatttat

SEQ ID NO: 42040 - DNA, 22 bp, Artificial Sequence
  chemically synthesized
ttaattttatttggtatttatt

SEQ ID NO: 42041 - DNA, 22 bp, Artificial Sequence
  chemically synthesized
attttatttggtatttattatt

SEQ ID NO: 42042 - DNA, 22 bp, Artificial Sequence
  chemically synthesized
tatttggtatttattatttttt

SEQ ID NO: 42043 - DNA, 22 bp, Artificial Sequence
  chemically synthesized
atttggtatttattattttttt

SEQ ID NO: 42044 - DNA, 22 bp, Artificial Sequence
  chemically synthesized
tttggtatttattatttttttt

SEQ ID NO: 42045 - DNA, 22 bp, Artificial Sequence
  chemically synthesized
ggtatttattatttttttttct

SEQ ID NO: 42046 - DNA, 22 bp, Artificial Sequence
  chemically synthesized
gtatttattatttttttttctt

SEQ ID NO: 42047 - DNA, 22 bp, Artificial Sequence
  chemically synthesized
attatttttttttctttcctga

SEQ ID NO: 42048 - DNA, 22 bp, Artificial Sequence
  chemically synthesized
ttatttttttttctttcctgag

SEQ ID NO: 42049 - DNA, 22 bp, Artificial Sequence
  chemically synthesized
tttttttttctttcctgagaca

SEQ ID NO: 42050 - DNA, 22 bp, Artificial Sequence
  chemically synthesized
ttttttctttcctgagacattc

SEQ ID NO: 42051 - DNA, 22 bp, Artificial Sequence
  chemically synthesized
tttttctttcctgagacattct

SEQ ID NO: 42052 - DNA, 22 bp, Artificial Sequence
  chemically synthesized
ttttctttcctgagacattctt

SEQ ID NO: 42053 - DNA, 22 bp, Artificial Sequence
  chemically synthesized
tttctttcctgagacattcttg

SEQ ID NO: 42054 - DNA, 22 bp, Artificial Sequence
  chemically synthesized
ttctttcctgagacattcttgc

SEQ ID NO: 42055 - DNA, 22 bp, Artificial Sequence
  chemically synthesized
tctttcctgagacattcttgct

SEQ ID NO: 42056 - DNA, 22 bp, Artificial Sequence
  chemically synthesized
ctttcctgagacattcttgctc

SEQ ID NO: 42057 - DNA, 22 bp, Artificial Sequence
  chemically synthesized
tttcctgagacattcttgctct

SEQ ID NO: 42058 - DNA, 22 bp, Artificial Sequence
  chemically synthesized
tcctgagacattcttgctctgt

SEQ ID NO: 42059 - DNA, 22 bp, Artificial Sequence
  chemically synthesized
cctgagacattcttgctctgtc

SEQ ID NO: 42060 - DNA, 22 bp, Artificial Sequence
  chemically synthesized
ctgagacattcttgctctgtca

SEQ ID NO: 42061 - DNA, 22 bp, Artificial Sequence
  chemically synthesized
agacattcttgctctgtcaccc

SEQ ID NO: 42062 - DNA, 22 bp, Artificial Sequence
  chemically synthesized
ttgctctgtcacccaggctgga

SEQ ID NO: 42063 - DNA, 22 bp, Artificial Sequence
  chemically synthesized
gctctgtcacccaggctggagt

SEQ ID NO: 42064 - DNA, 22 bp, Artificial Sequence
  chemically synthesized
ctctgtcacccaggctggagtg

SEQ ID NO: 42065 - DNA, 22 bp, Artificial Sequence
  chemically synthesized
tgtcacccaggctggagtgcag

SEQ ID NO: 42066 - DNA, 22 bp, Artificial Sequence
  chemically synthesized
tcacccaggctggagtgcagtg

SEQ ID NO: 42067 - DNA, 22 bp, Artificial Sequence
  chemically synthesized
gagtgcagtggcacattcttgg

SEQ ID NO: 42068 - DNA, 22 bp, Artificial Sequence
  chemically synthesized
ttggctcactgcaacctccatc

SEQ ID NO: 42069 - DNA, 22 bp, Artificial Sequence
  chemically synthesized
ggctcactgcaacctccatctc

SEQ ID NO: 42070 - DNA, 22 bp, Artificial Sequence
  chemically synthesized
gctcactgcaacctccatctcc

SEQ ID NO: 42071 - DNA, 22 bp, Artificial Sequence
  chemically synthesized
actgcaacctccatctcctgtg

SEQ ID NO: 42072 - DNA, 22 bp, Artificial Sequence
  chemically synthesized
caacctccatctcctgtgttca

SEQ ID NO: 42073 - DNA, 22 bp, Artificial Sequence
  chemically synthesized
catctcctgtgttcaagcaatt

SEQ ID NO: 42074 - DNA, 22 bp, Artificial Sequence
  chemically synthesized
ctgtgttcaagcaattctagtg

SEQ ID NO: 42075 - DNA, 22 bp, Artificial Sequence
  chemically synthesized
tgttcaagcaattctagtgcct

SEQ ID NO: 42076 - DNA, 22 bp, Artificial Sequence
  chemically synthesized
aagcaattctagtgcctcagcc

SEQ ID NO: 42077 - DNA, 22 bp, Artificial Sequence
  chemically synthesized
tagtgcctcagcctacttagta

SEQ ID NO: 42078 - DNA, 22 bp, Artificial Sequence
  chemically synthesized
gtgcctcagcctacttagtagc

SEQ ID NO: 42079 - DNA, 22 bp, Artificial Sequence
  chemically synthesized
agcctacttagtagctgggatg

SEQ ID NO: 42080 - DNA, 22 bp, Artificial Sequence
  chemically synthesized
cttagtagctgggatgactggc

SEQ ID NO: 42081 - DNA, 22 bp, Artificial Sequence
  chemically synthesized
agtagctgggatgactggcatg

SEQ ID NO: 42082 - DNA, 22 bp, Artificial Sequence
  chemically synthesized
gtagctgggatgactggcatgt

SEQ ID NO: 42083 - DNA, 22 bp, Artificial Sequence
  chemically synthesized
ggatgactggcatgtgcctcca

SEQ ID NO: 42084 - DNA, 22 bp, Artificial Sequence
  chemically synthesized
gcatgtgcctccacacccagct

SEQ ID NO: 42085 - DNA, 22 bp, Artificial Sequence
  chemically synthesized
cacacccagctaatttttgtat

SEQ ID NO: 42086 - DNA, 22 bp, Artificial Sequence
  chemically synthesized
atttttgtattttttgtagaga

SEQ ID NO: 42087 - DNA, 22 bp, Artificial Sequence
  chemically synthesized
ttgtattttttgtagagacagg

SEQ ID NO: 42088 - DNA, 22 bp, Artificial Sequence
  chemically synthesized
tgtattttttgtagagacaggg

SEQ ID NO: 42089 - DNA, 22 bp, Artificial Sequence
  chemically synthesized
gtattttttgtagagacagggt

SEQ ID NO: 42090 - DNA, 22 bp, Artificial Sequence
  chemically synthesized
tattttttgtagagacagggtt

SEQ ID NO: 42091 - DNA, 22 bp, Artificial Sequence
  chemically synthesized
tttgtagagacagggttttggc

SEQ ID NO: 42092 - DNA, 22 bp, Artificial Sequence
  chemically synthesized
ttgtagagacagggttttggca

SEQ ID NO: 42093 - DNA, 22 bp, Artificial Sequence
  chemically synthesized
tgtagagacagggttttggcat

SEQ ID NO: 42094 - DNA, 22 bp, Artificial Sequence
  chemically synthesized
gtagagacagggttttggcatg

SEQ ID NO: 42095 - DNA, 22 bp, Artificial Sequence
  chemically synthesized
tagagacagggttttggcatgt

SEQ ID NO: 42096 - DNA, 22 bp, Artificial Sequence
  chemically synthesized
tggcatgttgcccaggcttgtc

SEQ ID NO: 42097 - DNA, 22 bp, Artificial Sequence
  chemically synthesized
ggcatgttgcccaggcttgtct

SEQ ID NO: 42098 - DNA, 22 bp, Artificial Sequence
  chemically synthesized
gcatgttgcccaggcttgtctc

SEQ ID NO: 42099 - DNA, 22 bp, Artificial Sequence
  chemically synthesized
cccaggcttgtctcaaactcct

SEQ ID NO: 42100 - DNA, 22 bp, Artificial Sequence
  chemically synthesized
gtctcaaactcctggcctcagg

SEQ ID NO: 42101 - DNA, 22 bp, Artificial Sequence
  chemically synthesized
tctcaaactcctggcctcaggt

SEQ ID NO: 42102 - DNA, 22 bp, Artificial Sequence
  chemically synthesized
aaactcctggcctcaggtgatc

SEQ ID NO: 42103 - DNA, 22 bp, Artificial Sequence
  chemically synthesized
ctggcctcaggtgatccatctg

SEQ ID NO: 42104 - DNA, 22 bp, Artificial Sequence
  chemically synthesized
gcctcaggtgatccatctgccg

SEQ ID NO: 42105 - DNA, 22 bp, Artificial Sequence
  chemically synthesized
aggtgatccatctgccgtggcc

SEQ ID NO: 42106 - DNA, 22 bp, Artificial Sequence
  chemically synthesized
ccgtggcctcccaaaatgctgg

SEQ ID NO: 42107 - DNA, 22 bp, Artificial Sequence
  chemically synthesized
ccaaaatgctgggattataggc

SEQ ID NO: 42108 - DNA, 22 bp, Artificial Sequence
  chemically synthesized
ggattataggcatgagccacca

SEQ ID NO: 42109 - DNA, 22 bp, Artificial Sequence
  chemically synthesized
taggcatgagccaccaccccct

SEQ ID NO: 42110 - DNA, 22 bp, Artificial Sequence
  chemically synthesized
ctggaaggattgatatcttata

SEQ ID NO: 42111 - DNA, 22 bp, Artificial Sequence
  chemically synthesized
gaaggattgatatcttataaca

SEQ ID NO: 42112 - DNA, 22 bp, Artificial Sequence
  chemically synthesized
atatcttataacataatttata

SEQ ID NO: 42113 - DNA, 22 bp, Artificial Sequence
  chemically synthesized
ataacataatttataattacag

SEQ ID NO: 42114 - DNA, 22 bp, Artificial Sequence
  chemically synthesized
taacataatttataattacaga

SEQ ID NO: 42115 - DNA, 22 bp, Artificial Sequence
  chemically synthesized
ataattacagaaaacatgtgag

SEQ ID NO: 42116 - DNA, 22 bp, Artificial Sequence
  chemically synthesized
taattacagaaaacatgtgagt

SEQ ID NO: 42117 - DNA, 22 bp, Artificial Sequence
  chemically synthesized
cagaaaacatgtgagttcacta

SEQ ID NO: 42118 - DNA, 22 bp, Artificial Sequence
  chemically synthesized
actaggaataaataaattttga

SEQ ID NO: 42119 - DNA, 22 bp, Artificial Sequence
  chemically synthesized
ggaataaataaattttgaagat

SEQ ID NO: 42120 - DNA, 22 bp, Artificial Sequence
  chemically synthesized
tgaagataataaaagattttca

SEQ ID NO: 42121 - DNA, 22 bp, Artificial Sequence
  chemically synthesized
gaagataataaaagattttcac

SEQ ID NO: 42122 - DNA, 22 bp, Artificial Sequence
  chemically synthesized
aagataataaaagattttcact

SEQ ID NO: 42123 - DNA, 22 bp, Artificial Sequence
  chemically synthesized
tcacttatgttgtcatttcggc

SEQ ID NO: 42124 - DNA, 22 bp, Artificial Sequence
  chemically synthesized
cacttatgttgtcatttcggca

SEQ ID NO: 42125 - DNA, 22 bp, Artificial Sequence
  chemically synthesized
acttatgttgtcatttcggcac

SEQ ID NO: 42126 - DNA, 22 bp, Artificial Sequence
  chemically synthesized
atgttgtcatttcggcacagtt

SEQ ID NO: 42127 - DNA, 22 bp, Artificial Sequence
  chemically synthesized
tgttgtcatttcggcacagttt

SEQ ID NO: 42128 - DNA, 22 bp, Artificial Sequence
  chemically synthesized
tcatttcggcacagtttggtat

SEQ ID NO: 42129 - DNA, 22 bp, Artificial Sequence
  chemically synthesized
cggcacagtttggtataggatg

SEQ ID NO: 42130 - DNA, 22 bp, Artificial Sequence
  chemically synthesized
ggcacagtttggtataggatgt

SEQ ID NO: 42131 - DNA, 22 bp, Artificial Sequence
  chemically synthesized
ggtataggatgtggagatgtta

SEQ ID NO: 42132 - DNA, 22 bp, Artificial Sequence
  chemically synthesized
gtataggatgtggagatgttaa

SEQ ID NO: 42133 - DNA, 22 bp, Artificial Sequence
  chemically synthesized
acatttatacctagcttgctcg

SEQ ID NO: 42134 - DNA, 22 bp, Artificial Sequence
  chemically synthesized
atacctagcttgctcgtaaact

SEQ ID NO: 42135 - DNA, 22 bp, Artificial Sequence
  chemically synthesized
tacctagcttgctcgtaaacta

SEQ ID NO: 42136 - DNA, 22 bp, Artificial Sequence
  chemically synthesized
gcttgctcgtaaactaagacct

SEQ ID NO: 42137 - DNA, 22 bp, Artificial Sequence
  chemically synthesized
gctcgtaaactaagacctgaaa

SEQ ID NO: 42138 - DNA, 22 bp, Artificial Sequence
  chemically synthesized
ctcgtaaactaagacctgaaag

SEQ ID NO: 42139 - DNA, 22 bp, Artificial Sequence
  chemically synthesized
gtaaactaagacctgaaagggt

SEQ ID NO: 42140 - DNA, 22 bp, Artificial Sequence
  chemically synthesized
agacctgaaagggttgtgtcta

SEQ ID NO: 42141 - DNA, 22 bp, Artificial Sequence
  chemically synthesized
aaagggttgtgtctatcagctg

SEQ ID NO: 42142 - DNA, 22 bp, Artificial Sequence
  chemically synthesized
tgtctatcagctgcacccctgg

SEQ ID NO: 42143 - DNA, 22 bp, Artificial Sequence
  chemically synthesized
tcagctgcacccctgggtagcg

SEQ ID NO: 42144 - DNA, 22 bp, Artificial Sequence
  chemically synthesized
cacccctgggtagcgacacaac

SEQ ID NO: 42145 - DNA, 22 bp, Artificial Sequence
  chemically synthesized
ggtagcgacacaacctcgggaa

SEQ ID NO: 42146 - DNA, 22 bp, Artificial Sequence
  chemically synthesized
gggaaggcctcagccccctcct

SEQ ID NO: 42147 - DNA, 22 bp, Artificial Sequence
  chemically synthesized
agccccctcctcgtacagcact

SEQ ID NO: 42148 - DNA, 22 bp, Artificial Sequence
  chemically synthesized
ctcgtacagcactgcctgttgg

SEQ ID NO: 42149 - DNA, 22 bp, Artificial Sequence
  chemically synthesized
gtacagcactgcctgttggaaa

SEQ ID NO: 42150 - DNA, 22 bp, Artificial Sequence
  chemically synthesized
cctgttggaaagcttgagggag

SEQ ID NO: 42151 - DNA, 22 bp, Artificial Sequence
  chemically synthesized
ttggaaagcttgagggaggcta

SEQ ID NO: 42152 - DNA, 22 bp, Artificial Sequence
  chemically synthesized
gaaagcttgagggaggctatgg

SEQ ID NO: 42153 - DNA, 22 bp, Artificial Sequence
  chemically synthesized
gagggaggctatggatgtgcag

SEQ ID NO: 42154 - DNA, 22 bp, Artificial Sequence
  chemically synthesized
agggaggctatggatgtgcagc

SEQ ID NO: 42155 - DNA, 22 bp, Artificial Sequence
  chemically synthesized
tggatgtgcagcacttggcaga

SEQ ID NO: 42156 - DNA, 22 bp, Artificial Sequence
  chemically synthesized
ggcagagggtctggtcatggaa

SEQ ID NO: 42157 - DNA, 22 bp, Artificial Sequence
  chemically synthesized
gcagagggtctggtcatggaag

SEQ ID NO: 42158 - DNA, 22 bp, Artificial Sequence
  chemically synthesized
gtcatggaagttaccagcaaat

SEQ ID NO: 42159 - DNA, 22 bp, Artificial Sequence
  chemically synthesized
ccagcaaatatgagctactttt

SEQ ID NO: 42160 - DNA, 22 bp, Artificial Sequence
  chemically synthesized
cttttatgattttattttatcc

SEQ ID NO: 42161 - DNA, 22 bp, Artificial Sequence
  chemically synthesized
ttatgattttattttatccaaa

SEQ ID NO: 42162 - DNA, 22 bp, Artificial Sequence
  chemically synthesized
tatgattttattttatccaaaa

SEQ ID NO: 42163 - DNA, 22 bp, Artificial Sequence
  chemically synthesized
atgattttattttatccaaaag

SEQ ID NO: 42164 - DNA, 22 bp, Artificial Sequence
  chemically synthesized
tgattttattttatccaaaaga

SEQ ID NO: 42165 - DNA, 22 bp, Artificial Sequence
  chemically synthesized
tattttatccaaaagaaagaga

SEQ ID NO: 42166 - DNA, 22 bp, Artificial Sequence
  chemically synthesized
attttatccaaaagaaagagaa

SEQ ID NO: 42167 - DNA, 22 bp, Artificial Sequence
  chemically synthesized
ttttatccaaaagaaagagaat

SEQ ID NO: 42168 - DNA, 22 bp, Artificial Sequence
  chemically synthesized
tatccaaaagaaagagaatgaa

SEQ ID NO: 42169 - DNA, 22 bp, Artificial Sequence
  chemically synthesized
atccaaaagaaagagaatgaaa

SEQ ID NO: 42170 - DNA, 22 bp, Artificial Sequence
  chemically synthesized
tccaaaagaaagagaatgaaag

SEQ ID NO: 42171 - DNA, 22 bp, Artificial Sequence
  chemically synthesized
atcaggaaagatgaaggtctag

SEQ ID NO: 42172 - DNA, 22 bp, Artificial Sequence
  chemically synthesized
ggggtgagggaaggagtaagga

SEQ ID NO: 42173 - DNA, 22 bp, Artificial Sequence
  chemically synthesized
aggggggaaatggctttcacca

SEQ ID NO: 42174 - DNA, 22 bp, Artificial Sequence
  chemically synthesized
tcaccacttcccagcatctatt

SEQ ID NO: 42175 - DNA, 22 bp, Artificial Sequence
  chemically synthesized
caccacttcccagcatctattg

SEQ ID NO: 42176 - DNA, 22 bp, Artificial Sequence
  chemically synthesized
accacttcccagcatctattga

SEQ ID NO: 42177 - DNA, 22 bp, Artificial Sequence
  chemically synthesized
cccagcatctattgacattgca

SEQ ID NO: 42178 - DNA, 22 bp, Artificial Sequence
  chemically synthesized
ccagcatctattgacattgcac

SEQ ID NO: 42179 - DNA, 22 bp, Artificial Sequence
  chemically synthesized
ttgacattgcactctcaaatat

SEQ ID NO: 42180 - DNA, 22 bp, Artificial Sequence
  chemically synthesized
acattgcactctcaaatatttt

SEQ ID NO: 42181 - DNA, 22 bp, Artificial Sequence
  chemically synthesized
cactctcaaatattttataaga

SEQ ID NO: 42182 - DNA, 22 bp, Artificial Sequence
  chemically synthesized
tcaaatattttataagactcta

SEQ ID NO: 42183 - DNA, 22 bp, Artificial Sequence
  chemically synthesized
aaatattttataagactctata

SEQ ID NO: 42184 - DNA, 22 bp, Artificial Sequence
  chemically synthesized
tataagactctatattcaaggt

SEQ ID NO: 42185 - DNA, 22 bp, Artificial Sequence
  chemically synthesized
ataagactctatattcaaggta

SEQ ID NO: 42186 - DNA, 22 bp, Artificial Sequence
  chemically synthesized
taagactctatattcaaggtaa

SEQ ID NO: 42187 - DNA, 22 bp, Artificial Sequence
  chemically synthesized
tatattcaaggtaatgtttgaa

SEQ ID NO: 42188 - DNA, 22 bp, Artificial Sequence
  chemically synthesized
tattcaaggtaatgtttgaacc

SEQ ID NO: 42189 - DNA, 22 bp, Artificial Sequence
  chemically synthesized
aaggtaatgtttgaaccctgct

SEQ ID NO: 42190 - DNA, 22 bp, Artificial Sequence
  chemically synthesized
gaaccctgctgagccagtggca

SEQ ID NO: 42191 - DNA, 22 bp, Artificial Sequence
  chemically synthesized
aaccctgctgagccagtggcat

SEQ ID NO: 42192 - DNA, 22 bp, Artificial Sequence
  chemically synthesized
ctgagccagtggcatgggtctc

SEQ ID NO: 42193 - DNA, 22 bp, Artificial Sequence
  chemically synthesized
agccagtggcatgggtctctga

SEQ ID NO: 42194 - DNA, 22 bp, Artificial Sequence
  chemically synthesized
tgagagaatcattaacttaatt

SEQ ID NO: 42195 - DNA, 22 bp, Artificial Sequence
  chemically synthesized
agagaatcattaacttaatttg

SEQ ID NO: 42196 - DNA, 22 bp, Artificial Sequence
  chemically synthesized
acttaatttgactatctggttt

SEQ ID NO: 42197 - DNA, 22 bp, Artificial Sequence
  chemically synthesized
aatttgactatctggtttgtgg

SEQ ID NO: 42198 - DNA, 22 bp, Artificial Sequence
  chemically synthesized
atttgactatctggtttgtggg

SEQ ID NO: 42199 - DNA, 22 bp, Artificial Sequence
  chemically synthesized
gactatctggtttgtgggtgcg

SEQ ID NO: 42200 - DNA, 22 bp, Artificial Sequence
  chemically synthesized
actatctggtttgtgggtgcgt

SEQ ID NO: 42201 - DNA, 22 bp, Artificial Sequence
  chemically synthesized
tctggtttgtgggtgcgtttac

SEQ ID NO: 42202 - DNA, 22 bp, Artificial Sequence
  chemically synthesized
gtttgtgggtgcgtttactctc

SEQ ID NO: 42203 - DNA, 22 bp, Artificial Sequence
  chemically synthesized
gtgggtgcgtttactctcatgt

SEQ ID NO: 42204 - DNA, 22 bp, Artificial Sequence
  chemically synthesized
tgggtgcgtttactctcatgta

SEQ ID NO: 42205 - DNA, 22 bp, Artificial Sequence
  chemically synthesized
actctcatgtaagtcaacaatg

SEQ ID NO: 42206 - DNA, 22 bp, Artificial Sequence
  chemically synthesized
ctctcatgtaagtcaacaatgt

SEQ ID NO: 42207 - DNA, 22 bp, Artificial Sequence
  chemically synthesized
tcatgtaagtcaacaatgtcct

SEQ ID NO: 42208 - DNA, 22 bp, Artificial Sequence
  chemically synthesized
atgtaagtcaacaatgtcctgg

SEQ ID NO: 42209 - DNA, 22 bp, Artificial Sequence
  chemically synthesized
ggattgggacacactttctggg

SEQ ID NO: 42210 - DNA, 22 bp, Artificial Sequence
  chemically synthesized
ggacacactttctgggcactgc

SEQ ID NO: 42211 - DNA, 22 bp, Artificial Sequence
  chemically synthesized
tctgggcactgctggccagtcc

SEQ ID NO: 42212 - DNA, 22 bp, Artificial Sequence
  chemically synthesized
ctgggcactgctggccagtccc

SEQ ID NO: 42213 - DNA, 22 bp, Artificial Sequence
  chemically synthesized
tgggcactgctggccagtccca

SEQ ID NO: 42214 - DNA, 22 bp, Artificial Sequence
  chemically synthesized
ggcactgctggccagtcccaaa

SEQ ID NO: 42215 - DNA, 22 bp, Artificial Sequence
  chemically synthesized
ctggccagtcccaaaatggaac

SEQ ID NO: 42216 - DNA, 22 bp, Artificial Sequence
  chemically synthesized
gccagtcccaaaatggaacata

SEQ ID NO: 42217 - DNA, 22 bp, Artificial Sequence
  chemically synthesized
ttctacttcttttatttctgaa

SEQ ID NO: 42218 - DNA, 22 bp, Artificial Sequence
  chemically synthesized
ctacttcttttatttctgaaat

SEQ ID NO: 42219 - DNA, 22 bp, Artificial Sequence
  chemically synthesized
tacttcttttatttctgaaatc

SEQ ID NO: 42220 - DNA, 22 bp, Artificial Sequence
  chemically synthesized
cttcttttatttctgaaatcag

SEQ ID NO: 42221 - DNA, 22 bp, Artificial Sequence
  chemically synthesized
cttttatttctgaaatcaggta

SEQ ID NO: 42222 - DNA, 22 bp, Artificial Sequence
  chemically synthesized
ttttatttctgaaatcaggtaa

SEQ ID NO: 42223 - DNA, 22 bp, Artificial Sequence
  chemically synthesized
ttatttctgaaatcaggtaaga

SEQ ID NO: 42224 - DNA, 22 bp, Artificial Sequence
  chemically synthesized
tatttctgaaatcaggtaagac

SEQ ID NO: 42225 - DNA, 22 bp, Artificial Sequence
  chemically synthesized
atttctgaaatcaggtaagaca

SEQ ID NO: 42226 - DNA, 22 bp, Artificial Sequence
  chemically synthesized
tttctgaaatcaggtaagacat

SEQ ID NO: 42227 - DNA, 22 bp, Artificial Sequence
  chemically synthesized
ctgaaatcaggtaagacatagt

SEQ ID NO: 42228 - DNA, 22 bp, Artificial Sequence
  chemically synthesized
tgaaatcaggtaagacatagtt

SEQ ID NO: 42229 - DNA, 22 bp, Artificial Sequence
  chemically synthesized
aaatcaggtaagacatagtttt

SEQ ID NO: 42230 - DNA, 22 bp, Artificial Sequence
  chemically synthesized
ttttaaattataagaattattt

SEQ ID NO: 42231 - DNA, 22 bp, Artificial Sequence
  chemically synthesized
tttaaattataagaattatttt

SEQ ID NO: 42232 - DNA, 22 bp, Artificial Sequence
  chemically synthesized
ttaaattataagaattattttt

SEQ ID NO: 42233 - DNA, 22 bp, Artificial Sequence
  chemically synthesized
taaattataagaattatttttt

SEQ ID NO: 42234 - DNA, 22 bp, Artificial Sequence
  chemically synthesized
aaattataagaattattttttc

SEQ ID NO: 42235 - DNA, 22 bp, Artificial Sequence
  chemically synthesized
aattataagaattattttttct

SEQ ID NO: 42236 - DNA, 22 bp, Artificial Sequence
  chemically synthesized
taagaattattttttctcccac

SEQ ID NO: 42237 - DNA, 22 bp, Artificial Sequence
  chemically synthesized
ttttttctcccacaatgtagta

SEQ ID NO: 42238 - DNA, 22 bp, Artificial Sequence
  chemically synthesized
tttctcccacaatgtagtaaaa

SEQ ID NO: 42239 - DNA, 22 bp, Artificial Sequence
  chemically synthesized
ttctcccacaatgtagtaaaaa

SEQ ID NO: 42240 - DNA, 22 bp, Artificial Sequence
  chemically synthesized
tctcccacaatgtagtaaaaat

SEQ ID NO: 42241 - DNA, 22 bp, Artificial Sequence
  chemically synthesized
ctcccacaatgtagtaaaaata

SEQ ID NO: 42242 - DNA, 22 bp, Artificial Sequence
  chemically synthesized
tcccacaatgtagtaaaaatac

SEQ ID NO: 42243 - DNA, 22 bp, Artificial Sequence
  chemically synthesized
ccacaatgtagtaaaaatacat

SEQ ID NO: 42244 - DNA, 22 bp, Artificial Sequence
  chemically synthesized
tatgtgcaattcatttaatttt

SEQ ID NO: 42245 - DNA, 22 bp, Artificial Sequence
  chemically synthesized
atgtgcaattcatttaattttt

SEQ ID NO: 42246 - DNA, 22 bp, Artificial Sequence
  chemically synthesized
tgtgcaattcatttaatttttg

SEQ ID NO: 42247 - DNA, 22 bp, Artificial Sequence
  chemically synthesized
atttaatttttgattcatgaaa

SEQ ID NO: 42248 - DNA, 22 bp, Artificial Sequence
  chemically synthesized
aatttttgattcatgaaattcc

SEQ ID NO: 42249 - DNA, 22 bp, Artificial Sequence
  chemically synthesized
atttttgattcatgaaattccc

SEQ ID NO: 42250 - DNA, 22 bp, Artificial Sequence
  chemically synthesized
ttgattcatgaaattcccagtt

SEQ ID NO: 42251 - DNA, 22 bp, Artificial Sequence
  chemically synthesized
tgattcatgaaattcccagttc

SEQ ID NO: 42252 - DNA, 22 bp, Artificial Sequence
  chemically synthesized
gattcatgaaattcccagttca

SEQ ID NO: 42253 - DNA, 22 bp, Artificial Sequence
  chemically synthesized
attcatgaaattcccagttcaa

SEQ ID NO: 42254 - DNA, 22 bp, Artificial Sequence
  chemically synthesized
atgaaattcccagttcaaaatc

SEQ ID NO: 42255 - DNA, 22 bp, Artificial Sequence
  chemically synthesized
ccagttcaaaatcttgtatatg

SEQ ID NO: 42256 - DNA, 22 bp, Artificial Sequence
  chemically synthesized
aaaatcttgtatatgattgaaa

SEQ ID NO: 42257 - DNA, 22 bp, Artificial Sequence
  chemically synthesized
gtatatgattgaaaaattctta

SEQ ID NO: 42258 - DNA, 22 bp, Artificial Sequence
  chemically synthesized
tatatgattgaaaaattcttaa

SEQ ID NO: 42259 - DNA, 22 bp, Artificial Sequence
  chemically synthesized
aaaaattcttaaaaaaataagt

SEQ ID NO: 42260 - DNA, 22 bp, Artificial Sequence
  chemically synthesized
ttaaaaaaataagtttaatttc

SEQ ID NO: 42261 - DNA, 22 bp, Artificial Sequence
  chemically synthesized
aaaaaaataagtttaatttccc

SEQ ID NO: 42262 - DNA, 22 bp, Artificial Sequence
  chemically synthesized
aaaaaataagtttaatttcccc

SEQ ID NO: 42263 - DNA, 22 bp, Artificial Sequence
  chemically synthesized
aatttccccgtgaagactgtca

SEQ ID NO: 42264 - DNA, 22 bp, Artificial Sequence
  chemically synthesized
atttccccgtgaagactgtcac

SEQ ID NO: 42265 - DNA, 22 bp, Artificial Sequence
  chemically synthesized
ccccgtgaagactgtcacggtg

SEQ ID NO: 42266 - DNA, 22 bp, Artificial Sequence
  chemically synthesized
cccgtgaagactgtcacggtgc

SEQ ID NO: 42267 - DNA, 22 bp, Artificial Sequence
  chemically synthesized
tcacggtgctggaatgaatggg

SEQ ID NO: 42268 - DNA, 22 bp, Artificial Sequence
  chemically synthesized
gaatgaatgggcagaaaaaata

SEQ ID NO: 42269 - DNA, 22 bp, Artificial Sequence
  chemically synthesized
atttttctaatctaaaagagtg

SEQ ID NO: 42270 - DNA, 22 bp, Artificial Sequence
  chemically synthesized
ttctaatctaaaagagtgtgcc

SEQ ID NO: 42271 - DNA, 22 bp, Artificial Sequence
  chemically synthesized
tctaatctaaaagagtgtgcct

SEQ ID NO: 42272 - DNA, 22 bp, Artificial Sequence
  chemically synthesized
ctaatctaaaagagtgtgccta

SEQ ID NO: 42273 - DNA, 22 bp, Artificial Sequence
  chemically synthesized
taatctaaaagagtgtgcctac

SEQ ID NO: 42274 - DNA, 22 bp, Artificial Sequence
  chemically synthesized
atctaaaagagtgtgcctacat

SEQ ID NO: 42275 - DNA, 22 bp, Artificial Sequence
  chemically synthesized
aaagagtgtgcctacatgatgg

SEQ ID NO: 42276 - DNA, 22 bp, Artificial Sequence
  chemically synthesized
catgatggccagtctggctgaa

SEQ ID NO: 42277 - DNA, 22 bp, Artificial Sequence
  chemically synthesized
gctgaaaaataaatagccattg

SEQ ID NO: 42278 - DNA, 22 bp, Artificial Sequence
  chemically synthesized
aaaaataaatagccattgtagc

SEQ ID NO: 42279 - DNA, 22 bp, Artificial Sequence
  chemically synthesized
tagctaactatgcaaaggatgg

SEQ ID NO: 42280 - DNA, 22 bp, Artificial Sequence
  chemically synthesized
actatgcaaaggatggctaagc

SEQ ID NO: 42281 - DNA, 22 bp, Artificial Sequence
  chemically synthesized
tgcaaaggatggctaagctctt

SEQ ID NO: 42282 - DNA, 22 bp, Artificial Sequence
  chemically synthesized
agctcttcgcttggttctcagt

SEQ ID NO: 42283 - DNA, 22 bp, Artificial Sequence
  chemically synthesized
ttcgcttggttctcagtttcat

SEQ ID NO: 42284 - DNA, 22 bp, Artificial Sequence
  chemically synthesized
cgcttggttctcagtttcatta

SEQ ID NO: 42285 - DNA, 22 bp, Artificial Sequence
  chemically synthesized
gcttggttctcagtttcattaa

SEQ ID NO: 42286 - DNA, 22 bp, Artificial Sequence
  chemically synthesized
ggttctcagtttcattaattta

SEQ ID NO: 42287 - DNA, 22 bp, Artificial Sequence
  chemically synthesized
gttctcagtttcattaatttat

SEQ ID NO: 42288 - DNA, 22 bp, Artificial Sequence
  chemically synthesized
tcagtttcattaatttatatca

SEQ ID NO: 42289 - DNA, 22 bp, Artificial Sequence
  chemically synthesized
agtttcattaatttatatcatc

SEQ ID NO: 42290 - DNA, 22 bp, Artificial Sequence
  chemically synthesized
cattaatttatatcatctctgt

SEQ ID NO: 42291 - DNA, 22 bp, Artificial Sequence
  chemically synthesized
attaatttatatcatctctgtt

SEQ ID NO: 42292 - DNA, 22 bp, Artificial Sequence
  chemically synthesized
atttatatcatctctgttcagg

SEQ ID NO: 42293 - DNA, 22 bp, Artificial Sequence
  chemically synthesized
atatcatctctgttcaggtgcc

SEQ ID NO: 42294 - DNA, 22 bp, Artificial Sequence
  chemically synthesized
tatcatctctgttcaggtgcca

SEQ ID NO: 42295 - DNA, 22 bp, Artificial Sequence
  chemically synthesized
tgttcaggtgccatgctcccct

SEQ ID NO: 42296 - DNA, 22 bp, Artificial Sequence
  chemically synthesized
ttcaggtgccatgctcccctca

SEQ ID NO: 42297 - DNA, 22 bp, Artificial Sequence
  chemically synthesized
aggtgccatgctcccctcacta

SEQ ID NO: 42298 - DNA, 22 bp, Artificial Sequence
  chemically synthesized
ccctcactagcaagttgaaaca

SEQ ID NO: 42299 - DNA, 22 bp, Artificial Sequence
  chemically synthesized
actagcaagttgaaacaatgaa

SEQ ID NO: 42300 - DNA, 22 bp, Artificial Sequence
  chemically synthesized
gcaagttgaaacaatgaaataa

SEQ ID NO: 42301 - DNA, 22 bp, Artificial Sequence
  chemically synthesized
aaacaatgaaataactctttga

SEQ ID NO: 42302 - DNA, 22 bp, Artificial Sequence
  chemically synthesized
tttgaatatgtttggttccttg

SEQ ID NO: 42303 - DNA, 22 bp, Artificial Sequence
  chemically synthesized
tgaatatgtttggttccttgac

SEQ ID NO: 42304 - DNA, 22 bp, Artificial Sequence
  chemically synthesized
gaatatgtttggttccttgacc

SEQ ID NO: 42305 - DNA, 22 bp, Artificial Sequence
  chemically synthesized
aatatgtttggttccttgacct

SEQ ID NO: 42306 - DNA, 22 bp, Artificial Sequence
  chemically synthesized
ggttccttgacctgttcatgga

SEQ ID NO: 42307 - DNA, 22 bp, Artificial Sequence
  chemically synthesized
gttccttgacctgttcatggag

SEQ ID NO: 42308 - DNA, 22 bp, Artificial Sequence
  chemically synthesized
cttgacctgttcatggagtggg

SEQ ID NO: 42309 - DNA, 22 bp, Artificial Sequence
  chemically synthesized
gacctgttcatggagtgggact

SEQ ID NO: 42310 - DNA, 22 bp, Artificial Sequence
  chemically synthesized
acctgttcatggagtgggactc

SEQ ID NO: 42311 - DNA, 22 bp, Artificial Sequence
  chemically synthesized
ttcatggagtgggactcagcat

SEQ ID NO: 42312 - DNA, 22 bp, Artificial Sequence
  chemically synthesized
atggagtgggactcagcatttc

SEQ ID NO: 42313 - DNA, 22 bp, Artificial Sequence
  chemically synthesized
agcatttctctctttgttatgg

SEQ ID NO: 42314 - DNA, 22 bp, Artificial Sequence
  chemically synthesized
ctctctttgttatggcctgagt

SEQ ID NO: 42315 - DNA, 22 bp, Artificial Sequence
  chemically synthesized
tctctttgttatggcctgagta

SEQ ID NO: 42316 - DNA, 22 bp, Artificial Sequence
  chemically synthesized
tctttgttatggcctgagtaag

SEQ ID NO: 42317 - DNA, 22 bp, Artificial Sequence
  chemically synthesized
tttgttatggcctgagtaaggc

SEQ ID NO: 42318 - DNA, 22 bp, Artificial Sequence
  chemically synthesized
tgttatggcctgagtaaggctt

SEQ ID NO: 42319 - DNA, 22 bp, Artificial Sequence
  chemically synthesized
gttatggcctgagtaaggcttt

SEQ ID NO: 42320 - DNA, 22 bp, Artificial Sequence
  chemically synthesized
ttatggcctgagtaaggctttc

SEQ ID NO: 42321 - DNA, 22 bp, Artificial Sequence
  chemically synthesized
tggcctgagtaaggctttccat

SEQ ID NO: 42322 - DNA, 22 bp, Artificial Sequence
  chemically synthesized
agtaaggctttccatcggtata

SEQ ID NO: 42323 - DNA, 22 bp, Artificial Sequence
  chemically synthesized
tccatcggtatacatttgcttc

SEQ ID NO: 42324 - DNA, 22 bp, Artificial Sequence
  chemically synthesized
ccatcggtatacatttgcttct

SEQ ID NO: 42325 - DNA, 22 bp, Artificial Sequence
  chemically synthesized
catcggtatacatttgcttctt

SEQ ID NO: 42326 - DNA, 22 bp, Artificial Sequence
  chemically synthesized
gcttcttatccctggagaaatt

SEQ ID NO: 42327 - DNA, 22 bp, Artificial Sequence
  chemically synthesized
cttcttatccctggagaaatta

SEQ ID NO: 42328 - DNA, 22 bp, Artificial Sequence
  chemically synthesized
cttatccctggagaaattatac

SEQ ID NO: 42329 - DNA, 22 bp, Artificial Sequence
  chemically synthesized
ttatccctggagaaattataca

SEQ ID NO: 42330 - DNA, 22 bp, Artificial Sequence
  chemically synthesized
atccctggagaaattatacaca

SEQ ID NO: 42331 - DNA, 22 bp, Artificial Sequence
  chemically synthesized
tccctggagaaattatacacat

SEQ ID NO: 42332 - DNA, 22 bp, Artificial Sequence
  chemically synthesized
gagaaattatacacatccattt

SEQ ID NO: 42333 - DNA, 22 bp, Artificial Sequence
  chemically synthesized
tacacatccatttgccagatga

SEQ ID NO: 42334 - DNA, 22 bp, Artificial Sequence
  chemically synthesized
gccagatgatatacgcatataa

SEQ ID NO: 42335 - DNA, 22 bp, Artificial Sequence
  chemically synthesized
ccagatgatatacgcatataat

SEQ ID NO: 42336 - DNA, 22 bp, Artificial Sequence
  chemically synthesized
aacaaatactcagggtatttgt

SEQ ID NO: 42337 - DNA, 22 bp, Artificial Sequence
  chemically synthesized
agggtatttgttgagtgggtta

SEQ ID NO: 42338 - DNA, 22 bp, Artificial Sequence
  chemically synthesized
gttgagtgggttaggtccccac

SEQ ID NO: 42339 - DNA, 22 bp, Artificial Sequence
  chemically synthesized
ttgagtgggttaggtccccaca

SEQ ID NO: 42340 - DNA, 22 bp, Artificial Sequence
  chemically synthesized
agtgggttaggtccccacattt

SEQ ID NO: 42341 - DNA, 22 bp, Artificial Sequence
  chemically synthesized
ggtccccacatttttatacata

SEQ ID NO: 42342 - DNA, 22 bp, Artificial Sequence
  chemically synthesized
ttatacatacatacacacatac

SEQ ID NO: 42343 - DNA, 22 bp, Artificial Sequence
  chemically synthesized
tatacatacatacacacataca

SEQ ID NO: 42344 - DNA, 22 bp, Artificial Sequence
  chemically synthesized
atacatacatacacacatacac

SEQ ID NO: 42345 - DNA, 22 bp, Artificial Sequence
  chemically synthesized
tacatacatacacacatacaca

SEQ ID NO: 42346 - DNA, 22 bp, Artificial Sequence
  chemically synthesized
tgaatgtaagtgtgtgtccttt

SEQ ID NO: 42347 - DNA, 22 bp, Artificial Sequence
  chemically synthesized
tacaaatactagcttatttagc

SEQ ID NO: 42348 - DNA, 22 bp, Artificial Sequence
  chemically synthesized
acaaatactagcttatttagct

SEQ ID NO: 42349 - DNA, 22 bp, Artificial Sequence
  chemically synthesized
caaatactagcttatttagctc

SEQ ID NO: 42350 - DNA, 22 bp, Artificial Sequence
  chemically synthesized
gcttatttagctcatggtatag

SEQ ID NO: 42351 - DNA, 22 bp, Artificial Sequence
  chemically synthesized
atttagctcatggtataggtag

SEQ ID NO: 42352 - DNA, 22 bp, Artificial Sequence
  chemically synthesized
tttagctcatggtataggtagg

SEQ ID NO: 42353 - DNA, 22 bp, Artificial Sequence
  chemically synthesized
agctcatggtataggtagggta

SEQ ID NO: 42354 - DNA, 22 bp, Artificial Sequence
  chemically synthesized
gctcatggtataggtagggtag

SEQ ID NO: 42355 - DNA, 22 bp, Artificial Sequence
  chemically synthesized
atggtataggtagggtagcata

SEQ ID NO: 42356 - DNA, 22 bp, Artificial Sequence
  chemically synthesized
tataaacaaagaaatctagact

SEQ ID NO: 42357 - DNA, 22 bp, Artificial Sequence
  chemically synthesized
ataaacaaagaaatctagactt

SEQ ID NO: 42358 - DNA, 22 bp, Artificial Sequence
  chemically synthesized
taaacaaagaaatctagactta

SEQ ID NO: 42359 - DNA, 22 bp, Artificial Sequence
  chemically synthesized
gacttaggaaaatcatgttatt

SEQ ID NO: 42360 - DNA, 22 bp, Artificial Sequence
  chemically synthesized
aggaaaatcatgttatttgtct

SEQ ID NO: 42361 - DNA, 22 bp, Artificial Sequence
  chemically synthesized
ggaaaatcatgttatttgtctc

SEQ ID NO: 42362 - DNA, 22 bp, Artificial Sequence
  chemically synthesized
tttgtctcgtgaccaaattccc

SEQ ID NO: 42363 - DNA, 22 bp, Artificial Sequence
  chemically synthesized
gtctcgtgaccaaattcccaaa

SEQ ID NO: 42364 - DNA, 22 bp, Artificial Sequence
  chemically synthesized
tctcgtgaccaaattcccaaat

SEQ ID NO: 42365 - DNA, 22 bp, Artificial Sequence
  chemically synthesized
gtgaccaaattcccaaatcaag

SEQ ID NO: 42366 - DNA, 22 bp, Artificial Sequence
  chemically synthesized
ccaaatcaaggaaataaagaaa

SEQ ID NO: 42367 - DNA, 22 bp, Artificial Sequence
  chemically synthesized
gatttaagccagatttccaaga

SEQ ID NO: 42368 - DNA, 22 bp, Artificial Sequence
  chemically synthesized
aagccagatttccaagaaaaaa

SEQ ID NO: 42369 - DNA, 22 bp, Artificial Sequence
  chemically synthesized
agccagatttccaagaaaaaat

SEQ ID NO: 42370 - DNA, 22 bp, Artificial Sequence
  chemically synthesized
ccaagaaaaaatctagggctct

SEQ ID NO: 42371 - DNA, 22 bp, Artificial Sequence
  chemically synthesized
caagaaaaaatctagggctctt

SEQ ID NO: 42372 - DNA, 22 bp, Artificial Sequence
  chemically synthesized
gggctcttctcactttttcatc

SEQ ID NO: 42373 - DNA, 22 bp, Artificial Sequence
  chemically synthesized
ttctcactttttcatctttgtt

SEQ ID NO: 42374 - DNA, 22 bp, Artificial Sequence
  chemically synthesized
ctcactttttcatctttgttcc

SEQ ID NO: 42375 - DNA, 22 bp, Artificial Sequence
  chemically synthesized
tcactttttcatctttgttcca

SEQ ID NO: 42376 - DNA, 22 bp, Artificial Sequence
  chemically synthesized
actttttcatctttgttccaac

SEQ ID NO: 42377 - DNA, 22 bp, Artificial Sequence
  chemically synthesized
tttcatctttgttccaacattt

SEQ ID NO: 42378 - DNA, 22 bp, Artificial Sequence
  chemically synthesized
ttcatctttgttccaacatttg

SEQ ID NO: 42379 - DNA, 22 bp, Artificial Sequence
  chemically synthesized
tcatctttgttccaacatttga

SEQ ID NO: 42380 - DNA, 22 bp, Artificial Sequence
  chemically synthesized
catctttgttccaacatttgaa

SEQ ID NO: 42381 - DNA, 22 bp, Artificial Sequence
  chemically synthesized
atctttgttccaacatttgaaa

SEQ ID NO: 42382 - DNA, 22 bp, Artificial Sequence
  chemically synthesized
tgttccaacatttgaaaaaata

SEQ ID NO: 42383 - DNA, 22 bp, Artificial Sequence
  chemically synthesized
gttccaacatttgaaaaaataa

SEQ ID NO: 42384 - DNA, 22 bp, Artificial Sequence
  chemically synthesized
ttccaacatttgaaaaaataaa

SEQ ID NO: 42385 - DNA, 22 bp, Artificial Sequence
  chemically synthesized
caacatttgaaaaaataaatct

SEQ ID NO: 42386 - DNA, 22 bp, Artificial Sequence
  chemically synthesized
gaaaaaataaatctaaacacat

SEQ ID NO: 42387 - DNA, 22 bp, Artificial Sequence
  chemically synthesized
aaaaaataaatctaaacacatt

SEQ ID NO: 42388 - DNA, 22 bp, Artificial Sequence
  chemically synthesized
aacacattccaatgtaactgaa

SEQ ID NO: 42389 - DNA, 22 bp, Artificial Sequence
  chemically synthesized
caatgtaactgaagagcaggtt

SEQ ID NO: 42390 - DNA, 22 bp, Artificial Sequence
  chemically synthesized
aagagcaggttaattgtttgcc

SEQ ID NO: 42391 - DNA, 22 bp, Artificial Sequence
  chemically synthesized
attgtttgccacttgcagaatc

SEQ ID NO: 42392 - DNA, 22 bp, Artificial Sequence
  chemically synthesized
tttgccacttgcagaatccaat

SEQ ID NO: 42393 - DNA, 22 bp, Artificial Sequence
  chemically synthesized
gccacttgcagaatccaattaa

SEQ ID NO: 42394 - DNA, 22 bp, Artificial Sequence
  chemically synthesized
ccacttgcagaatccaattaag

SEQ ID NO: 42395 - DNA, 22 bp, Artificial Sequence
  chemically synthesized
gcagaatccaattaagaagaga

SEQ ID NO: 42396 - DNA, 22 bp, Artificial Sequence
  chemically synthesized
cagaatccaattaagaagagag

SEQ ID NO: 42397 - DNA, 22 bp, Artificial Sequence
  chemically synthesized
agaagagagaagtctggtataa

SEQ ID NO: 42398 - DNA, 22 bp, Artificial Sequence
  chemically synthesized
gtataaagaaagtgatttgctt

SEQ ID NO: 42399 - DNA, 22 bp, Artificial Sequence
  chemically synthesized
gcttccaaagctagcttagggg

SEQ ID NO: 42400 - DNA, 22 bp, Artificial Sequence
  chemically synthesized
cttccaaagctagcttagggga

SEQ ID NO: 42401 - DNA, 22 bp, Artificial Sequence
  chemically synthesized
ccaaagctagcttaggggaaga

SEQ ID NO: 42402 - DNA, 22 bp, Artificial Sequence
  chemically synthesized
caaagctagcttaggggaagaa

SEQ ID NO: 42403 - DNA, 22 bp, Artificial Sequence
  chemically synthesized
gcttaggggaagaaatgcagca

SEQ ID NO: 42404 - DNA, 22 bp, Artificial Sequence
  chemically synthesized
aggggaagaaatgcagcagtcc

SEQ ID NO: 42405 - DNA, 22 bp, Artificial Sequence
  chemically synthesized
ggggaagaaatgcagcagtcct

SEQ ID NO: 42406 - DNA, 22 bp, Artificial Sequence
  chemically synthesized
ccgtactacttcactttaggag

SEQ ID NO: 42407 - DNA, 22 bp, Artificial Sequence
  chemically synthesized
cttcactttaggagcagaaagt

SEQ ID NO: 42408 - DNA, 22 bp, Artificial Sequence
  chemically synthesized
cactttaggagcagaaagtggc

SEQ ID NO: 42409 - DNA, 22 bp, Artificial Sequence
  chemically synthesized
actttaggagcagaaagtggca

SEQ ID NO: 42410 - DNA, 22 bp, Artificial Sequence
  chemically synthesized
taggagcagaaagtggcacttt

SEQ ID NO: 42411 - DNA, 22 bp, Artificial Sequence
  chemically synthesized
aggagcagaaagtggcactttt

SEQ ID NO: 42412 - DNA, 22 bp, Artificial Sequence
  chemically synthesized
ggagcagaaagtggcactttta

SEQ ID NO: 42413 - DNA, 22 bp, Artificial Sequence
  chemically synthesized
ttaaaaggcaacagaggaggcg

SEQ ID NO: 42414 - DNA, 22 bp, Artificial Sequence
  chemically synthesized
taaaaggcaacagaggaggcga

SEQ ID NO: 42415 - DNA, 22 bp, Artificial Sequence
  chemically synthesized
aaaaggcaacagaggaggcgag

SEQ ID NO: 42416 - DNA, 22 bp, Artificial Sequence
  chemically synthesized
aaaggcaacagaggaggcgagc

SEQ ID NO: 42417 - DNA, 22 bp, Artificial Sequence
  chemically synthesized
aggggtccatgctagcttgggc

SEQ ID NO: 42418 - DNA, 22 bp, Artificial Sequence
  chemically synthesized
gcttgggcaccttatccaccag

SEQ ID NO: 42419 - DNA, 22 bp, Artificial Sequence
  chemically synthesized
gggcaccttatccaccaggtag

SEQ ID NO: 42420 - DNA, 22 bp, Artificial Sequence
  chemically synthesized
ggcaccttatccaccaggtagt

SEQ ID NO: 42421 - DNA, 22 bp, Artificial Sequence
  chemically synthesized
atccaccaggtagttgagcagt

SEQ ID NO: 42422 - DNA, 22 bp, Artificial Sequence
  chemically synthesized
tccaccaggtagttgagcagtt

SEQ ID NO: 42423 - DNA, 22 bp, Artificial Sequence
  chemically synthesized
agcagttgcctgctggtgcctt

SEQ ID NO: 42424 - DNA, 22 bp, Artificial Sequence
  chemically synthesized
cctgctggtgcctttgtgagca

SEQ ID NO: 42425 - DNA, 22 bp, Artificial Sequence
  chemically synthesized
ctggtgcctttgtgagcagggt

SEQ ID NO: 42426 - DNA, 22 bp, Artificial Sequence
  chemically synthesized
gtgcctttgtgagcagggtgtt

SEQ ID NO: 42427 - DNA, 22 bp, Artificial Sequence
  chemically synthesized
tgtgagcagggtgttgtccctt

SEQ ID NO: 42428 - DNA, 22 bp, Artificial Sequence
  chemically synthesized
gtgagcagggtgttgtcccttg

SEQ ID NO: 42429 - DNA, 22 bp, Artificial Sequence
  chemically synthesized
tgagcagggtgttgtcccttga

SEQ ID NO: 42430 - DNA, 22 bp, Artificial Sequence
  chemically synthesized
tcccttgaggcaaatctctgga

SEQ ID NO: 42431 - DNA, 22 bp, Artificial Sequence
  chemically synthesized
gaggcaaatctctggagggtga

SEQ ID NO: 42432 - DNA, 22 bp, Artificial Sequence
  chemically synthesized
aggcaaatctctggagggtgag

SEQ ID NO: 42433 - DNA, 22 bp, Artificial Sequence
  chemically synthesized
tggagggtgagagttttgtagt

SEQ ID NO: 42434 - DNA, 22 bp, Artificial Sequence
  chemically synthesized
gagggtgagagttttgtagtgg

SEQ ID NO: 42435 - DNA, 22 bp, Artificial Sequence
  chemically synthesized
tgtagtgggcatgctttggttt

SEQ ID NO: 42436 - DNA, 22 bp, Artificial Sequence
  chemically synthesized
gtagtgggcatgctttggttta

SEQ ID NO: 42437 - DNA, 22 bp, Artificial Sequence
  chemically synthesized
tagtgggcatgctttggtttat

SEQ ID NO: 42438 - DNA, 22 bp, Artificial Sequence
  chemically synthesized
tggtttataaatcacctgtgaa

SEQ ID NO: 42439 - DNA, 22 bp, Artificial Sequence
  chemically synthesized
ggtttataaatcacctgtgaac

SEQ ID NO: 42440 - DNA, 22 bp, Artificial Sequence
  chemically synthesized
gtttataaatcacctgtgaact

SEQ ID NO: 42441 - DNA, 22 bp, Artificial Sequence
  chemically synthesized
ataaatcacctgtgaactcagg

SEQ ID NO: 42442 - DNA, 22 bp, Artificial Sequence
  chemically synthesized
taaatcacctgtgaactcagga

SEQ ID NO: 42443 - DNA, 22 bp, Artificial Sequence
  chemically synthesized
tgaactcaggagttccatcttg

SEQ ID NO: 42444 - DNA, 22 bp, Artificial Sequence
  chemically synthesized
aggagttccatcttgaagcaca

SEQ ID NO: 42445 - DNA, 22 bp, Artificial Sequence
  chemically synthesized
catcttgaagcacatacatagt

SEQ ID NO: 42446 - DNA, 22 bp, Artificial Sequence
  chemically synthesized
gaagcacatacatagttagatg

SEQ ID NO: 42447 - DNA, 22 bp, Artificial Sequence
  chemically synthesized
aagcacatacatagttagatga

SEQ ID NO: 42448 - DNA, 22 bp, Artificial Sequence
  chemically synthesized
gatgaacttgccctgcagggag

SEQ ID NO: 42449 - DNA, 22 bp, Artificial Sequence
  chemically synthesized
gccctgcagggagagtctgatg

SEQ ID NO: 42450 - DNA, 22 bp, Artificial Sequence
  chemically synthesized
ccctgcagggagagtctgatga

SEQ ID NO: 42451 - DNA, 22 bp, Artificial Sequence
  chemically synthesized
cagggagagtctgatgaaaggg

SEQ ID NO: 42452 - DNA, 22 bp, Artificial Sequence
  chemically synthesized
atgaaagggaggtagatgcttg

SEQ ID NO: 42453 - DNA, 22 bp, Artificial Sequence
  chemically synthesized
gcaatttaatctataaattacc

SEQ ID NO: 42454 - DNA, 22 bp, Artificial Sequence
  chemically synthesized
caatttaatctataaattacca

SEQ ID NO: 42455 - DNA, 22 bp, Artificial Sequence
  chemically synthesized
aatctataaattaccagataaa

SEQ ID NO: 42456 - DNA, 22 bp, Artificial Sequence
  chemically synthesized
atctataaattaccagataaaa

SEQ ID NO: 42457 - DNA, 22 bp, Artificial Sequence
  chemically synthesized
taaattaccagataaaatttta

SEQ ID NO: 42458 - DNA, 22 bp, Artificial Sequence
  chemically synthesized
ccagataaaattttacaagttg

SEQ ID NO: 42459 - DNA, 22 bp, Artificial Sequence
  chemically synthesized
tacaagttgactttaaagtcaa

SEQ ID NO: 42460 - DNA, 22 bp, Artificial Sequence
  chemically synthesized
acaagttgactttaaagtcaaa

SEQ ID NO: 42461 - DNA, 22 bp, Artificial Sequence
  chemically synthesized
caagttgactttaaagtcaaac

SEQ ID NO: 42462 - DNA, 22 bp, Artificial Sequence
  chemically synthesized
actttaaagtcaaacacatttg

SEQ ID NO: 42463 - DNA, 22 bp, Artificial Sequence
  chemically synthesized
taaagtcaaacacatttgaatt

SEQ ID NO: 42464 - DNA, 22 bp, Artificial Sequence
  chemically synthesized
aaagtcaaacacatttgaattt

SEQ ID NO: 42465 - DNA, 22 bp, Artificial Sequence
  chemically synthesized
aagtcaaacacatttgaattta

SEQ ID NO: 42466 - DNA, 22 bp, Artificial Sequence
  chemically synthesized
gaatttagtggaagccattcaa

SEQ ID NO: 42467 - DNA, 22 bp, Artificial Sequence
  chemically synthesized
aatttagtggaagccattcaag

SEQ ID NO: 42468 - DNA, 22 bp, Artificial Sequence
  chemically synthesized
agtggaagccattcaagaaaat

SEQ ID NO: 42469 - DNA, 22 bp, Artificial Sequence
  chemically synthesized
gtggaagccattcaagaaaata

SEQ ID NO: 42470 - DNA, 22 bp, Artificial Sequence
  chemically synthesized
aagaaaatatcaaagaaaatac

SEQ ID NO: 42471 - DNA, 22 bp, Artificial Sequence
  chemically synthesized
agcaaagagttttttggggaaa

SEQ ID NO: 42472 - DNA, 22 bp, Artificial Sequence
  chemically synthesized
tttggggaaattggtgtctatg

SEQ ID NO: 42473 - DNA, 22 bp, Artificial Sequence
  chemically synthesized
ttggggaaattggtgtctatgt

SEQ ID NO: 42474 - DNA, 22 bp, Artificial Sequence
  chemically synthesized
tggggaaattggtgtctatgtc

SEQ ID NO: 42475 - DNA, 22 bp, Artificial Sequence
  chemically synthesized
ggggaaattggtgtctatgtct

SEQ ID NO: 42476 - DNA, 22 bp, Artificial Sequence
  chemically synthesized
gggaaattggtgtctatgtctg

SEQ ID NO: 42477 - DNA, 22 bp, Artificial Sequence
  chemically synthesized
gtgtctatgtctgtgtgtgtag

SEQ ID NO: 42478 - DNA, 22 bp, Artificial Sequence
  chemically synthesized
tgtctgtgtgtgtagggagtgc

SEQ ID NO: 42479 - DNA, 22 bp, Artificial Sequence
  chemically synthesized
tgtgtgtagggagtgcagggga

SEQ ID NO: 42480 - DNA, 22 bp, Artificial Sequence
  chemically synthesized
tatttcagcccatggaaactag

SEQ ID NO: 42481 - DNA, 22 bp, Artificial Sequence
  chemically synthesized
tttcagcccatggaaactagga

SEQ ID NO: 42482 - DNA, 22 bp, Artificial Sequence
  chemically synthesized
cagcccatggaaactaggatgt

SEQ ID NO: 42483 - DNA, 22 bp, Artificial Sequence
  chemically synthesized
agcccatggaaactaggatgta

SEQ ID NO: 42484 - DNA, 22 bp, Artificial Sequence
  chemically synthesized
ggatgtagatcactgtgaactt

SEQ ID NO: 42485 - DNA, 22 bp, Artificial Sequence
  chemically synthesized
tgaacttattcagcaggctaca

SEQ ID NO: 42486 - DNA, 22 bp, Artificial Sequence
  chemically synthesized
attcagcaggctacacccaaag

SEQ ID NO: 42487 - DNA, 22 bp, Artificial Sequence
  chemically synthesized
ttcagcaggctacacccaaagg

SEQ ID NO: 42488 - DNA, 22 bp, Artificial Sequence
  chemically synthesized
agcaggctacacccaaaggcta

SEQ ID NO: 42489 - DNA, 22 bp, Artificial Sequence
  chemically synthesized
cacccaaaggctagaacaaact

SEQ ID NO: 42490 - DNA, 22 bp, Artificial Sequence
  chemically synthesized
gaacaaacttctctgccacagg

SEQ ID NO: 42491 - DNA, 22 bp, Artificial Sequence
  chemically synthesized
ctctgccacaggattaacatat

SEQ ID NO: 42492 - DNA, 22 bp, Artificial Sequence
  chemically synthesized
tctgccacaggattaacatatg

SEQ ID NO: 42493 - DNA, 22 bp, Artificial Sequence
  chemically synthesized
tgccacaggattaacatatgtt

SEQ ID NO: 42494 - DNA, 22 bp, Artificial Sequence
  chemically synthesized
ccacaggattaacatatgtttt

SEQ ID NO: 42495 - DNA, 22 bp, Artificial Sequence
  chemically synthesized
acatatgttttaatcgacctgg

SEQ ID NO: 42496 - DNA, 22 bp, Artificial Sequence
  chemically synthesized
taatcgacctggggggcacatt

SEQ ID NO: 42497 - DNA, 22 bp, Artificial Sequence
  chemically synthesized
aatcgacctggggggcacattc

SEQ ID NO: 42498 - DNA, 22 bp, Artificial Sequence
  chemically synthesized
atcgacctggggggcacattct

SEQ ID NO: 42499 - DNA, 22 bp, Artificial Sequence
  chemically synthesized
gggggcacattctctgataagc

SEQ ID NO: 42500 - DNA, 22 bp, Artificial Sequence
  chemically synthesized
tctgataagctcttttggaaag

SEQ ID NO: 42501 - DNA, 22 bp, Artificial Sequence
  chemically synthesized
tgataagctcttttggaaagcc

SEQ ID NO: 42502 - DNA, 22 bp, Artificial Sequence
  chemically synthesized
ataagctcttttggaaagccag

SEQ ID NO: 42503 - DNA, 22 bp, Artificial Sequence
  chemically synthesized
ttttggaaagccaggctttctg

SEQ ID NO: 42504 - DNA, 22 bp, Artificial Sequence
  chemically synthesized
ttggaaagccaggctttctgtg

SEQ ID NO: 42505 - DNA, 22 bp, Artificial Sequence
  chemically synthesized
tggaaagccaggctttctgtgg

SEQ ID NO: 42506 - DNA, 22 bp, Artificial Sequence
  chemically synthesized
ggaaagccaggctttctgtgga

SEQ ID NO: 42507 - DNA, 22 bp, Artificial Sequence
  chemically synthesized
gaaagccaggctttctgtggac

SEQ ID NO: 42508 - DNA, 22 bp, Artificial Sequence
  chemically synthesized
tctgtggacgtgttatctttcc

SEQ ID NO: 42509 - DNA, 22 bp, Artificial Sequence
  chemically synthesized
ctgtggacgtgttatctttcca

SEQ ID NO: 42510 - DNA, 22 bp, Artificial Sequence
  chemically synthesized
tgtggacgtgttatctttccaa

SEQ ID NO: 42511 - DNA, 22 bp, Artificial Sequence
  chemically synthesized
tggacgtgttatctttccaatg

SEQ ID NO: 42512 - DNA, 22 bp, Artificial Sequence
  chemically synthesized
tctttccaatgtgtgctggaat

SEQ ID NO: 42513 - DNA, 22 bp, Artificial Sequence
  chemically synthesized
tccaatgtgtgctggaatgccc

SEQ ID NO: 42514 - DNA, 22 bp, Artificial Sequence
  chemically synthesized
ccaatgtgtgctggaatgcccg

SEQ ID NO: 42515 - DNA, 22 bp, Artificial Sequence
  chemically synthesized
caatgtgtgctggaatgcccgg

SEQ ID NO: 42516 - DNA, 22 bp, Artificial Sequence
  chemically synthesized
gaatgcccggggagaggaaaaa

SEQ ID NO: 42517 - DNA, 22 bp, Artificial Sequence
  chemically synthesized
cttttacagccatgctcagtga

SEQ ID NO: 42518 - DNA, 22 bp, Artificial Sequence
  chemically synthesized
ttttacagccatgctcagtgag

SEQ ID NO: 42519 - DNA, 22 bp, Artificial Sequence
  chemically synthesized
ttacagccatgctcagtgagaa

SEQ ID NO: 42520 - DNA, 22 bp, Artificial Sequence
  chemically synthesized
tacagccatgctcagtgagaag

SEQ ID NO: 42521 - DNA, 22 bp, Artificial Sequence
  chemically synthesized
acagccatgctcagtgagaagc

SEQ ID NO: 42522 - DNA, 22 bp, Artificial Sequence
  chemically synthesized
cagccatgctcagtgagaagcg

SEQ ID NO: 42523 - DNA, 22 bp, Artificial Sequence
  chemically synthesized
agtgagaagcggagaaacatct

SEQ ID NO: 42524 - DNA, 22 bp, Artificial Sequence
  chemically synthesized
ctattcacaaattgctaagtct

SEQ ID NO: 42525 - DNA, 22 bp, Artificial Sequence
  chemically synthesized
tattcacaaattgctaagtctt

SEQ ID NO: 42526 - DNA, 22 bp, Artificial Sequence
  chemically synthesized
ttcacaaattgctaagtctttt

SEQ ID NO: 42527 - DNA, 22 bp, Artificial Sequence
  chemically synthesized
acaaattgctaagtcttttaca

SEQ ID NO: 42528 - DNA, 22 bp, Artificial Sequence
  chemically synthesized
ctaagtcttttacacatgcaaa

SEQ ID NO: 42529 - DNA, 22 bp, Artificial Sequence
  chemically synthesized
agtcttttacacatgcaaatat

SEQ ID NO: 42530 - DNA, 22 bp, Artificial Sequence
  chemically synthesized
ttacacatgcaaatatgcatac

SEQ ID NO: 42531 - DNA, 22 bp, Artificial Sequence
  chemically synthesized
tacacatgcaaatatgcataca

SEQ ID NO: 42532 - DNA, 22 bp, Artificial Sequence
  chemically synthesized
acacatgcaaatatgcatacac

SEQ ID NO: 42533 - DNA, 22 bp, Artificial Sequence
  chemically synthesized
cacatgcaaatatgcatacaca

SEQ ID NO: 42534 - DNA, 22 bp, Artificial Sequence
  chemically synthesized
acacaccacagtgaggaagaaa

SEQ ID NO: 42535 - DNA, 22 bp, Artificial Sequence
  chemically synthesized
tcacaccattaataaaatacat

SEQ ID NO: 42536 - DNA, 22 bp, Artificial Sequence
  chemically synthesized
acaccattaataaaatacattt

SEQ ID NO: 42537 - DNA, 22 bp, Artificial Sequence
  chemically synthesized
ataaaatacatttacttcagta

SEQ ID NO: 42538 - DNA, 22 bp, Artificial Sequence
  chemically synthesized
acttcagtagcaatatacatct

SEQ ID NO: 42539 - DNA, 22 bp, Artificial Sequence
  chemically synthesized
cttcagtagcaatatacatcta

SEQ ID NO: 42540 - DNA, 22 bp, Artificial Sequence
  chemically synthesized
cagtagcaatatacatctacat

SEQ ID NO: 42541 - DNA, 22 bp, Artificial Sequence
  chemically synthesized
agtagcaatatacatctacatt

SEQ ID NO: 42542 - DNA, 22 bp, Artificial Sequence
  chemically synthesized
cattttgcctataatataaaag

SEQ ID NO: 42543 - DNA, 22 bp, Artificial Sequence
  chemically synthesized
tgcctataatataaaagtattt

SEQ ID NO: 42544 - DNA, 22 bp, Artificial Sequence
  chemically synthesized
gcctataatataaaagtatttt

SEQ ID NO: 42545 - DNA, 22 bp, Artificial Sequence
  chemically synthesized
cctataatataaaagtattttt

SEQ ID NO: 42546 - DNA, 22 bp, Artificial Sequence
  chemically synthesized
taatataaaagtatttttccta

SEQ ID NO: 42547 - DNA, 22 bp, Artificial Sequence
  chemically synthesized
ttcctattaaaagatttgttta

SEQ ID NO: 42548 - DNA, 22 bp, Artificial Sequence
  chemically synthesized
tcctattaaaagatttgtttaa

SEQ ID NO: 42549 - DNA, 22 bp, Artificial Sequence
  chemically synthesized
cctattaaaagatttgtttaat

SEQ ID NO: 42550 - DNA, 22 bp, Artificial Sequence
  chemically synthesized
ctattaaaagatttgtttaatg

SEQ ID NO: 42551 - DNA, 22 bp, Artificial Sequence
  chemically synthesized
ttaaaagatttgtttaatgttt

SEQ ID NO: 42552 - DNA, 22 bp, Artificial Sequence
  chemically synthesized
aaagatttgtttaatgtttctt

SEQ ID NO: 42553 - DNA, 22 bp, Artificial Sequence
  chemically synthesized
gtttaatgtttcttcaccaaca

SEQ ID NO: 42554 - DNA, 22 bp, Artificial Sequence
  chemically synthesized
tttaatgtttcttcaccaacaa

SEQ ID NO: 42555 - DNA, 22 bp, Artificial Sequence
  chemically synthesized
aatgtttcttcaccaacaaata

SEQ ID NO: 42556 - DNA, 22 bp, Artificial Sequence
  chemically synthesized
atgtttcttcaccaacaaataa

SEQ ID NO: 42557 - DNA, 22 bp, Artificial Sequence
  chemically synthesized
cttcaccaacaaataaacccta

SEQ ID NO: 42558 - DNA, 22 bp, Artificial Sequence
  chemically synthesized
ttcaccaacaaataaaccctat

SEQ ID NO: 42559 - DNA, 22 bp, Artificial Sequence
  chemically synthesized
caccaacaaataaaccctatta

SEQ ID NO: 42560 - DNA, 22 bp, Artificial Sequence
  chemically synthesized
accaacaaataaaccctattaa

SEQ ID NO: 42561 - DNA, 22 bp, Artificial Sequence
  chemically synthesized
ttaaatccccattgccatatga

SEQ ID NO: 42562 - DNA, 22 bp, Artificial Sequence
  chemically synthesized
aatccccattgccatatgagcc

SEQ ID NO: 42563 - DNA, 22 bp, Artificial Sequence
  chemically synthesized
ccatatgagccctggaggtgaa

SEQ ID NO: 42564 - DNA, 22 bp, Artificial Sequence
  chemically synthesized
gaggtgaatcagagaaacaaaa

SEQ ID NO: 42565 - DNA, 22 bp, Artificial Sequence
  chemically synthesized
tggaaaaatcatcaggttaaaa

SEQ ID NO: 42566 - DNA, 22 bp, Artificial Sequence
  chemically synthesized
aaaaaagaaaaattgattctgt

SEQ ID NO: 42567 - DNA, 22 bp, Artificial Sequence
  chemically synthesized
attctgttttgggatatttcct

SEQ ID NO: 42568 - DNA, 22 bp, Artificial Sequence
  chemically synthesized
tgttttgggatatttcctagca

SEQ ID NO: 42569 - DNA, 22 bp, Artificial Sequence
  chemically synthesized
ttttgggatatttcctagcaac

SEQ ID NO: 42570 - DNA, 22 bp, Artificial Sequence
  chemically synthesized
tgggatatttcctagcaacatg

SEQ ID NO: 42571 - DNA, 22 bp, Artificial Sequence
  chemically synthesized
gggatatttcctagcaacatga

SEQ ID NO: 42572 - DNA, 22 bp, Artificial Sequence
  chemically synthesized
ggatatttcctagcaacatgag

SEQ ID NO: 42573 - DNA, 22 bp, Artificial Sequence
  chemically synthesized
cctagcaacatgagctggggag

SEQ ID NO: 42574 - DNA, 22 bp, Artificial Sequence
  chemically synthesized
ctagcaacatgagctggggagg

SEQ ID NO: 42575 - DNA, 22 bp, Artificial Sequence
  chemically synthesized
gcaacatgagctggggagggga

SEQ ID NO: 42576 - DNA, 22 bp, Artificial Sequence
  chemically synthesized
gggaggggatctcagcagtgat

SEQ ID NO: 42577 - DNA, 22 bp, Artificial Sequence
  chemically synthesized
agcagtgatgctctatgaagca

SEQ ID NO: 42578 - DNA, 22 bp, Artificial Sequence
  chemically synthesized
tatgaagcataataaaatgaca

SEQ ID NO: 42579 - DNA, 22 bp, Artificial Sequence
  chemically synthesized
tgaagcataataaaatgacaca

SEQ ID NO: 42580 - DNA, 22 bp, Artificial Sequence
  chemically synthesized
caggtaacttagttaaaggggg

SEQ ID NO: 42581 - DNA, 22 bp, Artificial Sequence
  chemically synthesized
agttaaagggggaaataaatgg

SEQ ID NO: 42582 - DNA, 22 bp, Artificial Sequence
  chemically synthesized
gttaaagggggaaataaatgga

SEQ ID NO: 42583 - DNA, 22 bp, Artificial Sequence
  chemically synthesized
aagggggaaataaatggaagtt

SEQ ID NO: 42584 - DNA, 22 bp, Artificial Sequence
  chemically synthesized
cctctttttgaatatcaattgt

SEQ ID NO: 42585 - DNA, 22 bp, Artificial Sequence
  chemically synthesized
ctctttttgaatatcaattgta

SEQ ID NO: 42586 - DNA, 22 bp, Artificial Sequence
  chemically synthesized
tttttgaatatcaattgtagcc

SEQ ID NO: 42587 - DNA, 22 bp, Artificial Sequence
  chemically synthesized
tttgaatatcaattgtagcctg

SEQ ID NO: 42588 - DNA, 22 bp, Artificial Sequence
  chemically synthesized
ttgaatatcaattgtagcctgc

SEQ ID NO: 42589 - DNA, 22 bp, Artificial Sequence
  chemically synthesized
tgaatatcaattgtagcctgct

SEQ ID NO: 42590 - DNA, 22 bp, Artificial Sequence
  chemically synthesized
gaatatcaattgtagcctgctc

SEQ ID NO: 42591 - DNA, 22 bp, Artificial Sequence
  chemically synthesized
aatatcaattgtagcctgctct

SEQ ID NO: 42592 - DNA, 22 bp, Artificial Sequence
  chemically synthesized
tagcctgctctgctacatttca

SEQ ID NO: 42593 - DNA, 22 bp, Artificial Sequence
  chemically synthesized
ctctgctacatttcaaaaacac

SEQ ID NO: 42594 - DNA, 22 bp, Artificial Sequence
  chemically synthesized
tgctacatttcaaaaacactct

SEQ ID NO: 42595 - DNA, 22 bp, Artificial Sequence
  chemically synthesized
ctacatttcaaaaacactcttc

SEQ ID NO: 42596 - DNA, 22 bp, Artificial Sequence
  chemically synthesized
catttcaaaaacactcttcaaa

SEQ ID NO: 42597 - DNA, 22 bp, Artificial Sequence
  chemically synthesized
caaaaacactcttcaaaatgtt

SEQ ID NO: 42598 - DNA, 22 bp, Artificial Sequence
  chemically synthesized
aaaaacactcttcaaaatgttt

SEQ ID NO: 42599 - DNA, 22 bp, Artificial Sequence
  chemically synthesized
ttcaaaatgtttaactgaactc

SEQ ID NO: 42600 - DNA, 22 bp, Artificial Sequence
  chemically synthesized
caaaatgtttaactgaactcac

SEQ ID NO: 42601 - DNA, 22 bp, Artificial Sequence
  chemically synthesized
aaaatgtttaactgaactcact

SEQ ID NO: 42602 - DNA, 22 bp, Artificial Sequence
  chemically synthesized
aactgaactcactgtaggaagc

SEQ ID NO: 42603 - DNA, 22 bp, Artificial Sequence
  chemically synthesized
actgaactcactgtaggaagca

SEQ ID NO: 42604 - DNA, 22 bp, Artificial Sequence
  chemically synthesized
aactcactgtaggaagcacctt

SEQ ID NO: 42605 - DNA, 22 bp, Artificial Sequence
  chemically synthesized
actgtaggaagcaccttattaa

SEQ ID NO: 42606 - DNA, 22 bp, Artificial Sequence
  chemically synthesized
taggaagcaccttattaattta

SEQ ID NO: 42607 - DNA, 22 bp, Artificial Sequence
  chemically synthesized
attaatttattgtgtgttttga

SEQ ID NO: 42608 - DNA, 22 bp, Artificial Sequence
  chemically synthesized
ttaatttattgtgtgttttgaa

SEQ ID NO: 42609 - DNA, 22 bp, Artificial Sequence
  chemically synthesized
atttattgtgtgttttgaagtc

SEQ ID NO: 42610 - DNA, 22 bp, Artificial Sequence
  chemically synthesized
attgtgtgttttgaagtcacac

SEQ ID NO: 42611 - DNA, 22 bp, Artificial Sequence
  chemically synthesized
ttgtgtgttttgaagtcacact

SEQ ID NO: 42612 - DNA, 22 bp, Artificial Sequence
  chemically synthesized
tgtgttttgaagtcacactgtg

SEQ ID NO: 42613 - DNA, 22 bp, Artificial Sequence
  chemically synthesized
tgaagtcacactgtgagctata

SEQ ID NO: 42614 - DNA, 22 bp, Artificial Sequence
  chemically synthesized
gaagtcacactgtgagctatag

SEQ ID NO: 42615 - DNA, 22 bp, Artificial Sequence
  chemically synthesized
aagtcacactgtgagctataga

SEQ ID NO: 42616 - DNA, 22 bp, Artificial Sequence
  chemically synthesized
tgagctatagaatttacccaag

SEQ ID NO: 42617 - DNA, 22 bp, Artificial Sequence
  chemically synthesized
tagaatttacccaagcacaact

SEQ ID NO: 42618 - DNA, 22 bp, Artificial Sequence
  chemically synthesized
acccaagcacaactcttcctgg

SEQ ID NO: 42619 - DNA, 22 bp, Artificial Sequence
  chemically synthesized
cccaagcacaactcttcctgga

SEQ ID NO: 42620 - DNA, 22 bp, Artificial Sequence
  chemically synthesized
ttcctggaaaagagagttcaaa

SEQ ID NO: 42621 - DNA, 22 bp, Artificial Sequence
  chemically synthesized
cctggaaaagagagttcaaatg

SEQ ID NO: 42622 - DNA, 22 bp, Artificial Sequence
  chemically synthesized
ctggaaaagagagttcaaatga

SEQ ID NO: 42623 - DNA, 22 bp, Artificial Sequence
  chemically synthesized
gaaaagagagttcaaatgagaa

SEQ ID NO: 42624 - DNA, 22 bp, Artificial Sequence
  chemically synthesized
aaatgagaaacagtgcggggtg

SEQ ID NO: 42625 - DNA, 22 bp, Artificial Sequence
  chemically synthesized
aaatatctatttctcaatgata

SEQ ID NO: 42626 - DNA, 22 bp, Artificial Sequence
  chemically synthesized
tttctcaatgatattttgatat

SEQ ID NO: 42627 - DNA, 22 bp, Artificial Sequence
  chemically synthesized
ctcaatgatattttgatatatc

SEQ ID NO: 42628 - DNA, 22 bp, Artificial Sequence
  chemically synthesized
tcaatgatattttgatatatct

SEQ ID NO: 42629 - DNA, 22 bp, Artificial Sequence
  chemically synthesized
aatgatattttgatatatctat

SEQ ID NO: 42630 - DNA, 22 bp, Artificial Sequence
  chemically synthesized
tgatatatctatcaagtgcttt

SEQ ID NO: 42631 - DNA, 22 bp, Artificial Sequence
  chemically synthesized
gatatatctatcaagtgctttt

SEQ ID NO: 42632 - DNA, 22 bp, Artificial Sequence
  chemically synthesized
atatatctatcaagtgcttttt

SEQ ID NO: 42633 - DNA, 22 bp, Artificial Sequence
  chemically synthesized
tcaagtgctttttagtggatta

SEQ ID NO: 42634 - DNA, 22 bp, Artificial Sequence
  chemically synthesized
tttagtggattaggttcagaat

SEQ ID NO: 42635 - DNA, 22 bp, Artificial Sequence
  chemically synthesized
ttagtggattaggttcagaatg

SEQ ID NO: 42636 - DNA, 22 bp, Artificial Sequence
  chemically synthesized
tagtggattaggttcagaatgc

SEQ ID NO: 42637 - DNA, 22 bp, Artificial Sequence
  chemically synthesized
agtggattaggttcagaatgca

SEQ ID NO: 42638 - DNA, 22 bp, Artificial Sequence
  chemically synthesized
gtggattaggttcagaatgcat

SEQ ID NO: 42639 - DNA, 22 bp, Artificial Sequence
  chemically synthesized
ggttcagaatgcatcagccaat

SEQ ID NO: 42640 - DNA, 22 bp, Artificial Sequence
  chemically synthesized
agaatgcatcagccaatgcctg

SEQ ID NO: 42641 - DNA, 22 bp, Artificial Sequence
  chemically synthesized
ttcaataatccagttttccagc

SEQ ID NO: 42642 - DNA, 22 bp, Artificial Sequence
  chemically synthesized
aataatccagttttccagcata

SEQ ID NO: 42643 - DNA, 22 bp, Artificial Sequence
  chemically synthesized
tccagcatagagcatattaaat

SEQ ID NO: 42644 - DNA, 22 bp, Artificial Sequence
  chemically synthesized
ccagcatagagcatattaaatt

SEQ ID NO: 42645 - DNA, 22 bp, Artificial Sequence
  chemically synthesized
cagcatagagcatattaaattg

SEQ ID NO: 42646 - DNA, 22 bp, Artificial Sequence
  chemically synthesized
aattgaggaaggacaaagtcac

SEQ ID NO: 42647 - DNA, 22 bp, Artificial Sequence
  chemically synthesized
aggaaggacaaagtcacagagg

SEQ ID NO: 42648 - DNA, 22 bp, Artificial Sequence
  chemically synthesized
tggccaaggactttgcatgaaa

SEQ ID NO: 42649 - DNA, 22 bp, Artificial Sequence
  chemically synthesized
tgcatgaaacagtgagcgtgca

SEQ ID NO: 42650 - DNA, 22 bp, Artificial Sequence
  chemically synthesized
gcatgaaacagtgagcgtgcat

SEQ ID NO: 42651 - DNA, 22 bp, Artificial Sequence
  chemically synthesized
catgaaacagtgagcgtgcatc

SEQ ID NO: 42652 - DNA, 22 bp, Artificial Sequence
  chemically synthesized
ctccttgccctgccctcatggt

SEQ ID NO: 42653 - DNA, 22 bp, Artificial Sequence
  chemically synthesized
cttgccctgccctcatggtctg

SEQ ID NO: 42654 - DNA, 22 bp, Artificial Sequence
  chemically synthesized
gccctgccctcatggtctgtgt

SEQ ID NO: 42655 - DNA, 22 bp, Artificial Sequence
  chemically synthesized
ccctgccctcatggtctgtgta

SEQ ID NO: 42656 - DNA, 22 bp, Artificial Sequence
  chemically synthesized
ccctcatggtctgtgtactctc

SEQ ID NO: 42657 - DNA, 22 bp, Artificial Sequence
  chemically synthesized
atggtctgtgtactctcaggag

SEQ ID NO: 42658 - DNA, 22 bp, Artificial Sequence
  chemically synthesized
tgtactctcaggaggtcaggac

SEQ ID NO: 42659 - DNA, 22 bp, Artificial Sequence
  chemically synthesized
tcaggaggtcaggacaggcctt

SEQ ID NO: 42660 - DNA, 22 bp, Artificial Sequence
  chemically synthesized
aggaggtcaggacaggcctttc

SEQ ID NO: 42661 - DNA, 22 bp, Artificial Sequence
  chemically synthesized
tctgagaatgagaatctgttca

SEQ ID NO: 42662 - DNA, 22 bp, Artificial Sequence
  chemically synthesized
ctgagaatgagaatctgttcat

SEQ ID NO: 42663 - DNA, 22 bp, Artificial Sequence
  chemically synthesized
tgagaatgagaatctgttcatc

SEQ ID NO: 42664 - DNA, 22 bp, Artificial Sequence
  chemically synthesized
agaatgagaatctgttcatctg

SEQ ID NO: 42665 - DNA, 22 bp, Artificial Sequence
  chemically synthesized
ttcatctgcctttctactggat

SEQ ID NO: 42666 - DNA, 22 bp, Artificial Sequence
  chemically synthesized
atctgcctttctactggatact

SEQ ID NO: 42667 - DNA, 22 bp, Artificial Sequence
  chemically synthesized
cctttctactggatacttgtca

SEQ ID NO: 42668 - DNA, 22 bp, Artificial Sequence
  chemically synthesized
tctactggatacttgtcatcgg

SEQ ID NO: 42669 - DNA, 22 bp, Artificial Sequence
  chemically synthesized
ctactggatacttgtcatcggc

SEQ ID NO: 42670 - DNA, 22 bp, Artificial Sequence
  chemically synthesized
tactggatacttgtcatcggca

SEQ ID NO: 42671 - DNA, 22 bp, Artificial Sequence
  chemically synthesized
ctggatacttgtcatcggcata

SEQ ID NO: 42672 - DNA, 22 bp, Artificial Sequence
  chemically synthesized
gatacttgtcatcggcatacaa

SEQ ID NO: 42673 - DNA, 22 bp, Artificial Sequence
  chemically synthesized
gtcatcggcatacaaacacatg

SEQ ID NO: 42674 - DNA, 22 bp, Artificial Sequence
  chemically synthesized
tcatcggcatacaaacacatgt

SEQ ID NO: 42675 - DNA, 22 bp, Artificial Sequence
  chemically synthesized
tctgcagtgtgtcatctttcag

SEQ ID NO: 42676 - DNA, 22 bp, Artificial Sequence
  chemically synthesized
tgcagtgtgtcatctttcagaa

SEQ ID NO: 42677 - DNA, 22 bp, Artificial Sequence
  chemically synthesized
cagtgtgtcatctttcagaacc

SEQ ID NO: 42678 - DNA, 22 bp, Artificial Sequence
  chemically synthesized
tcagaacctcccctgaccctgt

SEQ ID NO: 42679 - DNA, 22 bp, Artificial Sequence
  chemically synthesized
cagaacctcccctgaccctgta

SEQ ID NO: 42680 - DNA, 22 bp, Artificial Sequence
  chemically synthesized
agaacctcccctgaccctgtat

SEQ ID NO: 42681 - DNA, 22 bp, Artificial Sequence
  chemically synthesized
ccctgaccctgtattccctaga

SEQ ID NO: 42682 - DNA, 22 bp, Artificial Sequence
  chemically synthesized
accctgtattccctagaagtct

SEQ ID NO: 42683 - DNA, 22 bp, Artificial Sequence
  chemically synthesized
tattccctagaagtctcgctgc

SEQ ID NO: 42684 - DNA, 22 bp, Artificial Sequence
  chemically synthesized
cctagaagtctcgctgctttca

SEQ ID NO: 42685 - DNA, 22 bp, Artificial Sequence
  chemically synthesized
gaagtctcgctgctttcagagc

SEQ ID NO: 42686 - DNA, 22 bp, Artificial Sequence
  chemically synthesized
gctgctttcagagccaggcttc

SEQ ID NO: 42687 - DNA, 22 bp, Artificial Sequence
  chemically synthesized
ctttcagagccaggcttctctc

SEQ ID NO: 42688 - DNA, 22 bp, Artificial Sequence
  chemically synthesized
tcagagccaggcttctctcctg

SEQ ID NO: 42689 - DNA, 22 bp, Artificial Sequence
  chemically synthesized
cagagccaggcttctctcctgc

SEQ ID NO: 42690 - DNA, 22 bp, Artificial Sequence
  chemically synthesized
agagccaggcttctctcctgct

SEQ ID NO: 42691 - DNA, 22 bp, Artificial Sequence
  chemically synthesized
ctctcctgctgccacccccact

SEQ ID NO: 42692 - DNA, 22 bp, Artificial Sequence
  chemically synthesized
tctcctgctgccacccccactg

SEQ ID NO: 42693 - DNA, 22 bp, Artificial Sequence
  chemically synthesized
tcctgctgccacccccactgct

SEQ ID NO: 42694 - DNA, 22 bp, Artificial Sequence
  chemically synthesized
ctgctgccacccccactgctct

SEQ ID NO: 42695 - DNA, 22 bp, Artificial Sequence
  chemically synthesized
ctgccacccccactgctcttct

SEQ ID NO: 42696 - DNA, 22 bp, Artificial Sequence
  chemically synthesized
ccacccccactgctcttctagt

SEQ ID NO: 42697 - DNA, 22 bp, Artificial Sequence
  chemically synthesized
ctcttctagtcactctttaacc

SEQ ID NO: 42698 - DNA, 22 bp, Artificial Sequence
  chemically synthesized
ttctagtcactctttaacccac

SEQ ID NO: 42699 - DNA, 22 bp, Artificial Sequence
  chemically synthesized
ctagtcactctttaacccactc

SEQ ID NO: 42700 - DNA, 22 bp, Artificial Sequence
  chemically synthesized
tagtcactctttaacccactcc

SEQ ID NO: 42701 - DNA, 22 bp, Artificial Sequence
  chemically synthesized
gtcactctttaacccactccat

SEQ ID NO: 42702 - DNA, 22 bp, Artificial Sequence
  chemically synthesized
tttaacccactccatctgcatg

SEQ ID NO: 42703 - DNA, 22 bp, Artificial Sequence
  chemically synthesized
taacccactccatctgcatgtg

SEQ ID NO: 42704 - DNA, 22 bp, Artificial Sequence
  chemically synthesized
aacccactccatctgcatgtgg

SEQ ID NO: 42705 - DNA, 22 bp, Artificial Sequence
  chemically synthesized
acccactccatctgcatgtggc

SEQ ID NO: 42706 - DNA, 22 bp, Artificial Sequence
  chemically synthesized
catctgcatgtggcccccacca

SEQ ID NO: 42707 - DNA, 22 bp, Artificial Sequence
  chemically synthesized
catgtggcccccaccacacccc

SEQ ID NO: 42708 - DNA, 22 bp, Artificial Sequence
  chemically synthesized
aaagtggtcaaggttgtcctgt

SEQ ID NO: 42709 - DNA, 22 bp, Artificial Sequence
  chemically synthesized
tcctgttgcttaattccatgga

SEQ ID NO: 42710 - DNA, 22 bp, Artificial Sequence
  chemically synthesized
ttgcttaattccatggaagctt

SEQ ID NO: 42711 - DNA, 22 bp, Artificial Sequence
  chemically synthesized
cttaattccatggaagcttggc

SEQ ID NO: 42712 - DNA, 22 bp, Artificial Sequence
  chemically synthesized
aattccatggaagcttggctat

SEQ ID NO: 42713 - DNA, 22 bp, Artificial Sequence
  chemically synthesized
attccatggaagcttggctatc

SEQ ID NO: 42714 - DNA, 22 bp, Artificial Sequence
  chemically synthesized
catggaagcttggctatcttca

SEQ ID NO: 42715 - DNA, 22 bp, Artificial Sequence
  chemically synthesized
ggctatcttcattttattagcc

SEQ ID NO: 42716 - DNA, 22 bp, Artificial Sequence
  chemically synthesized
gctatcttcattttattagcct

SEQ ID NO: 42717 - DNA, 22 bp, Artificial Sequence
  chemically synthesized
tcttcattttattagcctcttt

SEQ ID NO: 42718 - DNA, 22 bp, Artificial Sequence
  chemically synthesized
cattttattagcctcttttggc

SEQ ID NO: 42719 - DNA, 22 bp, Artificial Sequence
  chemically synthesized
attttattagcctcttttggcc

SEQ ID NO: 42720 - DNA, 22 bp, Artificial Sequence
  chemically synthesized
tattagcctcttttggcctctc

SEQ ID NO: 42721 - DNA, 22 bp, Artificial Sequence
  chemically synthesized
attagcctcttttggcctctca

SEQ ID NO: 42722 - DNA, 22 bp, Artificial Sequence
  chemically synthesized
ttagcctcttttggcctctcac

SEQ ID NO: 42723 - DNA, 22 bp, Artificial Sequence
  chemically synthesized
gcctcttttggcctctcaccct

SEQ ID NO: 42724 - DNA, 22 bp, Artificial Sequence
  chemically synthesized
ttttggcctctcaccctgtgaa

SEQ ID NO: 42725 - DNA, 22 bp, Artificial Sequence
  chemically synthesized
ttggcctctcaccctgtgaaaa

SEQ ID NO: 42726 - DNA, 22 bp, Artificial Sequence
  chemically synthesized
tggcctctcaccctgtgaaaat

SEQ ID NO: 42727 - DNA, 22 bp, Artificial Sequence
  chemically synthesized
ggcctctcaccctgtgaaaatc

SEQ ID NO: 42728 - DNA, 22 bp, Artificial Sequence
  chemically synthesized
gcctctcaccctgtgaaaatca

SEQ ID NO: 42729 - DNA, 22 bp, Artificial Sequence
  chemically synthesized
tcaccctgtgaaaatcactaca

SEQ ID NO: 42730 - DNA, 22 bp, Artificial Sequence
  chemically synthesized
accctgtgaaaatcactacatt

SEQ ID NO: 42731 - DNA, 22 bp, Artificial Sequence
  chemically synthesized
tgaaaatcactacattttgtgc

SEQ ID NO: 42732 - DNA, 22 bp, Artificial Sequence
  chemically synthesized
cattttgtgccagagatggagc

SEQ ID NO: 42733 - DNA, 22 bp, Artificial Sequence
  chemically synthesized
tgtgccagagatggagctggca

SEQ ID NO: 42734 - DNA, 22 bp, Artificial Sequence
  chemically synthesized
gtgccagagatggagctggcat

SEQ ID NO: 42735 - DNA, 22 bp, Artificial Sequence
  chemically synthesized
tgccagagatggagctggcatc

SEQ ID NO: 42736 - DNA, 22 bp, Artificial Sequence
  chemically synthesized
gcatctccaggcttggaagagg

SEQ ID NO: 42737 - DNA, 22 bp, Artificial Sequence
  chemically synthesized
caggcttggaagagggctgctg

SEQ ID NO: 42738 - DNA, 22 bp, Artificial Sequence
  chemically synthesized
ggaagagggctgctgaagctca

SEQ ID NO: 42739 - DNA, 22 bp, Artificial Sequence
  chemically synthesized
gaagagggctgctgaagctcag

SEQ ID NO: 42740 - DNA, 22 bp, Artificial Sequence
  chemically synthesized
ctgaagctcagccaggtgtcct

SEQ ID NO: 42741 - DNA, 22 bp, Artificial Sequence
  chemically synthesized
aagctcagccaggtgtcctaag

SEQ ID NO: 42742 - DNA, 22 bp, Artificial Sequence
  chemically synthesized
agccaggtgtcctaaggagcct

SEQ ID NO: 42743 - DNA, 22 bp, Artificial Sequence
  chemically synthesized
aggagcctcaggacaggggatg

SEQ ID NO: 42744 - DNA, 22 bp, Artificial Sequence
  chemically synthesized
aggacaggggatgctcagtagc

SEQ ID NO: 42745 - DNA, 22 bp, Artificial Sequence
  chemically synthesized
agtagccttgcaatgggaacac

SEQ ID NO: 42746 - DNA, 22 bp, Artificial Sequence
  chemically synthesized
gcaatgggaacacagctgagcc

SEQ ID NO: 42747 - DNA, 22 bp, Artificial Sequence
  chemically synthesized
caatgggaacacagctgagccc

SEQ ID NO: 42748 - DNA, 22 bp, Artificial Sequence
  chemically synthesized
agccccacttggccaccctttg

SEQ ID NO: 42749 - DNA, 22 bp, Artificial Sequence
  chemically synthesized
ggccaccctttgccacaaccag

SEQ ID NO: 42750 - DNA, 22 bp, Artificial Sequence
  chemically synthesized
gccaccctttgccacaaccagg

SEQ ID NO: 42751 - DNA, 22 bp, Artificial Sequence
  chemically synthesized
tgccacaaccaggcagaaagca

SEQ ID NO: 42752 - DNA, 22 bp, Artificial Sequence
  chemically synthesized
gccacaaccaggcagaaagcag

SEQ ID NO: 42753 - DNA, 22 bp, Artificial Sequence
  chemically synthesized
ccacaaccaggcagaaagcagc

SEQ ID NO: 42754 - DNA, 22 bp, Artificial Sequence
  chemically synthesized
ttgaacagatttgttgcctcag

SEQ ID NO: 42755 - DNA, 22 bp, Artificial Sequence
  chemically synthesized
tgaacagatttgttgcctcaga

SEQ ID NO: 42756 - DNA, 22 bp, Artificial Sequence
  chemically synthesized
gaacagatttgttgcctcagat

SEQ ID NO: 42757 - DNA, 22 bp, Artificial Sequence
  chemically synthesized
aacagatttgttgcctcagatt

SEQ ID NO: 42758 - DNA, 22 bp, Artificial Sequence
  chemically synthesized
gttgcctcagatttgatctcaa

SEQ ID NO: 42759 - DNA, 22 bp, Artificial Sequence
  chemically synthesized
ttgcctcagatttgatctcaaa

SEQ ID NO: 42760 - DNA, 22 bp, Artificial Sequence
  chemically synthesized
cctcagatttgatctcaaagaa

SEQ ID NO: 42761 - DNA, 22 bp, Artificial Sequence
  chemically synthesized
agatttgatctcaaagaaaaat

SEQ ID NO: 42762 - DNA, 22 bp, Artificial Sequence
  chemically synthesized
gatctcaaagaaaaatcgtggg

SEQ ID NO: 42763 - DNA, 22 bp, Artificial Sequence
  chemically synthesized
atctcaaagaaaaatcgtgggc

SEQ ID NO: 42764 - DNA, 22 bp, Artificial Sequence
  chemically synthesized
aaagaaaaatcgtgggcagtat

SEQ ID NO: 42765 - DNA, 22 bp, Artificial Sequence
  chemically synthesized
gtcccaggttctgcttttttac

SEQ ID NO: 42766 - DNA, 22 bp, Artificial Sequence
  chemically synthesized
tgcttttttacaatttcctctg

SEQ ID NO: 42767 - DNA, 22 bp, Artificial Sequence
  chemically synthesized
cttttttacaatttcctctgaa

SEQ ID NO: 42768 - DNA, 22 bp, Artificial Sequence
  chemically synthesized
ttttacaatttcctctgaaatc

SEQ ID NO: 42769 - DNA, 22 bp, Artificial Sequence
  chemically synthesized
tttacaatttcctctgaaatct

SEQ ID NO: 42770 - DNA, 22 bp, Artificial Sequence
  chemically synthesized
ttacaatttcctctgaaatctg

SEQ ID NO: 42771 - DNA, 22 bp, Artificial Sequence
  chemically synthesized
tacaatttcctctgaaatctgg

SEQ ID NO: 42772 - DNA, 22 bp, Artificial Sequence
  chemically synthesized
acaatttcctctgaaatctgga

SEQ ID NO: 42773 - DNA, 22 bp, Artificial Sequence
  chemically synthesized
caatttcctctgaaatctggat

SEQ ID NO: 42774 - DNA, 22 bp, Artificial Sequence
  chemically synthesized
cctctgaaatctggatgcctat

SEQ ID NO: 42775 - DNA, 22 bp, Artificial Sequence
  chemically synthesized
ctctgaaatctggatgcctatc

SEQ ID NO: 42776 - DNA, 22 bp, Artificial Sequence
  chemically synthesized
tgaaatctggatgcctatcaac

SEQ ID NO: 42777 - DNA, 22 bp, Artificial Sequence
  chemically synthesized
aaatctggatgcctatcaacac

SEQ ID NO: 42778 - DNA, 22 bp, Artificial Sequence
  chemically synthesized
gatgcctatcaacaccttggaa

SEQ ID NO: 42779 - DNA, 22 bp, Artificial Sequence
  chemically synthesized
tcaacaccttggaaaaactgaa

SEQ ID NO: 42780 - DNA, 22 bp, Artificial Sequence
  chemically synthesized
ggaaaaactgaattctccccaa

SEQ ID NO: 42781 - DNA, 22 bp, Artificial Sequence
  chemically synthesized
gaaaaactgaattctccccaac

SEQ ID NO: 42782 - DNA, 22 bp, Artificial Sequence
  chemically synthesized
aattctccccaactaatagtgg

SEQ ID NO: 42783 - DNA, 22 bp, Artificial Sequence
  chemically synthesized
tccccaactaatagtggtgtgt

SEQ ID NO: 42784 - DNA, 22 bp, Artificial Sequence
  chemically synthesized
cccaactaatagtggtgtgtca

SEQ ID NO: 42785 - DNA, 22 bp, Artificial Sequence
  chemically synthesized
atagtggtgtgtcactgtagta

SEQ ID NO: 42786 - DNA, 22 bp, Artificial Sequence
  chemically synthesized
tagtaagcctagtacaaaaatg

SEQ ID NO: 42787 - DNA, 22 bp, Artificial Sequence
  chemically synthesized
gtacaaaaatggccttctttgt

SEQ ID NO: 42788 - DNA, 22 bp, Artificial Sequence
  chemically synthesized
ctttgtggaggagcttcatatc

SEQ ID NO: 42789 - DNA, 22 bp, Artificial Sequence
  chemically synthesized
tttgtggaggagcttcatatcc

SEQ ID NO: 42790 - DNA, 22 bp, Artificial Sequence
  chemically synthesized
tgtggaggagcttcatatcctc

SEQ ID NO: 42791 - DNA, 22 bp, Artificial Sequence
  chemically synthesized
gtggaggagcttcatatcctcc

SEQ ID NO: 42792 - DNA, 22 bp, Artificial Sequence
  chemically synthesized
tggaggagcttcatatcctcca

SEQ ID NO: 42793 - DNA, 22 bp, Artificial Sequence
  chemically synthesized
catatcctccattttttttttg

SEQ ID NO: 42794 - DNA, 22 bp, Artificial Sequence
  chemically synthesized
atatcctccattttttttttgc

SEQ ID NO: 42795 - DNA, 22 bp, Artificial Sequence
  chemically synthesized
cattttttttttgcttaatttt

SEQ ID NO: 42796 - DNA, 22 bp, Artificial Sequence
  chemically synthesized
tttttttgcttaatttttgccc

SEQ ID NO: 42797 - DNA, 22 bp, Artificial Sequence
  chemically synthesized
ttttttgcttaatttttgccca

SEQ ID NO: 42798 - DNA, 22 bp, Artificial Sequence
  chemically synthesized
tttttgcttaatttttgcccaa

SEQ ID NO: 42799 - DNA, 22 bp, Artificial Sequence
  chemically synthesized
ttttgcttaatttttgcccaag

SEQ ID NO: 42800 - DNA, 22 bp, Artificial Sequence
  chemically synthesized
tttgcttaatttttgcccaaga

SEQ ID NO: 42801 - DNA, 22 bp, Artificial Sequence
  chemically synthesized
ttgcttaatttttgcccaagat

SEQ ID NO: 42802 - DNA, 22 bp, Artificial Sequence
  chemically synthesized
tgcttaatttttgcccaagatg

SEQ ID NO: 42803 - DNA, 22 bp, Artificial Sequence
  chemically synthesized
gcttaatttttgcccaagatga

SEQ ID NO: 42804 - DNA, 22 bp, Artificial Sequence
  chemically synthesized
cttaatttttgcccaagatgag

SEQ ID NO: 42805 - DNA, 22 bp, Artificial Sequence
  chemically synthesized
aatttttgcccaagatgagaac

SEQ ID NO: 42806 - DNA, 22 bp, Artificial Sequence
  chemically synthesized
atttttgcccaagatgagaaca

SEQ ID NO: 42807 - DNA, 22 bp, Artificial Sequence
  chemically synthesized
ttgcccaagatgagaacataat

SEQ ID NO: 42808 - DNA, 22 bp, Artificial Sequence
  chemically synthesized
tgcccaagatgagaacataatt

SEQ ID NO: 42809 - DNA, 22 bp, Artificial Sequence
  chemically synthesized
gcccaagatgagaacataattt

SEQ ID NO: 42810 - DNA, 22 bp, Artificial Sequence
  chemically synthesized
cccaagatgagaacataattta

SEQ ID NO: 42811 - DNA, 22 bp, Artificial Sequence
  chemically synthesized
agttcactttttatttattccc

SEQ ID NO: 42812 - DNA, 22 bp, Artificial Sequence
  chemically synthesized
gttcactttttatttattccca

SEQ ID NO: 42813 - DNA, 22 bp, Artificial Sequence
  chemically synthesized
actttttatttattcccaacat

SEQ ID NO: 42814 - DNA, 22 bp, Artificial Sequence
  chemically synthesized
tttatttattcccaacatcatc

SEQ ID NO: 42815 - DNA, 22 bp, Artificial Sequence
  chemically synthesized
ttatttattcccaacatcatcc

SEQ ID NO: 42816 - DNA, 22 bp, Artificial Sequence
  chemically synthesized
tatttattcccaacatcatcca

SEQ ID NO: 42817 - DNA, 22 bp, Artificial Sequence
  chemically synthesized
atttattcccaacatcatccat

SEQ ID NO: 42818 - DNA, 22 bp, Artificial Sequence
  chemically synthesized
tttattcccaacatcatccatg

SEQ ID NO: 42819 - DNA, 22 bp, Artificial Sequence
  chemically synthesized
attcccaacatcatccatgcac

SEQ ID NO: 42820 - DNA, 22 bp, Artificial Sequence
  chemically synthesized
ttcccaacatcatccatgcacc

SEQ ID NO: 42821 - DNA, 22 bp, Artificial Sequence
  chemically synthesized
ccaacatcatccatgcaccaac

SEQ ID NO: 42822 - DNA, 22 bp, Artificial Sequence
  chemically synthesized
ttgtaactaaaggagggaccat

SEQ ID NO: 42823 - DNA, 22 bp, Artificial Sequence
  chemically synthesized
tgtaactaaaggagggaccatt

SEQ ID NO: 42824 - DNA, 22 bp, Artificial Sequence
  chemically synthesized
gtaactaaaggagggaccattc

SEQ ID NO: 42825 - DNA, 22 bp, Artificial Sequence
  chemically synthesized
taactaaaggagggaccattca

SEQ ID NO: 42826 - DNA, 22 bp, Artificial Sequence
  chemically synthesized
aaggagggaccattcagaagat

SEQ ID NO: 42827 - DNA, 22 bp, Artificial Sequence
  chemically synthesized
agaagatgcttatcaactgtca

SEQ ID NO: 42828 - DNA, 22 bp, Artificial Sequence
  chemically synthesized
atcaactgtcaaagtgacagtg

SEQ ID NO: 42829 - DNA, 22 bp, Artificial Sequence
  chemically synthesized
tcaactgtcaaagtgacagtgt

SEQ ID NO: 42830 - DNA, 22 bp, Artificial Sequence
  chemically synthesized
tcaaagtgacagtgttacaacc

SEQ ID NO: 42831 - DNA, 22 bp, Artificial Sequence
  chemically synthesized
caaccaatgcacatattgtaag

SEQ ID NO: 42832 - DNA, 22 bp, Artificial Sequence
  chemically synthesized
taagaaatcaaacaatggcctc

SEQ ID NO: 42833 - DNA, 22 bp, Artificial Sequence
  chemically synthesized
caaggttcatttctacacaggg

SEQ ID NO: 42834 - DNA, 22 bp, Artificial Sequence
  chemically synthesized
atttctacacagggattagcag

SEQ ID NO: 42835 - DNA, 22 bp, Artificial Sequence
  chemically synthesized
ctacacagggattagcagatca

SEQ ID NO: 42836 - DNA, 22 bp, Artificial Sequence
  chemically synthesized
tacacagggattagcagatcaa

SEQ ID NO: 42837 - DNA, 22 bp, Artificial Sequence
  chemically synthesized
cacagggattagcagatcaaca

SEQ ID NO: 42838 - DNA, 22 bp, Artificial Sequence
  chemically synthesized
gcagatcaacatcaatcttggc

SEQ ID NO: 42839 - DNA, 22 bp, Artificial Sequence
  chemically synthesized
ggcaacacagttgccactgatg

SEQ ID NO: 42840 - DNA, 22 bp, Artificial Sequence
  chemically synthesized
gcaacacagttgccactgatgg

SEQ ID NO: 42841 - DNA, 22 bp, Artificial Sequence
  chemically synthesized
ccactgatggtgtcttattttt

SEQ ID NO: 42842 - DNA, 22 bp, Artificial Sequence
  chemically synthesized
atggtgtcttattttttttatc

SEQ ID NO: 42843 - DNA, 22 bp, Artificial Sequence
  chemically synthesized
attttttttatcatgacatggc

SEQ ID NO: 42844 - DNA, 22 bp, Artificial Sequence
  chemically synthesized
ttttttttatcatgacatggca

SEQ ID NO: 42845 - DNA, 22 bp, Artificial Sequence
  chemically synthesized
tttttatcatgacatggcaatc

SEQ ID NO: 42846 - DNA, 22 bp, Artificial Sequence
  chemically synthesized
ttttatcatgacatggcaatca

SEQ ID NO: 42847 - DNA, 22 bp, Artificial Sequence
  chemically synthesized
tttatcatgacatggcaatcaa

SEQ ID NO: 42848 - DNA, 22 bp, Artificial Sequence
  chemically synthesized
ttatcatgacatggcaatcaag

SEQ ID NO: 42849 - DNA, 22 bp, Artificial Sequence
  chemically synthesized
tatcatgacatggcaatcaaga

SEQ ID NO: 42850 - DNA, 22 bp, Artificial Sequence
  chemically synthesized
atcatgacatggcaatcaagag

SEQ ID NO: 42851 - DNA, 22 bp, Artificial Sequence
  chemically synthesized
tcatgacatggcaatcaagagc

SEQ ID NO: 42852 - DNA, 22 bp, Artificial Sequence
  chemically synthesized
attcttatttaagattttatgg

SEQ ID NO: 42853 - DNA, 22 bp, Artificial Sequence
  chemically synthesized
ttcttatttaagattttatggt

SEQ ID NO: 42854 - DNA, 22 bp, Artificial Sequence
  chemically synthesized
ttatttaagattttatggttag

SEQ ID NO: 42855 - DNA, 22 bp, Artificial Sequence
  chemically synthesized
atttaagattttatggttagac

SEQ ID NO: 42856 - DNA, 22 bp, Artificial Sequence
  chemically synthesized
tttaagattttatggttagact

SEQ ID NO: 42857 - DNA, 22 bp, Artificial Sequence
  chemically synthesized
aagattttatggttagactagg

SEQ ID NO: 42858 - DNA, 22 bp, Artificial Sequence
  chemically synthesized
agattttatggttagactaggc

SEQ ID NO: 42859 - DNA, 22 bp, Artificial Sequence
  chemically synthesized
tatggttagactaggcagatag

SEQ ID NO: 42860 - DNA, 22 bp, Artificial Sequence
  chemically synthesized
atggttagactaggcagatagc

SEQ ID NO: 42861 - DNA, 22 bp, Artificial Sequence
  chemically synthesized
tggttagactaggcagatagct

SEQ ID NO: 42862 - DNA, 22 bp, Artificial Sequence
  chemically synthesized
gactaggcagatagctagatat

SEQ ID NO: 42863 - DNA, 22 bp, Artificial Sequence
  chemically synthesized
ggcagatagctagatatgagca

SEQ ID NO: 42864 - DNA, 22 bp, Artificial Sequence
  chemically synthesized
gatatgagcaggaggtggaagc

SEQ ID NO: 42865 - DNA, 22 bp, Artificial Sequence
  chemically synthesized
agagaatggaggtctggagaat

SEQ ID NO: 42866 - DNA, 22 bp, Artificial Sequence
  chemically synthesized
gagaatctgaaaccccagagat

SEQ ID NO: 42867 - DNA, 22 bp, Artificial Sequence
  chemically synthesized
aaaccccagagattacccaagt

SEQ ID NO: 42868 - DNA, 22 bp, Artificial Sequence
  chemically synthesized
cccaagtcctgcatgctagaca

SEQ ID NO: 42869 - DNA, 22 bp, Artificial Sequence
  chemically synthesized
catgctagacatgagtggagga

SEQ ID NO: 42870 - DNA, 22 bp, Artificial Sequence
  chemically synthesized
gacatgagtggaggagggggaa

SEQ ID NO: 42871 - DNA, 22 bp, Artificial Sequence
  chemically synthesized
ggtagaaaagaatgccccttaa

SEQ ID NO: 42872 - DNA, 22 bp, Artificial Sequence
  chemically synthesized
aagatgcccagcagtcgctcac

SEQ ID NO: 42873 - DNA, 22 bp, Artificial Sequence
  chemically synthesized
agatgcccagcagtcgctcact

SEQ ID NO: 42874 - DNA, 22 bp, Artificial Sequence
  chemically synthesized
actgtgcagttaacttttcaga

SEQ ID NO: 42875 - DNA, 22 bp, Artificial Sequence
  chemically synthesized
tgcagttaacttttcagaatgc

SEQ ID NO: 42876 - DNA, 22 bp, Artificial Sequence
  chemically synthesized
acttttcagaatgctgctagat

SEQ ID NO: 42877 - DNA, 22 bp, Artificial Sequence
  chemically synthesized
ttcagaatgctgctagatacat

SEQ ID NO: 42878 - DNA, 22 bp, Artificial Sequence
  chemically synthesized
tcagaatgctgctagatacatg

SEQ ID NO: 42879 - DNA, 22 bp, Artificial Sequence
  chemically synthesized
cagaatgctgctagatacatgc

SEQ ID NO: 42880 - DNA, 22 bp, Artificial Sequence
  chemically synthesized
agaatgctgctagatacatgct

SEQ ID NO: 42881 - DNA, 22 bp, Artificial Sequence
  chemically synthesized
ctagatacatgctgatagggag

SEQ ID NO: 42882 - DNA, 22 bp, Artificial Sequence
  chemically synthesized
gatacatgctgatagggaggga

SEQ ID NO: 42883 - DNA, 22 bp, Artificial Sequence
  chemically synthesized
atagggagggaagagggcaaag

SEQ ID NO: 42884 - DNA, 22 bp, Artificial Sequence
  chemically synthesized
ctaagagatacacggttgcagt

SEQ ID NO: 42885 - DNA, 22 bp, Artificial Sequence
  chemically synthesized
agagatacacggttgcagttag

SEQ ID NO: 42886 - DNA, 22 bp, Artificial Sequence
  chemically synthesized
cagttagtatacatctgagtgc

SEQ ID NO: 42887 - DNA, 22 bp, Artificial Sequence
  chemically synthesized
gtatacatctgagtgctataca

SEQ ID NO: 42888 - DNA, 22 bp, Artificial Sequence
  chemically synthesized
agtgctatacaaccttctttgg

SEQ ID NO: 42889 - DNA, 22 bp, Artificial Sequence
  chemically synthesized
tacaaccttctttgggtggtgg

SEQ ID NO: 42890 - DNA, 22 bp, Artificial Sequence
  chemically synthesized
ctttgggtggtggcaagaagca

SEQ ID NO: 42891 - DNA, 22 bp, Artificial Sequence
  chemically synthesized
tttgggtggtggcaagaagcaa

SEQ ID NO: 42892 - DNA, 22 bp, Artificial Sequence
  chemically synthesized
tgggtggtggcaagaagcaatg

SEQ ID NO: 42893 - DNA, 22 bp, Artificial Sequence
  chemically synthesized
gggtggtggcaagaagcaatgc

SEQ ID NO: 42894 - DNA, 22 bp, Artificial Sequence
  chemically synthesized
ggtggtggcaagaagcaatgca

SEQ ID NO: 42895 - DNA, 22 bp, Artificial Sequence
  chemically synthesized
cgtagaattcatatcaaacacc

SEQ ID NO: 42896 - DNA, 22 bp, Artificial Sequence
  chemically synthesized
atatcaaacacctgtatcacag

SEQ ID NO: 42897 - DNA, 22 bp, Artificial Sequence
  chemically synthesized
tatcacaggtgttaaagaaaca

SEQ ID NO: 42898 - DNA, 22 bp, Artificial Sequence
  chemically synthesized
aagaaacaagaaacattgtact

SEQ ID NO: 42899 - DNA, 22 bp, Artificial Sequence
  chemically synthesized
tacttcttgtattcttaataat

SEQ ID NO: 42900 - DNA, 22 bp, Artificial Sequence
  chemically synthesized
cttgtattcttaataatgattt

SEQ ID NO: 42901 - DNA, 22 bp, Artificial Sequence
  chemically synthesized
ttgtattcttaataatgatttg

SEQ ID NO: 42902 - DNA, 22 bp, Artificial Sequence
  chemically synthesized
gtattcttaataatgatttgca

SEQ ID NO: 42903 - DNA, 22 bp, Artificial Sequence
  chemically synthesized
tattcttaataatgatttgcaa

SEQ ID NO: 42904 - DNA, 22 bp, Artificial Sequence
  chemically synthesized
ttaataatgatttgcaatattg

SEQ ID NO: 42905 - DNA, 22 bp, Artificial Sequence
  chemically synthesized
aataatgatttgcaatattgtc

SEQ ID NO: 42906 - DNA, 22 bp, Artificial Sequence
  chemically synthesized
ataatgatttgcaatattgtct

SEQ ID NO: 42907 - DNA, 22 bp, Artificial Sequence
  chemically synthesized
gcaatattgtctttagtatcac

SEQ ID NO: 42908 - DNA, 22 bp, Artificial Sequence
  chemically synthesized
caatattgtctttagtatcact

SEQ ID NO: 42909 - DNA, 22 bp, Artificial Sequence
  chemically synthesized
tctttagtatcactgcaaacct

SEQ ID NO: 42910 - DNA, 22 bp, Artificial Sequence
  chemically synthesized
tagtatcactgcaaacctctat

SEQ ID NO: 42911 - DNA, 22 bp, Artificial Sequence
  chemically synthesized
agtatcactgcaaacctctata

SEQ ID NO: 42912 - DNA, 22 bp, Artificial Sequence
  chemically synthesized
gtatcactgcaaacctctataa

SEQ ID NO: 42913 - DNA, 22 bp, Artificial Sequence
  chemically synthesized
caaacctctataaatatgattt

SEQ ID NO: 42914 - DNA, 22 bp, Artificial Sequence
  chemically synthesized
tataaatatgatttttaaaaag

SEQ ID NO: 42915 - DNA, 22 bp, Artificial Sequence
  chemically synthesized
taaatatgatttttaaaaagta

SEQ ID NO: 42916 - DNA, 22 bp, Artificial Sequence
  chemically synthesized
ttaaaaagtatttctttaggtt

SEQ ID NO: 42917 - DNA, 22 bp, Artificial Sequence
  chemically synthesized
taaaaagtatttctttaggttg

SEQ ID NO: 42918 - DNA, 22 bp, Artificial Sequence
  chemically synthesized
aaaaagtatttctttaggttgg

SEQ ID NO: 42919 - DNA, 22 bp, Artificial Sequence
  chemically synthesized
aaaagtatttctttaggttgga

SEQ ID NO: 42920 - DNA, 22 bp, Artificial Sequence
  chemically synthesized
ctttaggttggaattacttcta

SEQ ID NO: 42921 - DNA, 22 bp, Artificial Sequence
  chemically synthesized
tttaggttggaattacttctac

SEQ ID NO: 42922 - DNA, 22 bp, Artificial Sequence
  chemically synthesized
taggttggaattacttctacgc

SEQ ID NO: 42923 - DNA, 22 bp, Artificial Sequence
  chemically synthesized
aggttggaattacttctacgca

SEQ ID NO: 42924 - DNA, 22 bp, Artificial Sequence
  chemically synthesized
ggttggaattacttctacgcat

SEQ ID NO: 42925 - DNA, 22 bp, Artificial Sequence
  chemically synthesized
gaattacttctacgcattgact

SEQ ID NO: 42926 - DNA, 22 bp, Artificial Sequence
  chemically synthesized
cttctacgcattgacttatctt

SEQ ID NO: 42927 - DNA, 22 bp, Artificial Sequence
  chemically synthesized
ctacgcattgacttatcttcct

SEQ ID NO: 42928 - DNA, 22 bp, Artificial Sequence
  chemically synthesized
tacgcattgacttatcttcctg

SEQ ID NO: 42929 - DNA, 22 bp, Artificial Sequence
  chemically synthesized
cgcattgacttatcttcctggg

SEQ ID NO: 42930 - DNA, 22 bp, Artificial Sequence
  chemically synthesized
acttatcttcctgggtttcatt

SEQ ID NO: 42931 - DNA, 22 bp, Artificial Sequence
  chemically synthesized
atcttcctgggtttcattagcc

SEQ ID NO: 42932 - DNA, 22 bp, Artificial Sequence
  chemically synthesized
tcttcctgggtttcattagccg

SEQ ID NO: 42933 - DNA, 22 bp, Artificial Sequence
  chemically synthesized
cctgggtttcattagccgtacc

SEQ ID NO: 42934 - DNA, 22 bp, Artificial Sequence
  chemically synthesized
ctgggtttcattagccgtaccc

SEQ ID NO: 42935 - DNA, 22 bp, Artificial Sequence
  chemically synthesized
ggtttcattagccgtacccgtt

SEQ ID NO: 42936 - DNA, 22 bp, Artificial Sequence
  chemically synthesized
cattagccgtacccgttgtact

SEQ ID NO: 42937 - DNA, 22 bp, Artificial Sequence
  chemically synthesized
attagccgtacccgttgtactt

SEQ ID NO: 42938 - DNA, 22 bp, Artificial Sequence
  chemically synthesized
gccgtacccgttgtactttctt

SEQ ID NO: 42939 - DNA, 22 bp, Artificial Sequence
  chemically synthesized
tactttcttccttaccactgtt

SEQ ID NO: 42940 - DNA, 22 bp, Artificial Sequence
  chemically synthesized
tcttccttaccactgtttatct

SEQ ID NO: 42941 - DNA, 22 bp, Artificial Sequence
  chemically synthesized
cttccttaccactgtttatctc

SEQ ID NO: 42942 - DNA, 22 bp, Artificial Sequence
  chemically synthesized
ttccttaccactgtttatctca

SEQ ID NO: 42943 - DNA, 22 bp, Artificial Sequence
  chemically synthesized
ccttaccactgtttatctcaaa

SEQ ID NO: 42944 - DNA, 22 bp, Artificial Sequence
  chemically synthesized
cttaccactgtttatctcaaac

SEQ ID NO: 42945 - DNA, 22 bp, Artificial Sequence
  chemically synthesized
accactgtttatctcaaactct

SEQ ID NO: 42946 - DNA, 22 bp, Artificial Sequence
  chemically synthesized
ccactgtttatctcaaactctt

SEQ ID NO: 42947 - DNA, 22 bp, Artificial Sequence
  chemically synthesized
tttatctcaaactcttgagatt

SEQ ID NO: 42948 - DNA, 22 bp, Artificial Sequence
  chemically synthesized
atctcaaactcttgagattaaa

SEQ ID NO: 42949 - DNA, 22 bp, Artificial Sequence
  chemically synthesized
tctcaaactcttgagattaaag

SEQ ID NO: 42950 - DNA, 22 bp, Artificial Sequence
  chemically synthesized
aaactcttgagattaaagtatg

SEQ ID NO: 42951 - DNA, 22 bp, Artificial Sequence
  chemically synthesized
ttgagattaaagtatgggctca

SEQ ID NO: 42952 - DNA, 22 bp, Artificial Sequence
  chemically synthesized
gagattaaagtatgggctcagg

SEQ ID NO: 42953 - DNA, 22 bp, Artificial Sequence
  chemically synthesized
agattaaagtatgggctcagga

SEQ ID NO: 42954 - DNA, 22 bp, Artificial Sequence
  chemically synthesized
aagtatgggctcaggagggagc

SEQ ID NO: 42955 - DNA, 22 bp, Artificial Sequence
  chemically synthesized
aggagggagcgaggagcttcag

SEQ ID NO: 42956 - DNA, 22 bp, Artificial Sequence
  chemically synthesized
caggactctcacggacctccag

SEQ ID NO: 42957 - DNA, 22 bp, Artificial Sequence
  chemically synthesized
aggactctcacggacctccagc

SEQ ID NO: 42958 - DNA, 22 bp, Artificial Sequence
  chemically synthesized
tcacggacctccagcacagtgt

SEQ ID NO: 42959 - DNA, 22 bp, Artificial Sequence
  chemically synthesized
acggacctccagcacagtgtag

SEQ ID NO: 42960 - DNA, 22 bp, Artificial Sequence
  chemically synthesized
cagcacagtgtagctgccttat

SEQ ID NO: 42961 - DNA, 22 bp, Artificial Sequence
  chemically synthesized
ccttatggaaaagtggccacac

SEQ ID NO: 42962 - DNA, 22 bp, Artificial Sequence
  chemically synthesized
atggaaaagtggccacactgtt

SEQ ID NO: 42963 - DNA, 22 bp, Artificial Sequence
  chemically synthesized
tggaaaagtggccacactgttt

SEQ ID NO: 42964 - DNA, 22 bp, Artificial Sequence
  chemically synthesized
ttttctgcactggtccctgccc

SEQ ID NO: 42965 - DNA, 22 bp, Artificial Sequence
  chemically synthesized
tctgcactggtccctgccccta

SEQ ID NO: 42966 - DNA, 22 bp, Artificial Sequence
  chemically synthesized
ctgcactggtccctgcccctac

SEQ ID NO: 42967 - DNA, 22 bp, Artificial Sequence
  chemically synthesized
tgcactggtccctgcccctact

SEQ ID NO: 42968 - DNA, 22 bp, Artificial Sequence
  chemically synthesized
cactggtccctgcccctactat

SEQ ID NO: 42969 - DNA, 22 bp, Artificial Sequence
  chemically synthesized
gtccctgcccctactattcctc

SEQ ID NO: 42970 - DNA, 22 bp, Artificial Sequence
  chemically synthesized
cccctactattcctcactgggc

SEQ ID NO: 42971 - DNA, 22 bp, Artificial Sequence
  chemically synthesized
ctattcctcactgggcagagca

SEQ ID NO: 42972 - DNA, 22 bp, Artificial Sequence
  chemically synthesized
ttcctcactgggcagagcacag

SEQ ID NO: 42973 - DNA, 22 bp, Artificial Sequence
  chemically synthesized
ctcactgggcagagcacagcca

SEQ ID NO: 42974 - DNA, 22 bp, Artificial Sequence
  chemically synthesized
actgggcagagcacagccaccc

SEQ ID NO: 42975 - DNA, 22 bp, Artificial Sequence
  chemically synthesized
ggcagagcacagccaccctggc

SEQ ID NO: 42976 - DNA, 22 bp, Artificial Sequence
  chemically synthesized
gccctgcctgaacattttagtc

SEQ ID NO: 42977 - DNA, 22 bp, Artificial Sequence
  chemically synthesized
cctgaacattttagtcagtgtt

SEQ ID NO: 42978 - DNA, 22 bp, Artificial Sequence
  chemically synthesized
aacattttagtcagtgttggct

SEQ ID NO: 42979 - DNA, 22 bp, Artificial Sequence
  chemically synthesized
tagtcagtgttggctctgtgct

SEQ ID NO: 42980 - DNA, 22 bp, Artificial Sequence
  chemically synthesized
agtcagtgttggctctgtgctt

SEQ ID NO: 42981 - DNA, 22 bp, Artificial Sequence
  chemically synthesized
gtcagtgttggctctgtgcttc

SEQ ID NO: 42982 - DNA, 22 bp, Artificial Sequence
  chemically synthesized
gctctgtgcttctctggggagg

SEQ ID NO: 42983 - DNA, 22 bp, Artificial Sequence
  chemically synthesized
tgtgcttctctggggaggaaat

SEQ ID NO: 42984 - DNA, 22 bp, Artificial Sequence
  chemically synthesized
tgcttctctggggaggaaatcc

SEQ ID NO: 42985 - DNA, 22 bp, Artificial Sequence
  chemically synthesized
ctctggggaggaaatccaagag

SEQ ID NO: 42986 - DNA, 22 bp, Artificial Sequence
  chemically synthesized
tctggggaggaaatccaagaga

SEQ ID NO: 42987 - DNA, 22 bp, Artificial Sequence
  chemically synthesized
tggggaggaaatccaagagaca

SEQ ID NO: 42988 - DNA, 22 bp, Artificial Sequence
  chemically synthesized
gggaggaaatccaagagacaac

SEQ ID NO: 42989 - DNA, 22 bp, Artificial Sequence
  chemically synthesized
tgccatttcagctgcagcagta

SEQ ID NO: 42990 - DNA, 22 bp, Artificial Sequence
  chemically synthesized
ccatttcagctgcagcagtacc

SEQ ID NO: 42991 - DNA, 22 bp, Artificial Sequence
  chemically synthesized
cagctgcagcagtaccaccgtt

SEQ ID NO: 42992 - DNA, 22 bp, Artificial Sequence
  chemically synthesized
agctgcagcagtaccaccgtta

SEQ ID NO: 42993 - DNA, 22 bp, Artificial Sequence
  chemically synthesized
cagcagtaccaccgttaatgcc

SEQ ID NO: 42994 - DNA, 22 bp, Artificial Sequence
  chemically synthesized
atgcccttgggcttgagaaaga

SEQ ID NO: 42995 - DNA, 22 bp, Artificial Sequence
  chemically synthesized
gggcttgagaaagaagggacct

SEQ ID NO: 42996 - DNA, 22 bp, Artificial Sequence
  chemically synthesized
ggcttgagaaagaagggacctg

SEQ ID NO: 42997 - DNA, 22 bp, Artificial Sequence
  chemically synthesized
gagaaagaagggacctggccac

SEQ ID NO: 42998 - DNA, 22 bp, Artificial Sequence
  chemically synthesized
agaaagaagggacctggccact

SEQ ID NO: 42999 - DNA, 22 bp, Artificial Sequence
  chemically synthesized
gccacttccctgacacctccag

SEQ ID NO: 43000 - DNA, 22 bp, Artificial Sequence
  chemically synthesized
ccctgacacctccagcacacag

SEQ ID NO: 43001 - DNA, 22 bp, Artificial Sequence
  chemically synthesized
cctgacacctccagcacacagc

SEQ ID NO: 43002 - DNA, 22 bp, Artificial Sequence
  chemically synthesized
acacctccagcacacagcaggg

SEQ ID NO: 43003 - DNA, 22 bp, Artificial Sequence
  chemically synthesized
cagcacacagcagggaaagaat

SEQ ID NO: 43004 - DNA, 22 bp, Artificial Sequence
  chemically synthesized
cagtttctctttcttgtgagct

SEQ ID NO: 43005 - DNA, 22 bp, Artificial Sequence
  chemically synthesized
ctctttcttgtgagctttcacc

SEQ ID NO: 43006 - DNA, 22 bp, Artificial Sequence
  chemically synthesized
tctttcttgtgagctttcacct

SEQ ID NO: 43007 - DNA, 22 bp, Artificial Sequence
  chemically synthesized
tttcttgtgagctttcacctgc

SEQ ID NO: 43008 - DNA, 22 bp, Artificial Sequence
  chemically synthesized
tcttgtgagctttcacctgcta

SEQ ID NO: 43009 - DNA, 22 bp, Artificial Sequence
  chemically synthesized
cttgtgagctttcacctgctac

SEQ ID NO: 43010 - DNA, 22 bp, Artificial Sequence
  chemically synthesized
ttgtgagctttcacctgctact

SEQ ID NO: 43011 - DNA, 22 bp, Artificial Sequence
  chemically synthesized
gtgagctttcacctgctactct

SEQ ID NO: 43012 - DNA, 22 bp, Artificial Sequence
  chemically synthesized
tgagctttcacctgctactctt

SEQ ID NO: 43013 - DNA, 22 bp, Artificial Sequence
  chemically synthesized
tcacctgctactcttcaccagg

SEQ ID NO: 43014 - DNA, 22 bp, Artificial Sequence
  chemically synthesized
cacctgctactcttcaccaggc

SEQ ID NO: 43015 - DNA, 22 bp, Artificial Sequence
  chemically synthesized
acctgctactcttcaccaggca

SEQ ID NO: 43016 - DNA, 22 bp, Artificial Sequence
  chemically synthesized
ctactcttcaccaggcaaggct

SEQ ID NO: 43017 - DNA, 22 bp, Artificial Sequence
  chemically synthesized
ctcttcaccaggcaaggctcct

SEQ ID NO: 43018 - DNA, 22 bp, Artificial Sequence
  chemically synthesized
ttcaccaggcaaggctcctggc

SEQ ID NO: 43019 - DNA, 22 bp, Artificial Sequence
  chemically synthesized
caccaggcaaggctcctggctt

SEQ ID NO: 43020 - DNA, 22 bp, Artificial Sequence
  chemically synthesized
accaggcaaggctcctggcttg

SEQ ID NO: 43021 - DNA, 22 bp, Artificial Sequence
  chemically synthesized
ctggcttgggcccacagtgcag

SEQ ID NO: 43022 - DNA, 22 bp, Artificial Sequence
  chemically synthesized
gcttgggcccacagtgcaggca

SEQ ID NO: 43023 - DNA, 22 bp, Artificial Sequence
  chemically synthesized
gggcccacagtgcaggcacctc

SEQ ID NO: 43024 - DNA, 22 bp, Artificial Sequence
  chemically synthesized
ggcccacagtgcaggcacctcg

SEQ ID NO: 43025 - DNA, 22 bp, Artificial Sequence
  chemically synthesized
gaactcagttgaacatttccac

SEQ ID NO: 43026 - DNA, 22 bp, Artificial Sequence
  chemically synthesized
agttgaacatttccactggctg

SEQ ID NO: 43027 - DNA, 22 bp, Artificial Sequence
  chemically synthesized
aacatttccactggctgcactc

SEQ ID NO: 43028 - DNA, 22 bp, Artificial Sequence
  chemically synthesized
ccactggctgcactctgtgttt

SEQ ID NO: 43029 - DNA, 22 bp, Artificial Sequence
  chemically synthesized
cactggctgcactctgtgtttt

SEQ ID NO: 43030 - DNA, 22 bp, Artificial Sequence
  chemically synthesized
gctgcactctgtgtttttgtgg

SEQ ID NO: 43031 - DNA, 22 bp, Artificial Sequence
  chemically synthesized
cactctgtgtttttgtggggtg

SEQ ID NO: 43032 - DNA, 22 bp, Artificial Sequence
  chemically synthesized
tgtgtttttgtggggtgaagct

SEQ ID NO: 43033 - DNA, 22 bp, Artificial Sequence
  chemically synthesized
tgtttttgtggggtgaagctcc

SEQ ID NO: 43034 - DNA, 22 bp, Artificial Sequence
  chemically synthesized
ttgtggggtgaagctcccagag

SEQ ID NO: 43035 - DNA, 22 bp, Artificial Sequence
  chemically synthesized
tgtggggtgaagctcccagagg

SEQ ID NO: 43036 - DNA, 22 bp, Artificial Sequence
  chemically synthesized
gtggggtgaagctcccagaggt

SEQ ID NO: 43037 - DNA, 22 bp, Artificial Sequence
  chemically synthesized
tggggtgaagctcccagaggtg

SEQ ID NO: 43038 - DNA, 22 bp, Artificial Sequence
  chemically synthesized
ccagaggtgactgaaagtcctt

SEQ ID NO: 43039 - DNA, 22 bp, Artificial Sequence
  chemically synthesized
aaagtccttctgccactaacac

SEQ ID NO: 43040 - DNA, 22 bp, Artificial Sequence
  chemically synthesized
ctgccactaacactgcagtcat

SEQ ID NO: 43041 - DNA, 22 bp, Artificial Sequence
  chemically synthesized
tgccactaacactgcagtcata

SEQ ID NO: 43042 - DNA, 22 bp, Artificial Sequence
  chemically synthesized
ccactaacactgcagtcatact

SEQ ID NO: 43043 - DNA, 22 bp, Artificial Sequence
  chemically synthesized
acactgcagtcatactgccctt

SEQ ID NO: 43044 - DNA, 22 bp, Artificial Sequence
  chemically synthesized
cagtcatactgcccttgctgta

SEQ ID NO: 43045 - DNA, 22 bp, Artificial Sequence
  chemically synthesized
cccttgctgtacttggactagg

SEQ ID NO: 43046 - DNA, 22 bp, Artificial Sequence
  chemically synthesized
gctgtacttggactagggaagg

SEQ ID NO: 43047 - DNA, 22 bp, Artificial Sequence
  chemically synthesized
ctgtacttggactagggaagga

SEQ ID NO: 43048 - DNA, 22 bp, Artificial Sequence
  chemically synthesized
tacttggactagggaaggaaaa

SEQ ID NO: 43049 - DNA, 22 bp, Artificial Sequence
  chemically synthesized
ggactagggaaggaaaaaagat

SEQ ID NO: 43050 - DNA, 22 bp, Artificial Sequence
  chemically synthesized
gactagggaaggaaaaaagatc

SEQ ID NO: 43051 - DNA, 22 bp, Artificial Sequence
  chemically synthesized
gggaaggaaaaaagatcctgag

SEQ ID NO: 43052 - DNA, 22 bp, Artificial Sequence
  chemically synthesized
agtgctttactcacaccccagt

SEQ ID NO: 43053 - DNA, 22 bp, Artificial Sequence
  chemically synthesized
tactcacaccccagtgtgcccc

SEQ ID NO: 43054 - DNA, 22 bp, Artificial Sequence
  chemically synthesized
actcacaccccagtgtgcccca

SEQ ID NO: 43055 - DNA, 22 bp, Artificial Sequence
  chemically synthesized
ctcacaccccagtgtgccccag

SEQ ID NO: 43056 - DNA, 22 bp, Artificial Sequence
  chemically synthesized
acaccccagtgtgccccagcca

SEQ ID NO: 43057 - DNA, 22 bp, Artificial Sequence
  chemically synthesized
tggaaaagaggccagtgtgtca

SEQ ID NO: 43058 - DNA, 22 bp, Artificial Sequence
  chemically synthesized
caagcaccctgaggcccctgcc

SEQ ID NO: 43059 - DNA, 22 bp, Artificial Sequence
  chemically synthesized
aggcccctgcccctgctgcccc

SEQ ID NO: 43060 - DNA, 22 bp, Artificial Sequence
  chemically synthesized
cccctgctgcccccaagctgta

SEQ ID NO: 43061 - DNA, 22 bp, Artificial Sequence
  chemically synthesized
ctgcccccaagctgtagagcca

SEQ ID NO: 43062 - DNA, 22 bp, Artificial Sequence
  chemically synthesized
cccccaagctgtagagccagaa

SEQ ID NO: 43063 - DNA, 22 bp, Artificial Sequence
  chemically synthesized
tagagccagaatataaagctgg

SEQ ID NO: 43064 - DNA, 22 bp, Artificial Sequence
  chemically synthesized
gcagaaaaatgtaaaaaggcta

SEQ ID NO: 43065 - DNA, 22 bp, Artificial Sequence
  chemically synthesized
gactggcttagcctcccagcct

SEQ ID NO: 43066 - DNA, 22 bp, Artificial Sequence
  chemically synthesized
gcttagcctcccagcctacatc

SEQ ID NO: 43067 - DNA, 22 bp, Artificial Sequence
  chemically synthesized
agcctcccagcctacatctttc

SEQ ID NO: 43068 - DNA, 22 bp, Artificial Sequence
  chemically synthesized
gcctcccagcctacatctttct

SEQ ID NO: 43069 - DNA, 22 bp, Artificial Sequence
  chemically synthesized
ccagcctacatctttctcctgt

SEQ ID NO: 43070 - DNA, 22 bp, Artificial Sequence
  chemically synthesized
catctttctcctgtgctggatc

SEQ ID NO: 43071 - DNA, 22 bp, Artificial Sequence
  chemically synthesized
tctcctgtgctggatccttcct

SEQ ID NO: 43072 - DNA, 22 bp, Artificial Sequence
  chemically synthesized
ctcctgtgctggatccttcctg

SEQ ID NO: 43073 - DNA, 22 bp, Artificial Sequence
  chemically synthesized
tcctgtgctggatccttcctgc

SEQ ID NO: 43074 - DNA, 22 bp, Artificial Sequence
  chemically synthesized
ctgtgctggatccttcctgctc

SEQ ID NO: 43075 - DNA, 22 bp, Artificial Sequence
  chemically synthesized
tgctggatccttcctgctcttg

SEQ ID NO: 43076 - DNA, 22 bp, Artificial Sequence
  chemically synthesized
gatccttcctgctcttgaacat

SEQ ID NO: 43077 - DNA, 22 bp, Artificial Sequence
  chemically synthesized
cctgctcttgaacatcggactc

SEQ ID NO: 43078 - DNA, 22 bp, Artificial Sequence
  chemically synthesized
ctgctcttgaacatcggactcc

SEQ ID NO: 43079 - DNA, 22 bp, Artificial Sequence
  chemically synthesized
ctcttgaacatcggactccaag

SEQ ID NO: 43080 - DNA, 22 bp, Artificial Sequence
  chemically synthesized
ttgaacatcggactccaagttc

SEQ ID NO: 43081 - DNA, 22 bp, Artificial Sequence
  chemically synthesized
gaacatcggactccaagttctt

SEQ ID NO: 43082 - DNA, 22 bp, Artificial Sequence
  chemically synthesized
aacatcggactccaagttcttc

SEQ ID NO: 43083 - DNA, 22 bp, Artificial Sequence
  chemically synthesized
caagttcttcagctgtgggact

SEQ ID NO: 43084 - DNA, 22 bp, Artificial Sequence
  chemically synthesized
ttcagctgtgggacttggactg

SEQ ID NO: 43085 - DNA, 22 bp, Artificial Sequence
  chemically synthesized
cagctgtgggacttggactgtc

SEQ ID NO: 43086 - DNA, 22 bp, Artificial Sequence
  chemically synthesized
agctgtgggacttggactgtct

SEQ ID NO: 43087 - DNA, 22 bp, Artificial Sequence
  chemically synthesized
tgggacttggactgtcttcctt

SEQ ID NO: 43088 - DNA, 22 bp, Artificial Sequence
  chemically synthesized
ggactgtcttccttgctcctca

SEQ ID NO: 43089 - DNA, 22 bp, Artificial Sequence
  chemically synthesized
gactgtcttccttgctcctcag

SEQ ID NO: 43090 - DNA, 22 bp, Artificial Sequence
  chemically synthesized
tcttccttgctcctcagattgc

SEQ ID NO: 43091 - DNA, 22 bp, Artificial Sequence
  chemically synthesized
ccttgctcctcagattgcaggt

SEQ ID NO: 43092 - DNA, 22 bp, Artificial Sequence
  chemically synthesized
cttgctcctcagattgcaggtg

SEQ ID NO: 43093 - DNA, 22 bp, Artificial Sequence
  chemically synthesized
gctcctcagattgcaggtggcc

SEQ ID NO: 43094 - DNA, 22 bp, Artificial Sequence
  chemically synthesized
ctcctcagattgcaggtggcct

SEQ ID NO: 43095 - DNA, 22 bp, Artificial Sequence
  chemically synthesized
ctcagattgcaggtggcctatt

SEQ ID NO: 43096 - DNA, 22 bp, Artificial Sequence
  chemically synthesized
agattgcaggtggcctattatg

SEQ ID NO: 43097 - DNA, 22 bp, Artificial Sequence
  chemically synthesized
caggtggcctattatgggacct

SEQ ID NO: 43098 - DNA, 22 bp, Artificial Sequence
  chemically synthesized
ttatgggaccttgtaatcttgt

SEQ ID NO: 43099 - DNA, 22 bp, Artificial Sequence
  chemically synthesized
tgggaccttgtaatcttgtgag

SEQ ID NO: 43100 - DNA, 22 bp, Artificial Sequence
  chemically synthesized
gtaatcttgtgagttaatacca

SEQ ID NO: 43101 - DNA, 22 bp, Artificial Sequence
  chemically synthesized
taatcttgtgagttaataccac

SEQ ID NO: 43102 - DNA, 22 bp, Artificial Sequence
  chemically synthesized
gtgagttaataccacttaataa

SEQ ID NO: 43103 - DNA, 22 bp, Artificial Sequence
  chemically synthesized
tgagttaataccacttaataag

SEQ ID NO: 43104 - DNA, 22 bp, Artificial Sequence
  chemically synthesized
ataccacttaataagctcccct

SEQ ID NO: 43105 - DNA, 22 bp, Artificial Sequence
  chemically synthesized
aataagctcccctttgtgtgag

SEQ ID NO: 43106 - DNA, 22 bp, Artificial Sequence
  chemically synthesized
ataagctcccctttgtgtgagt

SEQ ID NO: 43107 - DNA, 22 bp, Artificial Sequence
  chemically synthesized
ccctttgtgtgagtatatctat

SEQ ID NO: 43108 - DNA, 22 bp, Artificial Sequence
  chemically synthesized
tgtgtgagtatatctatatcta

SEQ ID NO: 43109 - DNA, 22 bp, Artificial Sequence
  chemically synthesized
gtgtgagtatatctatatctat

SEQ ID NO: 43110 - DNA, 22 bp, Artificial Sequence
  chemically synthesized
tgtgagtatatctatatctata

SEQ ID NO: 43111 - DNA, 22 bp, Artificial Sequence
  chemically synthesized
tatctatagatagatataggta

SEQ ID NO: 43112 - DNA, 22 bp, Artificial Sequence
  chemically synthesized
tagatagatataggtatactca

SEQ ID NO: 43113 - DNA, 22 bp, Artificial Sequence
  chemically synthesized
actatatatacacatatataca

SEQ ID NO: 43114 - DNA, 22 bp, Artificial Sequence
  chemically synthesized
tatatacacatatatacatata

SEQ ID NO: 43115 - DNA, 22 bp, Artificial Sequence
  chemically synthesized
tctctctctctctctcatatat

SEQ ID NO: 43116 - DNA, 22 bp, Artificial Sequence
  chemically synthesized
tctctctctctctcatatatat

SEQ ID NO: 43117 - DNA, 22 bp, Artificial Sequence
  chemically synthesized
tctctctctctcatatatatat

SEQ ID NO: 43118 - DNA, 22 bp, Artificial Sequence
  chemically synthesized
tctctctctcatatatatatat

SEQ ID NO: 43119 - DNA, 22 bp, Artificial Sequence
  chemically synthesized
tctctctcatatatatatatat

SEQ ID NO: 43120 - DNA, 22 bp, Artificial Sequence
  chemically synthesized
tctctcatatatatatatatat

SEQ ID NO: 43121 - DNA, 22 bp, Artificial Sequence
  chemically synthesized
tctcatatatatatatatataa

SEQ ID NO: 43122 - DNA, 22 bp, Artificial Sequence
  chemically synthesized
tcatatatatatatatataatc

SEQ ID NO: 43123 - DNA, 22 bp, Artificial Sequence
  chemically synthesized
atatatatatatatataatctc

SEQ ID NO: 43124 - DNA, 22 bp, Artificial Sequence
  chemically synthesized
ctattagttctgtccctctaga

SEQ ID NO: 43125 - DNA, 22 bp, Artificial Sequence
  chemically synthesized
ttagttctgtccctctagagaa

SEQ ID NO: 43126 - DNA, 22 bp, Artificial Sequence
  chemically synthesized
gttctgtccctctagagaaccc

SEQ ID NO: 43127 - DNA, 22 bp, Artificial Sequence
  chemically synthesized
tgtccctctagagaaccccgac

SEQ ID NO: 43128 - DNA, 22 bp, Artificial Sequence
  chemically synthesized
tccctctagagaaccccgacta

SEQ ID NO: 43129 - DNA, 22 bp, Artificial Sequence
  chemically synthesized
tagagaaccccgactaatacag

SEQ ID NO: 43130 - DNA, 22 bp, Artificial Sequence
  chemically synthesized
gagaaccccgactaatacagat

SEQ ID NO: 43131 - DNA, 22 bp, Artificial Sequence
  chemically synthesized
atacagattttcataccagaag

SEQ ID NO: 43132 - DNA, 22 bp, Artificial Sequence
  chemically synthesized
tcataccagaagtggttcttga

SEQ ID NO: 43133 - DNA, 22 bp, Artificial Sequence
  chemically synthesized
cataccagaagtggttcttgag

SEQ ID NO: 43134 - DNA, 22 bp, Artificial Sequence
  chemically synthesized
ataccagaagtggttcttgagg

SEQ ID NO: 43135 - DNA, 22 bp, Artificial Sequence
  chemically synthesized
ttgaggaacagaatattaagga

SEQ ID NO: 43136 - DNA, 22 bp, Artificial Sequence
  chemically synthesized
gaggaacagaatattaaggatg

SEQ ID NO: 43137 - DNA, 22 bp, Artificial Sequence
  chemically synthesized
aggaacagaatattaaggatgg

SEQ ID NO: 43138 - DNA, 22 bp, Artificial Sequence
  chemically synthesized
aggatggaattctttcattggt

SEQ ID NO: 43139 - DNA, 22 bp, Artificial Sequence
  chemically synthesized
tttcattggttttgggacttct

SEQ ID NO: 43140 - DNA, 22 bp, Artificial Sequence
  chemically synthesized
tcattggttttgggacttctgg

SEQ ID NO: 43141 - DNA, 22 bp, Artificial Sequence
  chemically synthesized
cattggttttgggacttctggt

SEQ ID NO: 43142 - DNA, 22 bp, Artificial Sequence
  chemically synthesized
attggttttgggacttctggtg

SEQ ID NO: 43143 - DNA, 22 bp, Artificial Sequence
  chemically synthesized
gttttgggacttctggtgttgg

SEQ ID NO: 43144 - DNA, 22 bp, Artificial Sequence
  chemically synthesized
tgggacttctggtgttggctga

SEQ ID NO: 43145 - DNA, 22 bp, Artificial Sequence
  chemically synthesized
gggacttctggtgttggctgat

SEQ ID NO: 43146 - DNA, 22 bp, Artificial Sequence
  chemically synthesized
ggacttctggtgttggctgatt

SEQ ID NO: 43147 - DNA, 22 bp, Artificial Sequence
  chemically synthesized
ctggtgttggctgattaatatg

SEQ ID NO: 43148 - DNA, 22 bp, Artificial Sequence
  chemically synthesized
tggtgttggctgattaatatga

SEQ ID NO: 43149 - DNA, 22 bp, Artificial Sequence
  chemically synthesized
gtgttggctgattaatatgatt

SEQ ID NO: 43150 - DNA, 22 bp, Artificial Sequence
  chemically synthesized
gctgattaatatgattagacca

SEQ ID NO: 43151 - DNA, 22 bp, Artificial Sequence
  chemically synthesized
attaatatgattagaccaaaaa

SEQ ID NO: 43152 - DNA, 22 bp, Artificial Sequence
  chemically synthesized
atatgattagaccaaaaaatgc

SEQ ID NO: 43153 - DNA, 22 bp, Artificial Sequence
  chemically synthesized
gaccaaaaaatgctaaggactc

SEQ ID NO: 43154 - DNA, 22 bp, Artificial Sequence
  chemically synthesized
aggactctacttctaatagtat

SEQ ID NO: 43155 - DNA, 22 bp, Artificial Sequence
  chemically synthesized
tacttctaatagtatggagaac

SEQ ID NO: 43156 - DNA, 22 bp, Artificial Sequence
  chemically synthesized
cttctaatagtatggagaacac

SEQ ID NO: 43157 - DNA, 22 bp, Artificial Sequence
  chemically synthesized
ctaatagtatggagaacactga

SEQ ID NO: 43158 - DNA, 22 bp, Artificial Sequence
  chemically synthesized
taatagtatggagaacactgat

SEQ ID NO: 43159 - DNA, 22 bp, Artificial Sequence
  chemically synthesized
atagtatggagaacactgatag

SEQ ID NO: 43160 - DNA, 22 bp, Artificial Sequence
  chemically synthesized
atagtacttggcctgaattgtt

SEQ ID NO: 43161 - DNA, 22 bp, Artificial Sequence
  chemically synthesized
ggcctgaattgtttagagagtt

SEQ ID NO: 43162 - DNA, 22 bp, Artificial Sequence
  chemically synthesized
gcctgaattgtttagagagtta

SEQ ID NO: 43163 - DNA, 22 bp, Artificial Sequence
  chemically synthesized
aattgtttagagagttatgcaa

SEQ ID NO: 43164 - DNA, 22 bp, Artificial Sequence
  chemically synthesized
tttagagagttatgcaaaataa

SEQ ID NO: 43165 - DNA, 22 bp, Artificial Sequence
  chemically synthesized
agagagttatgcaaaataaatg

SEQ ID NO: 43166 - DNA, 22 bp, Artificial Sequence
  chemically synthesized
gagagttatgcaaaataaatgc

SEQ ID NO: 43167 - DNA, 22 bp, Artificial Sequence
  chemically synthesized
tgcaaaataaatgcatttgaca

SEQ ID NO: 43168 - DNA, 22 bp, Artificial Sequence
  chemically synthesized
gacactactgattcatcactta

SEQ ID NO: 43169 - DNA, 22 bp, Artificial Sequence
  chemically synthesized
acactactgattcatcacttat

SEQ ID NO: 43170 - DNA, 22 bp, Artificial Sequence
  chemically synthesized
ctgattcatcacttatgagagg

SEQ ID NO: 43171 - DNA, 22 bp, Artificial Sequence
  chemically synthesized
attcatcacttatgagaggcaa

SEQ ID NO: 43172 - DNA, 22 bp, Artificial Sequence
  chemically synthesized
atcacttatgagaggcaaggag

SEQ ID NO: 43173 - DNA, 22 bp, Artificial Sequence
  chemically synthesized
atgagaggcaaggagtttagtg

SEQ ID NO: 43174 - DNA, 22 bp, Artificial Sequence
  chemically synthesized
tgagaggcaaggagtttagtga

SEQ ID NO: 43175 - DNA, 22 bp, Artificial Sequence
  chemically synthesized
agtgactctatacataatacct

SEQ ID NO: 43176 - DNA, 22 bp, Artificial Sequence
  chemically synthesized
gtgactctatacataatacctt

SEQ ID NO: 43177 - DNA, 22 bp, Artificial Sequence
  chemically synthesized
tatacataatacctttgactat

SEQ ID NO: 43178 - DNA, 22 bp, Artificial Sequence
  chemically synthesized
tacataatacctttgactatat

SEQ ID NO: 43179 - DNA, 22 bp, Artificial Sequence
  chemically synthesized
tgactatatgtggagaaccaag

SEQ ID NO: 43180 - DNA, 22 bp, Artificial Sequence
  chemically synthesized
gactatatgtggagaaccaagg

SEQ ID NO: 43181 - DNA, 22 bp, Artificial Sequence
  chemically synthesized
actatatgtggagaaccaagga

SEQ ID NO: 43182 - DNA, 22 bp, Artificial Sequence
  chemically synthesized
tatgtggagaaccaaggaacat

SEQ ID NO: 43183 - DNA, 22 bp, Artificial Sequence
  chemically synthesized
gttgattgctcctaagttctct

SEQ ID NO: 43184 - DNA, 22 bp, Artificial Sequence
  chemically synthesized
attgctcctaagttctctggag

SEQ ID NO: 43185 - DNA, 22 bp, Artificial Sequence
  chemically synthesized
ctcctaagttctctggagaaag

SEQ ID NO: 43186 - DNA, 22 bp, Artificial Sequence
  chemically synthesized
ctaagttctctggagaaagaga

SEQ ID NO: 43187 - DNA, 22 bp, Artificial Sequence
  chemically synthesized
agttctctggagaaagagatga

SEQ ID NO: 43188 - DNA, 22 bp, Artificial Sequence
  chemically synthesized
tctggagaaagagatgaaagaa

SEQ ID NO: 43189 - DNA, 22 bp, Artificial Sequence
  chemically synthesized
tggagaaagagatgaaagaaaa

SEQ ID NO: 43190 - DNA, 22 bp, Artificial Sequence
  chemically synthesized
gagaaagagatgaaagaaaatg

SEQ ID NO: 43191 - DNA, 22 bp, Artificial Sequence
  chemically synthesized
aggggatctgtctcccaccttc

SEQ ID NO: 43192 - DNA, 22 bp, Artificial Sequence
  chemically synthesized
tctcccaccttcagaagcagat

SEQ ID NO: 43193 - DNA, 22 bp, Artificial Sequence
  chemically synthesized
ccaccttcagaagcagatactg

SEQ ID NO: 43194 - DNA, 22 bp, Artificial Sequence
  chemically synthesized
cagaagcagatactgagccaca

SEQ ID NO: 43195 - DNA, 22 bp, Artificial Sequence
  chemically synthesized
agaagcagatactgagccacaa

SEQ ID NO: 43196 - DNA, 22 bp, Artificial Sequence
  chemically synthesized
agccacaaatctgctaagattg

SEQ ID NO: 43197 - DNA, 22 bp, Artificial Sequence
  chemically synthesized
ctaagattgccctgaatgagag

SEQ ID NO: 43198 - DNA, 22 bp, Artificial Sequence
  chemically synthesized
agattgccctgaatgagagttt

SEQ ID NO: 43199 - DNA, 22 bp, Artificial Sequence
  chemically synthesized
ccctgaatgagagttttaactc

SEQ ID NO: 43200 - DNA, 22 bp, Artificial Sequence
  chemically synthesized
aatgagagttttaactcctgta

SEQ ID NO: 43201 - DNA, 22 bp, Artificial Sequence
  chemically synthesized
taactcctgtagagaaagagtt

SEQ ID NO: 43202 - DNA, 22 bp, Artificial Sequence
  chemically synthesized
aactcctgtagagaaagagttg

SEQ ID NO: 43203 - DNA, 22 bp, Artificial Sequence
  chemically synthesized
actcctgtagagaaagagttga

SEQ ID NO: 43204 - DNA, 22 bp, Artificial Sequence
  chemically synthesized
ctgtagagaaagagttgaaatt

SEQ ID NO: 43205 - DNA, 22 bp, Artificial Sequence
  chemically synthesized
tagagaaagagttgaaattgtg

SEQ ID NO: 43206 - DNA, 22 bp, Artificial Sequence
  chemically synthesized
aaattgtgaaaaaacagagaca

SEQ ID NO: 43207 - DNA, 22 bp, Artificial Sequence
  chemically synthesized
tgaaaaaacagagacaagctgt

SEQ ID NO: 43208 - DNA, 22 bp, Artificial Sequence
  chemically synthesized
ttatcatgcgagtagctgatct

SEQ ID NO: 43209 - DNA, 22 bp, Artificial Sequence
  chemically synthesized
tcatgcgagtagctgatctgca

SEQ ID NO: 43210 - DNA, 22 bp, Artificial Sequence
  chemically synthesized
atctgcaacaagaggtgcatgc

SEQ ID NO: 43211 - DNA, 22 bp, Artificial Sequence
  chemically synthesized
caacaagaggtgcatgcacagc

SEQ ID NO: 43212 - DNA, 22 bp, Artificial Sequence
  chemically synthesized
gccaggtgtttactgttaaagt

SEQ ID NO: 43213 - DNA, 22 bp, Artificial Sequence
  chemically synthesized
ccaggtgtttactgttaaagtg

SEQ ID NO: 43214 - DNA, 22 bp, Artificial Sequence
  chemically synthesized
actgttaaagtgagggcattga

SEQ ID NO: 43215 - DNA, 22 bp, Artificial Sequence
  chemically synthesized
ctgttaaagtgagggcattgac

SEQ ID NO: 43216 - DNA, 22 bp, Artificial Sequence
  chemically synthesized
ttaaagtgagggcattgactgg

SEQ ID NO: 43217 - DNA, 22 bp, Artificial Sequence
  chemically synthesized
aagtgagggcattgactggaaa

SEQ ID NO: 43218 - DNA, 22 bp, Artificial Sequence
  chemically synthesized
actggaaaaaaatgggaccctg

SEQ ID NO: 43219 - DNA, 22 bp, Artificial Sequence
  chemically synthesized
gaaaaaaatgggaccctggaac

SEQ ID NO: 43220 - DNA, 22 bp, Artificial Sequence
  chemically synthesized
gaacttggagtggggatgtgtg

SEQ ID NO: 43221 - DNA, 22 bp, Artificial Sequence
  chemically synthesized
ggagtggggatgtgtgggagaa

SEQ ID NO: 43222 - DNA, 22 bp, Artificial Sequence
  chemically synthesized
gagtggggatgtgtgggagaac

SEQ ID NO: 43223 - DNA, 22 bp, Artificial Sequence
  chemically synthesized
atgaagctgaggacactgagtt

SEQ ID NO: 43224 - DNA, 22 bp, Artificial Sequence
  chemically synthesized
aggacactgagtttgtgaactc

SEQ ID NO: 43225 - DNA, 22 bp, Artificial Sequence
  chemically synthesized
agtttgtgaactctgatgaaac

SEQ ID NO: 43226 - DNA, 22 bp, Artificial Sequence
  chemically synthesized
gtgaactctgatgaaacttttt

SEQ ID NO: 43227 - DNA, 22 bp, Artificial Sequence
  chemically synthesized
tgaactctgatgaaactttttt

SEQ ID NO: 43228 - DNA, 22 bp, Artificial Sequence
  chemically synthesized
tgatgaaacttttttgccagaa

SEQ ID NO: 43229 - DNA, 22 bp, Artificial Sequence
  chemically synthesized
atgaaacttttttgccagaaga

SEQ ID NO: 43230 - DNA, 22 bp, Artificial Sequence
  chemically synthesized
ttttgccagaagaaacagtttc

SEQ ID NO: 43231 - DNA, 22 bp, Artificial Sequence
  chemically synthesized
tttgccagaagaaacagtttcc

SEQ ID NO: 43232 - DNA, 22 bp, Artificial Sequence
  chemically synthesized
ttgccagaagaaacagtttccc

SEQ ID NO: 43233 - DNA, 22 bp, Artificial Sequence
  chemically synthesized
tgccagaagaaacagtttcccc

SEQ ID NO: 43234 - DNA, 22 bp, Artificial Sequence
  chemically synthesized
gccagaagaaacagtttcccca

SEQ ID NO: 43235 - DNA, 22 bp, Artificial Sequence
  chemically synthesized
ccagaagaaacagtttccccat

SEQ ID NO: 43236 - DNA, 22 bp, Artificial Sequence
  chemically synthesized
ccccatccccagtagtggtaac

SEQ ID NO: 43237 - DNA, 22 bp, Artificial Sequence
  chemically synthesized
cccatccccagtagtggtaaca

SEQ ID NO: 43238 - DNA, 22 bp, Artificial Sequence
  chemically synthesized
cctgacccgtgctgccattagc

SEQ ID NO: 43239 - DNA, 22 bp, Artificial Sequence
  chemically synthesized
acccgtgctgccattagccttt

SEQ ID NO: 43240 - DNA, 22 bp, Artificial Sequence
  chemically synthesized
ccattagcctttccacctttgt

SEQ ID NO: 43241 - DNA, 22 bp, Artificial Sequence
  chemically synthesized
gcctttccacctttgtctgagg

SEQ ID NO: 43242 - DNA, 22 bp, Artificial Sequence
  chemically synthesized
tccacctttgtctgaggatgta

SEQ ID NO: 43243 - DNA, 22 bp, Artificial Sequence
  chemically synthesized
ccacctttgtctgaggatgtaa

SEQ ID NO: 43244 - DNA, 22 bp, Artificial Sequence
  chemically synthesized
cacctttgtctgaggatgtaaa

SEQ ID NO: 43245 - DNA, 22 bp, Artificial Sequence
  chemically synthesized
tgtctgaggatgtaaaccctgc

SEQ ID NO: 43246 - DNA, 22 bp, Artificial Sequence
  chemically synthesized
gtctgaggatgtaaaccctgca

SEQ ID NO: 43247 - DNA, 22 bp, Artificial Sequence
  chemically synthesized
tctgaggatgtaaaccctgcac

SEQ ID NO: 43248 - DNA, 22 bp, Artificial Sequence
  chemically synthesized
aggatgtaaaccctgcactgct

SEQ ID NO: 43249 - DNA, 22 bp, Artificial Sequence
  chemically synthesized
cactgcttgaggcaacagtgat

SEQ ID NO: 43250 - DNA, 22 bp, Artificial Sequence
  chemically synthesized
cttgaggcaacagtgatggcct

SEQ ID NO: 43251 - DNA, 22 bp, Artificial Sequence
  chemically synthesized
gaggcaacagtgatggccttcc

SEQ ID NO: 43252 - DNA, 22 bp, Artificial Sequence
  chemically synthesized
aggcaacagtgatggccttccc

SEQ ID NO: 43253 - DNA, 22 bp, Artificial Sequence
  chemically synthesized
ccctgaggcagctgccaggcaa

SEQ ID NO: 43254 - DNA, 22 bp, Artificial Sequence
  chemically synthesized
cctgaggcagctgccaggcaag

SEQ ID NO: 43255 - DNA, 22 bp, Artificial Sequence
  chemically synthesized
aggcagctgccaggcaagataa

SEQ ID NO: 43256 - DNA, 22 bp, Artificial Sequence
  chemically synthesized
ccaggcaagataatgttgattc

SEQ ID NO: 43257 - DNA, 22 bp, Artificial Sequence
  chemically synthesized
attctcctcaagaggcacccct

SEQ ID NO: 43258 - DNA, 22 bp, Artificial Sequence
  chemically synthesized
tcctcaagaggcacccctaatg

SEQ ID NO: 43259 - DNA, 22 bp, Artificial Sequence
  chemically synthesized
ctcaagaggcacccctaatgcc

SEQ ID NO: 43260 - DNA, 22 bp, Artificial Sequence
  chemically synthesized
aagaggcacccctaatgcccct

SEQ ID NO: 43261 - DNA, 22 bp, Artificial Sequence
  chemically synthesized
atgcccctgaatgcttctagac

SEQ ID NO: 43262 - DNA, 22 bp, Artificial Sequence
  chemically synthesized
aatgcttctagacctataacta

SEQ ID NO: 43263 - DNA, 22 bp, Artificial Sequence
  chemically synthesized
ctagacctataactaggctaaa

SEQ ID NO: 43264 - DNA, 22 bp, Artificial Sequence
  chemically synthesized
tagacctataactaggctaaat

SEQ ID NO: 43265 - DNA, 22 bp, Artificial Sequence
  chemically synthesized
gacctataactaggctaaattc

SEQ ID NO: 43266 - DNA, 22 bp, Artificial Sequence
  chemically synthesized
taactaggctaaattccttgcg

SEQ ID NO: 43267 - DNA, 22 bp, Artificial Sequence
  chemically synthesized
ggctaaattccttgcgggcccc

SEQ ID NO: 43268 - DNA, 22 bp, Artificial Sequence
  chemically synthesized
aattccttgcgggccccagagg

SEQ ID NO: 43269 - DNA, 22 bp, Artificial Sequence
  chemically synthesized
cttgcgggccccagaggtgagg

SEQ ID NO: 43270 - DNA, 22 bp, Artificial Sequence
  chemically synthesized
gcgggccccagaggtgaggttc

SEQ ID NO: 43271 - DNA, 22 bp, Artificial Sequence
  chemically synthesized
cgggccccagaggtgaggttca

SEQ ID NO: 43272 - DNA, 22 bp, Artificial Sequence
  chemically synthesized
agagtgtgacccatgaggaggt

SEQ ID NO: 43273 - DNA, 22 bp, Artificial Sequence
  chemically synthesized
tactctaaaagaactgcttaag

SEQ ID NO: 43274 - DNA, 22 bp, Artificial Sequence
  chemically synthesized
taaaagaactgcttaagctttc

SEQ ID NO: 43275 - DNA, 22 bp, Artificial Sequence
  chemically synthesized
aaagaactgcttaagctttcta

SEQ ID NO: 43276 - DNA, 22 bp, Artificial Sequence
  chemically synthesized
cttaagctttctaatttatatt

SEQ ID NO: 43277 - DNA, 22 bp, Artificial Sequence
  chemically synthesized
aagctttctaatttatattggc

SEQ ID NO: 43278 - DNA, 22 bp, Artificial Sequence
  chemically synthesized
agctttctaatttatattggca

SEQ ID NO: 43279 - DNA, 22 bp, Artificial Sequence
  chemically synthesized
tctaatttatattggcagaaat

SEQ ID NO: 43280 - DNA, 22 bp, Artificial Sequence
  chemically synthesized
ctaatttatattggcagaaatc

SEQ ID NO: 43281 - DNA, 22 bp, Artificial Sequence
  chemically synthesized
taatttatattggcagaaatct

SEQ ID NO: 43282 - DNA, 22 bp, Artificial Sequence
  chemically synthesized
atttatattggcagaaatctgg

SEQ ID NO: 43283 - DNA, 22 bp, Artificial Sequence
  chemically synthesized
atattggcagaaatctggagaa

SEQ ID NO: 43284 - DNA, 22 bp, Artificial Sequence
  chemically synthesized
tattggcagaaatctggagaac

SEQ ID NO: 43285 - DNA, 22 bp, Artificial Sequence
  chemically synthesized
gcagaaatctggagaacaggca

SEQ ID NO: 43286 - DNA, 22 bp, Artificial Sequence
  chemically synthesized
gagaacaggcatgggaatggat

SEQ ID NO: 43287 - DNA, 22 bp, Artificial Sequence
  chemically synthesized
agggtaagggataatggtggaa

SEQ ID NO: 43288 - DNA, 22 bp, Artificial Sequence
  chemically synthesized
gatcaagctgaatttattggtt

SEQ ID NO: 43289 - DNA, 22 bp, Artificial Sequence
  chemically synthesized
aatttattggtttggccctact

SEQ ID NO: 43290 - DNA, 22 bp, Artificial Sequence
  chemically synthesized
attggtttggccctactaagta

SEQ ID NO: 43291 - DNA, 22 bp, Artificial Sequence
  chemically synthesized
ttggtttggccctactaagtag

SEQ ID NO: 43292 - DNA, 22 bp, Artificial Sequence
  chemically synthesized
gtttggccctactaagtaggga

SEQ ID NO: 43293 - DNA, 22 bp, Artificial Sequence
  chemically synthesized
ggccctactaagtagggattct

SEQ ID NO: 43294 - DNA, 22 bp, Artificial Sequence
  chemically synthesized
gccctactaagtagggattctg

SEQ ID NO: 43295 - DNA, 22 bp, Artificial Sequence
  chemically synthesized
ctaagtagggattctgcattta

SEQ ID NO: 43296 - DNA, 22 bp, Artificial Sequence
  chemically synthesized
agtagggattctgcatttaatg

SEQ ID NO: 43297 - DNA, 22 bp, Artificial Sequence
  chemically synthesized
tgcatttaatgttgcagctcgg

SEQ ID NO: 43298 - DNA, 22 bp, Artificial Sequence
  chemically synthesized
catttaatgttgcagctcgggg

SEQ ID NO: 43299 - DNA, 22 bp, Artificial Sequence
  chemically synthesized
aatgttgcagctcggggactta

SEQ ID NO: 43300 - DNA, 22 bp, Artificial Sequence
  chemically synthesized
atgttgcagctcggggacttag

SEQ ID NO: 43301 - DNA, 22 bp, Artificial Sequence
  chemically synthesized
cagctcggggacttagaaaagg

SEQ ID NO: 43302 - DNA, 22 bp, Artificial Sequence
  chemically synthesized
ggggacttagaaaaggttctga

SEQ ID NO: 43303 - DNA, 22 bp, Artificial Sequence
  chemically synthesized
agaaaaggttctgatagggccg

SEQ ID NO: 43304 - DNA, 22 bp, Artificial Sequence
  chemically synthesized
gaaaaggttctgatagggccgg

SEQ ID NO: 43305 - DNA, 22 bp, Artificial Sequence
  chemically synthesized
tgatagggccgggagcagtggc

SEQ ID NO: 43306 - DNA, 22 bp, Artificial Sequence
  chemically synthesized
atagggccgggagcagtggctc

SEQ ID NO: 43307 - DNA, 22 bp, Artificial Sequence
  chemically synthesized
acgcctgtaatcccagcacctt

SEQ ID NO: 43308 - DNA, 22 bp, Artificial Sequence
  chemically synthesized
taatcccagcaccttgggaggc

SEQ ID NO: 43309 - DNA, 22 bp, Artificial Sequence
  chemically synthesized
gggaggcgggggcgggcagatc

SEQ ID NO: 43310 - DNA, 22 bp, Artificial Sequence
  chemically synthesized
ggaggcgggggcgggcagatca

SEQ ID NO: 43311 - DNA, 22 bp, Artificial Sequence
  chemically synthesized
agacaattctggctaaaatggt

SEQ ID NO: 43312 - DNA, 22 bp, Artificial Sequence
  chemically synthesized
tggctaaaatggtgaaacccca

SEQ ID NO: 43313 - DNA, 22 bp, Artificial Sequence
  chemically synthesized
gctaaaatggtgaaaccccatc

SEQ ID NO: 43314 - DNA, 22 bp, Artificial Sequence
  chemically synthesized
aaatggtgaaaccccatctctg

SEQ ID NO: 43315 - DNA, 22 bp, Artificial Sequence
  chemically synthesized
tgctaaaaatacaaaaattagc

SEQ ID NO: 43316 - DNA, 22 bp, Artificial Sequence
  chemically synthesized
ctaaaaatacaaaaattagctg

SEQ ID NO: 43317 - DNA, 22 bp, Artificial Sequence
  chemically synthesized
aaaatacaaaaattagctgggc

SEQ ID NO: 43318 - DNA, 22 bp, Artificial Sequence
  chemically synthesized
gctgggcatggtgatgcgtaac

SEQ ID NO: 43319 - DNA, 22 bp, Artificial Sequence
  chemically synthesized
ggcatggtgatgcgtaactgta

SEQ ID NO: 43320 - DNA, 22 bp, Artificial Sequence
  chemically synthesized
taatctcatctacttgggaggc

SEQ ID NO: 43321 - DNA, 22 bp, Artificial Sequence
  chemically synthesized
atctacttgggaggctgaggca

SEQ ID NO: 43322 - DNA, 22 bp, Artificial Sequence
  chemically synthesized
cttgggaggctgaggcaagaga

SEQ ID NO: 43323 - DNA, 22 bp, Artificial Sequence
  chemically synthesized
gggaggctgaggcaagagaact

SEQ ID NO: 43324 - DNA, 22 bp, Artificial Sequence
  chemically synthesized
ggaggctgaggcaagagaactg

SEQ ID NO: 43325 - DNA, 22 bp, Artificial Sequence
  chemically synthesized
aggcaagagaactgcttgaacc

SEQ ID NO: 43326 - DNA, 22 bp, Artificial Sequence
  chemically synthesized
cttgaacctgtgaggcagagat

SEQ ID NO: 43327 - DNA, 22 bp, Artificial Sequence
  chemically synthesized
gaacctgtgaggcagagattgc

SEQ ID NO: 43328 - DNA, 22 bp, Artificial Sequence
  chemically synthesized
aacctgtgaggcagagattgca

SEQ ID NO: 43329 - DNA, 22 bp, Artificial Sequence
  chemically synthesized
tgaggcagagattgcagtgagc

SEQ ID NO: 43330 - DNA, 22 bp, Artificial Sequence
  chemically synthesized
cagtgagccaagatcgccccac

SEQ ID NO: 43331 - DNA, 22 bp, Artificial Sequence
  chemically synthesized
cattccagcctggtaacagagc

SEQ ID NO: 43332 - DNA, 22 bp, Artificial Sequence
  chemically synthesized
cagcctggtaacagagcaagac

SEQ ID NO: 43333 - DNA, 22 bp, Artificial Sequence
  chemically synthesized
gtaacagagcaagactccattt

SEQ ID NO: 43334 - DNA, 22 bp, Artificial Sequence
  chemically synthesized
catttccaaaaaaaaaaaaaaa

SEQ ID NO: 43335 - DNA, 22 bp, Artificial Sequence
  chemically synthesized
ccaaaaaaaaaaaaaaaaaagt

SEQ ID NO: 43336 - DNA, 22 bp, Artificial Sequence
  chemically synthesized
caaaaaaaaaaaaaaaaaagtt

SEQ ID NO: 43337 - DNA, 22 bp, Artificial Sequence
  chemically synthesized
taatagtttatttgcttggtta

SEQ ID NO: 43338 - DNA, 22 bp, Artificial Sequence
  chemically synthesized
atttgcttggttagctgaaata

SEQ ID NO: 43339 - DNA, 22 bp, Artificial Sequence
  chemically synthesized
tttgcttggttagctgaaatat

SEQ ID NO: 43340 - DNA, 22 bp, Artificial Sequence
  chemically synthesized
gcttggttagctgaaatatgga

SEQ ID NO: 43341 - DNA, 22 bp, Artificial Sequence
  chemically synthesized
cttggttagctgaaatatggat

SEQ ID NO: 43342 - DNA, 22 bp, Artificial Sequence
  chemically synthesized
ggttagctgaaatatggattaa

SEQ ID NO: 43343 - DNA, 22 bp, Artificial Sequence
  chemically synthesized
gttagctgaaatatggattaaa

SEQ ID NO: 43344 - DNA, 22 bp, Artificial Sequence
  chemically synthesized
gctgaaatatggattaaaagat

SEQ ID NO: 43345 - DNA, 22 bp, Artificial Sequence
  chemically synthesized
aaatatggattaaaagatggtc

SEQ ID NO: 43346 - DNA, 22 bp, Artificial Sequence
  chemically synthesized
aaagatggtccaatgttagtga

SEQ ID NO: 43347 - DNA, 22 bp, Artificial Sequence
  chemically synthesized
gtgagctggaaatgccttggtt

SEQ ID NO: 43348 - DNA, 22 bp, Artificial Sequence
  chemically synthesized
gaaatgccttggtttaatgtag

SEQ ID NO: 43349 - DNA, 22 bp, Artificial Sequence
  chemically synthesized
ggtttaatgtagaggaagtgat

SEQ ID NO: 43350 - DNA, 22 bp, Artificial Sequence
  chemically synthesized
gtttaatgtagaggaagtgatc

SEQ ID NO: 43351 - DNA, 22 bp, Artificial Sequence
  chemically synthesized
aatgtagaggaagtgatccaaa

SEQ ID NO: 43352 - DNA, 22 bp, Artificial Sequence
  chemically synthesized
atgtagaggaagtgatccaaag

SEQ ID NO: 43353 - DNA, 22 bp, Artificial Sequence
  chemically synthesized
agggagattaggatggtggagt

SEQ ID NO: 43354 - DNA, 22 bp, Artificial Sequence
  chemically synthesized
gggagattaggatggtggagtg

SEQ ID NO: 43355 - DNA, 22 bp, Artificial Sequence
  chemically synthesized
ggatggtggagtggattagtca

SEQ ID NO: 43356 - DNA, 22 bp, Artificial Sequence
  chemically synthesized
gtcactttagacctactcatcc

SEQ ID NO: 43357 - DNA, 22 bp, Artificial Sequence
  chemically synthesized
tagacctactcatcccagctgg

SEQ ID NO: 43358 - DNA, 22 bp, Artificial Sequence
  chemically synthesized
agacctactcatcccagctggg

SEQ ID NO: 43359 - DNA, 22 bp, Artificial Sequence
  chemically synthesized
gacctactcatcccagctggga

SEQ ID NO: 43360 - DNA, 22 bp, Artificial Sequence
  chemically synthesized
ctcatcccagctgggagggtcc

SEQ ID NO: 43361 - DNA, 22 bp, Artificial Sequence
  chemically synthesized
atcccagctgggagggtccaga

SEQ ID NO: 43362 - DNA, 22 bp, Artificial Sequence
  chemically synthesized
ggagggtccagaagatacaccc

SEQ ID NO: 43363 - DNA, 22 bp, Artificial Sequence
  chemically synthesized
ggccgaagctttgtgaaataga

SEQ ID NO: 43364 - DNA, 22 bp, Artificial Sequence
  chemically synthesized
gccgaagctttgtgaaatagat

SEQ ID NO: 43365 - DNA, 22 bp, Artificial Sequence
  chemically synthesized
tgtgaaatagatttgtgagagc

SEQ ID NO: 43366 - DNA, 22 bp, Artificial Sequence
  chemically synthesized
gtgaaatagatttgtgagagca

SEQ ID NO: 43367 - DNA, 22 bp, Artificial Sequence
  chemically synthesized
tgaaatagatttgtgagagcag

SEQ ID NO: 43368 - DNA, 22 bp, Artificial Sequence
  chemically synthesized
gtgagagcagcacctgtatttt

SEQ ID NO: 43369 - DNA, 22 bp, Artificial Sequence
  chemically synthesized
tgagagcagcacctgtattttt

SEQ ID NO: 43370 - DNA, 22 bp, Artificial Sequence
  chemically synthesized
tatttttgaagagcccgtaatt

SEQ ID NO: 43371 - DNA, 22 bp, Artificial Sequence
  chemically synthesized
ttgaagagcccgtaattgctct

SEQ ID NO: 43372 - DNA, 22 bp, Artificial Sequence
  chemically synthesized
tgaagagcccgtaattgctctt

SEQ ID NO: 43373 - DNA, 22 bp, Artificial Sequence
  chemically synthesized
gaagagcccgtaattgctcttc

SEQ ID NO: 43374 - DNA, 22 bp, Artificial Sequence
  chemically synthesized
aagagcccgtaattgctcttct

SEQ ID NO: 43375 - DNA, 22 bp, Artificial Sequence
  chemically synthesized
ctcttctctgtatgtcagatct

SEQ ID NO: 43376 - DNA, 22 bp, Artificial Sequence
  chemically synthesized
ttctctgtatgtcagatctaac

SEQ ID NO: 43377 - DNA, 22 bp, Artificial Sequence
  chemically synthesized
ctctgtatgtcagatctaacag

SEQ ID NO: 43378 - DNA, 22 bp, Artificial Sequence
  chemically synthesized
tctgtatgtcagatctaacagt

SEQ ID NO: 43379 - DNA, 22 bp, Artificial Sequence
  chemically synthesized
tgtatgtcagatctaacagtag

SEQ ID NO: 43380 - DNA, 22 bp, Artificial Sequence
  chemically synthesized
tatgtcagatctaacagtagga

SEQ ID NO: 43381 - DNA, 22 bp, Artificial Sequence
  chemically synthesized
acagtaggaaccacagtcactc

SEQ ID NO: 43382 - DNA, 22 bp, Artificial Sequence
  chemically synthesized
aactacaaaatttaaatacaat

SEQ ID NO: 43383 - DNA, 22 bp, Artificial Sequence
  chemically synthesized
caaaatttaaatacaatgggaa

SEQ ID NO: 43384 - DNA, 22 bp, Artificial Sequence
  chemically synthesized
aaatacaatgggaataattgga

SEQ ID NO: 43385 - DNA, 22 bp, Artificial Sequence
  chemically synthesized
aatacaatgggaataattggat

SEQ ID NO: 43386 - DNA, 22 bp, Artificial Sequence
  chemically synthesized
gatcctgaggtggcaggggcca

SEQ ID NO: 43387 - DNA, 22 bp, Artificial Sequence
  chemically synthesized
aggtggcaggggccaagtgttg

SEQ ID NO: 43388 - DNA, 22 bp, Artificial Sequence
  chemically synthesized
gcactgaaccatcaaaggcaag

SEQ ID NO: 43389 - DNA, 22 bp, Artificial Sequence
  chemically synthesized
aaccatcaaaggcaaggtgggc

SEQ ID NO: 43390 - DNA, 22 bp, Artificial Sequence
  chemically synthesized
ccataatagacagcagaggcaa

SEQ ID NO: 43391 - DNA, 22 bp, Artificial Sequence
  chemically synthesized
actcatgtagagctctggcatt

SEQ ID NO: 43392 - DNA, 22 bp, Artificial Sequence
  chemically synthesized
atgtagagctctggcattggct

SEQ ID NO: 43393 - DNA, 22 bp, Artificial Sequence
  chemically synthesized
tggcattggctaattaatcatg

SEQ ID NO: 43394 - DNA, 22 bp, Artificial Sequence
  chemically synthesized
gcattggctaattaatcatggt

SEQ ID NO: 43395 - DNA, 22 bp, Artificial Sequence
  chemically synthesized
gctaattaatcatggtgttcct

SEQ ID NO: 43396 - DNA, 22 bp, Artificial Sequence
  chemically synthesized
attaatcatggtgttcctagaa

SEQ ID NO: 43397 - DNA, 22 bp, Artificial Sequence
  chemically synthesized
atcatggtgttcctagaagtga

SEQ ID NO: 43398 - DNA, 22 bp, Artificial Sequence
  chemically synthesized
ctagaagtgaaattgatgggaa

SEQ ID NO: 43399 - DNA, 22 bp, Artificial Sequence
  chemically synthesized
gaagtgaaattgatgggaaacc

SEQ ID NO: 43400 - DNA, 22 bp, Artificial Sequence
  chemically synthesized
atgggaaacctactgtattcct

SEQ ID NO: 43401 - DNA, 22 bp, Artificial Sequence
  chemically synthesized
ctgtattcctacttgatttata

SEQ ID NO: 43402 - DNA, 22 bp, Artificial Sequence
  chemically synthesized
tattcctacttgatttatataa

SEQ ID NO: 43403 - DNA, 22 bp, Artificial Sequence
  chemically synthesized
ctacttgatttatataaacaaa

SEQ ID NO: 43404 - DNA, 22 bp, Artificial Sequence
  chemically synthesized
cttgatttatataaacaaaaaa

SEQ ID NO: 43405 - DNA, 22 bp, Artificial Sequence
  chemically synthesized
gatttatataaacaaaaaactg

SEQ ID NO: 43406 - DNA, 22 bp, Artificial Sequence
  chemically synthesized
atttatataaacaaaaaactgc

SEQ ID NO: 43407 - DNA, 22 bp, Artificial Sequence
  chemically synthesized
atataaacaaaaaactgccagg

SEQ ID NO: 43408 - DNA, 22 bp, Artificial Sequence
  chemically synthesized
tataaacaaaaaactgccaggt

SEQ ID NO: 43409 - DNA, 22 bp, Artificial Sequence
  chemically synthesized
ccaggtagaatggactaaagac

SEQ ID NO: 43410 - DNA, 22 bp, Artificial Sequence
  chemically synthesized
aagactaatctgaattataaaa

SEQ ID NO: 43411 - DNA, 22 bp, Artificial Sequence
  chemically synthesized
atctgaattataaaaacagaga

SEQ ID NO: 43412 - DNA, 22 bp, Artificial Sequence
  chemically synthesized
aattataaaaacagagaatcat

SEQ ID NO: 43413 - DNA, 22 bp, Artificial Sequence
  chemically synthesized
taaaaacagagaatcatgggcc

SEQ ID NO: 43414 - DNA, 22 bp, Artificial Sequence
  chemically synthesized
aatcaatttccagactcgaacc

SEQ ID NO: 43415 - DNA, 22 bp, Artificial Sequence
  chemically synthesized
ccagactcgaacctgttacagt

SEQ ID NO: 43416 - DNA, 22 bp, Artificial Sequence
  chemically synthesized
cagactcgaacctgttacagtt

SEQ ID NO: 43417 - DNA, 22 bp, Artificial Sequence
  chemically synthesized
gaacctgttacagttccagaac

SEQ ID NO: 43418 - DNA, 22 bp, Artificial Sequence
  chemically synthesized
ttacagttccagaacccactga

SEQ ID NO: 43419 - DNA, 22 bp, Artificial Sequence
  chemically synthesized
cagttccagaacccactgaatg

SEQ ID NO: 43420 - DNA, 22 bp, Artificial Sequence
  chemically synthesized
cagaacccactgaatgaagggg

SEQ ID NO: 43421 - DNA, 22 bp, Artificial Sequence
  chemically synthesized
aatgaaggggaggctggatccc

SEQ ID NO: 43422 - DNA, 22 bp, Artificial Sequence
  chemically synthesized
gatccccttgaggaaggacacc

SEQ ID NO: 43423 - DNA, 22 bp, Artificial Sequence
  chemically synthesized
gaggaaggacaccactaggcta

SEQ ID NO: 43424 - DNA, 22 bp, Artificial Sequence
  chemically synthesized
aggaaggacaccactaggctac

SEQ ID NO: 43425 - DNA, 22 bp, Artificial Sequence
  chemically synthesized
ggctactgacaacttatgctgt

SEQ ID NO: 43426 - DNA, 22 bp, Artificial Sequence
  chemically synthesized
ctgacaacttatgctgttactc

SEQ ID NO: 43427 - DNA, 22 bp, Artificial Sequence
  chemically synthesized
acaacttatgctgttactcttt

SEQ ID NO: 43428 - DNA, 22 bp, Artificial Sequence
  chemically synthesized
atgctgttactctttctcccat

SEQ ID NO: 43429 - DNA, 22 bp, Artificial Sequence
  chemically synthesized
tgctgttactctttctcccatc

SEQ ID NO: 43430 - DNA, 22 bp, Artificial Sequence
  chemically synthesized
ttactctttctcccatccttcc

SEQ ID NO: 43431 - DNA, 22 bp, Artificial Sequence
  chemically synthesized
ctctttctcccatccttcccta

SEQ ID NO: 43432 - DNA, 22 bp, Artificial Sequence
  chemically synthesized
tttctcccatccttccctaagg

SEQ ID NO: 43433 - DNA, 22 bp, Artificial Sequence
  chemically synthesized
tctcccatccttccctaaggag

SEQ ID NO: 43434 - DNA, 22 bp, Artificial Sequence
  chemically synthesized
ctcccatccttccctaaggaga

SEQ ID NO: 43435 - DNA, 22 bp, Artificial Sequence
  chemically synthesized
tcccatccttccctaaggagac

SEQ ID NO: 43436 - DNA, 22 bp, Artificial Sequence
  chemically synthesized
ccatccttccctaaggagacct

SEQ ID NO: 43437 - DNA, 22 bp, Artificial Sequence
  chemically synthesized
ccctaaggagacctctggcctt

SEQ ID NO: 43438 - DNA, 22 bp, Artificial Sequence
  chemically synthesized
cctaaggagacctctggccttt

SEQ ID NO: 43439 - DNA, 22 bp, Artificial Sequence
  chemically synthesized
aggagacctctggccttttacc

SEQ ID NO: 43440 - DNA, 22 bp, Artificial Sequence
  chemically synthesized
tggccttttaccagggtaactg

SEQ ID NO: 43441 - DNA, 22 bp, Artificial Sequence
  chemically synthesized
gccttttaccagggtaactgtg

SEQ ID NO: 43442 - DNA, 22 bp, Artificial Sequence
  chemically synthesized
ttaccagggtaactgtgtgtac

SEQ ID NO: 43443 - DNA, 22 bp, Artificial Sequence
  chemically synthesized
taccagggtaactgtgtgtact

SEQ ID NO: 43444 - DNA, 22 bp, Artificial Sequence
  chemically synthesized
accagggtaactgtgtgtactg

SEQ ID NO: 43445 - DNA, 22 bp, Artificial Sequence
  chemically synthesized
ccagggtaactgtgtgtactgg

SEQ ID NO: 43446 - DNA, 22 bp, Artificial Sequence
  chemically synthesized
tgtgtactggagaaagggaagt

SEQ ID NO: 43447 - DNA, 22 bp, Artificial Sequence
  chemically synthesized
gagaaagggaagtaatgagaca

SEQ ID NO: 43448 - DNA, 22 bp, Artificial Sequence
  chemically synthesized
cagaaagtactggacactggct

SEQ ID NO: 43449 - DNA, 22 bp, Artificial Sequence
  chemically synthesized
agaaagtactggacactggctc

SEQ ID NO: 43450 - DNA, 22 bp, Artificial Sequence
  chemically synthesized
gacactggctctgagctgacgt

SEQ ID NO: 43451 - DNA, 22 bp, Artificial Sequence
  chemically synthesized
gctctgagctgacgttgattcc

SEQ ID NO: 43452 - DNA, 22 bp, Artificial Sequence
  chemically synthesized
tgagctgacgttgattccaggg

SEQ ID NO: 43453 - DNA, 22 bp, Artificial Sequence
  chemically synthesized
agctgacgttgattccagggta

SEQ ID NO: 43454 - DNA, 22 bp, Artificial Sequence
  chemically synthesized
acgttgattccagggtacccaa

SEQ ID NO: 43455 - DNA, 22 bp, Artificial Sequence
  chemically synthesized
attccagggtacccaaaacgtt

SEQ ID NO: 43456 - DNA, 22 bp, Artificial Sequence
  chemically synthesized
cagggtacccaaaacgttattg

SEQ ID NO: 43457 - DNA, 22 bp, Artificial Sequence
  chemically synthesized
ttgtggttccccagttaaagta

SEQ ID NO: 43458 - DNA, 22 bp, Artificial Sequence
  chemically synthesized
tggttccccagttaaagtaggg

SEQ ID NO: 43459 - DNA, 22 bp, Artificial Sequence
  chemically synthesized
cccagttaaagtaggggcttat

SEQ ID NO: 43460 - DNA, 22 bp, Artificial Sequence
  chemically synthesized
aagtaggggcttatggaggtta

SEQ ID NO: 43461 - DNA, 22 bp, Artificial Sequence
  chemically synthesized
atggaggttaggtaattaatgg

SEQ ID NO: 43462 - DNA, 22 bp, Artificial Sequence
  chemically synthesized
tggaggttaggtaattaatgga

SEQ ID NO: 43463 - DNA, 22 bp, Artificial Sequence
  chemically synthesized
ggtaattaatggagttttagct

SEQ ID NO: 43464 - DNA, 22 bp, Artificial Sequence
  chemically synthesized
atggagttttagctcatttctg

SEQ ID NO: 43465 - DNA, 22 bp, Artificial Sequence
  chemically synthesized
tagctcatttctgacttacagt

SEQ ID NO: 43466 - DNA, 22 bp, Artificial Sequence
  chemically synthesized
agctcatttctgacttacagtg

SEQ ID NO: 43467 - DNA, 22 bp, Artificial Sequence
  chemically synthesized
gctcatttctgacttacagtgg

SEQ ID NO: 43468 - DNA, 22 bp, Artificial Sequence
  chemically synthesized
atttctgacttacagtggttcc

SEQ ID NO: 43469 - DNA, 22 bp, Artificial Sequence
  chemically synthesized
ctgacttacagtggttccagtg

SEQ ID NO: 43470 - DNA, 22 bp, Artificial Sequence
  chemically synthesized
tgacttacagtggttccagtgg

SEQ ID NO: 43471 - DNA, 22 bp, Artificial Sequence
  chemically synthesized
acttacagtggttccagtgggt

SEQ ID NO: 43472 - DNA, 22 bp, Artificial Sequence
  chemically synthesized
acagtggttccagtgggtccct

SEQ ID NO: 43473 - DNA, 22 bp, Artificial Sequence
  chemically synthesized
cagtggttccagtgggtccctg

SEQ ID NO: 43474 - DNA, 22 bp, Artificial Sequence
  chemically synthesized
cagtgggtccctggacttatcc

SEQ ID NO: 43475 - DNA, 22 bp, Artificial Sequence
  chemically synthesized
gacttatcctctggtcattttc

SEQ ID NO: 43476 - DNA, 22 bp, Artificial Sequence
  chemically synthesized
atcctctggtcattttcccagt

SEQ ID NO: 43477 - DNA, 22 bp, Artificial Sequence
  chemically synthesized
tcctctggtcattttcccagtg

SEQ ID NO: 43478 - DNA, 22 bp, Artificial Sequence
  chemically synthesized
tggtcattttcccagtgccaaa

SEQ ID NO: 43479 - DNA, 22 bp, Artificial Sequence
  chemically synthesized
gtcattttcccagtgccaaaat

SEQ ID NO: 43480 - DNA, 22 bp, Artificial Sequence
  chemically synthesized
tcccagtgccaaaatgcataat

SEQ ID NO: 43481 - DNA, 22 bp, Artificial Sequence
  chemically synthesized
cccagtgccaaaatgcataatt

SEQ ID NO: 43482 - DNA, 22 bp, Artificial Sequence
  chemically synthesized
ccagtgccaaaatgcataattt

SEQ ID NO: 43483 - DNA, 22 bp, Artificial Sequence
  chemically synthesized
gtatagacatacttattagctg

SEQ ID NO: 43484 - DNA, 22 bp, Artificial Sequence
  chemically synthesized
tatagacatacttattagctgg

SEQ ID NO: 43485 - DNA, 22 bp, Artificial Sequence
  chemically synthesized
attagctggcagaaatgccaca

SEQ ID NO: 43486 - DNA, 22 bp, Artificial Sequence
  chemically synthesized
ttagctggcagaaatgccacat

SEQ ID NO: 43487 - DNA, 22 bp, Artificial Sequence
  chemically synthesized
gctggcagaaatgccacattgg

SEQ ID NO: 43488 - DNA, 22 bp, Artificial Sequence
  chemically synthesized
gcagaaatgccacattggctcc

SEQ ID NO: 43489 - DNA, 22 bp, Artificial Sequence
  chemically synthesized
gctccctgactggtaggatgag

SEQ ID NO: 43490 - DNA, 22 bp, Artificial Sequence
  chemically synthesized
cctgactggtaggatgagggct

SEQ ID NO: 43491 - DNA, 22 bp, Artificial Sequence
  chemically synthesized
actggtaggatgagggctatta

SEQ ID NO: 43492 - DNA, 22 bp, Artificial Sequence
  chemically synthesized
gtaggatgagggctattatggt

SEQ ID NO: 43493 - DNA, 22 bp, Artificial Sequence
  chemically synthesized
ttatggtgggaaaggccaaaca

SEQ ID NO: 43494 - DNA, 22 bp, Artificial Sequence
  chemically synthesized
tggtgggaaaggccaaacagaa

SEQ ID NO: 43495 - DNA, 22 bp, Artificial Sequence
  chemically synthesized
gagctgtctctacctagaaaaa

SEQ ID NO: 43496 - DNA, 22 bp, Artificial Sequence
  chemically synthesized
tctctacctagaaaaataaaaa

SEQ ID NO: 43497 - DNA, 22 bp, Artificial Sequence
  chemically synthesized
tacctagaaaaataaaaaaatc

SEQ ID NO: 43498 - DNA, 22 bp, Artificial Sequence
  chemically synthesized
cctagaaaaataaaaaaatcaa

SEQ ID NO: 43499 - DNA, 22 bp, Artificial Sequence
  chemically synthesized
gaaaaataaaaaaatcaaaaac

SEQ ID NO: 43500 - DNA, 22 bp, Artificial Sequence
  chemically synthesized
gagggactgaagtgattagtgt

SEQ ID NO: 43501 - DNA, 22 bp, Artificial Sequence
  chemically synthesized
aagtgattagtgtcaccatcaa

SEQ ID NO: 43502 - DNA, 22 bp, Artificial Sequence
  chemically synthesized
gtgtcaccatcaaggacttgaa

SEQ ID NO: 43503 - DNA, 22 bp, Artificial Sequence
  chemically synthesized
gaaagacgcaggggtggtgatt

SEQ ID NO: 43504 - DNA, 22 bp, Artificial Sequence
  chemically synthesized
aaagacgcaggggtggtgattc

SEQ ID NO: 43505 - DNA, 22 bp, Artificial Sequence
  chemically synthesized
ccaccacatccctgttcaactc

SEQ ID NO: 43506 - DNA, 22 bp, Artificial Sequence
  chemically synthesized
ttcaactctcccatttgacctg

SEQ ID NO: 43507 - DNA, 22 bp, Artificial Sequence
  chemically synthesized
aactctcccatttgacctgtgc

SEQ ID NO: 43508 - DNA, 22 bp, Artificial Sequence
  chemically synthesized
tcccatttgacctgtgcagagg

SEQ ID NO: 43509 - DNA, 22 bp, Artificial Sequence
  chemically synthesized
ccatttgacctgtgcagaggac

SEQ ID NO: 43510 - DNA, 22 bp, Artificial Sequence
  chemically synthesized
gacctgtgcagaggacagatgg

SEQ ID NO: 43511 - DNA, 22 bp, Artificial Sequence
  chemically synthesized
acctgtgcagaggacagatgga

SEQ ID NO: 43512 - DNA, 22 bp, Artificial Sequence
  chemically synthesized
tgcagaggacagatggatcttg

SEQ ID NO: 43513 - DNA, 22 bp, Artificial Sequence
  chemically synthesized
ggaaaatgatggtggattattt

SEQ ID NO: 43514 - DNA, 22 bp, Artificial Sequence
  chemically synthesized
gaaaatgatggtggattatttt

SEQ ID NO: 43515 - DNA, 22 bp, Artificial Sequence
  chemically synthesized
ttttaagcttaaccaagtggtg

SEQ ID NO: 43516 - DNA, 22 bp, Artificial Sequence
  chemically synthesized
taagcttaaccaagtggtgact

SEQ ID NO: 43517 - DNA, 22 bp, Artificial Sequence
  chemically synthesized
aagcttaaccaagtggtgactc

SEQ ID NO: 43518 - DNA, 22 bp, Artificial Sequence
  chemically synthesized
agcttaaccaagtggtgactcc

SEQ ID NO: 43519 - DNA, 22 bp, Artificial Sequence
  chemically synthesized
aaccaagtggtgactccaattg

SEQ ID NO: 43520 - DNA, 22 bp, Artificial Sequence
  chemically synthesized
accaagtggtgactccaattgc

SEQ ID NO: 43521 - DNA, 22 bp, Artificial Sequence
  chemically synthesized
caattgcagctgctctaccagt

SEQ ID NO: 43522 - DNA, 22 bp, Artificial Sequence
  chemically synthesized
cagctgctctaccagttgtggt

SEQ ID NO: 43523 - DNA, 22 bp, Artificial Sequence
  chemically synthesized
ctctaccagttgtggttttgtt

SEQ ID NO: 43524 - DNA, 22 bp, Artificial Sequence
  chemically synthesized
taccagttgtggttttgttgct

SEQ ID NO: 43525 - DNA, 22 bp, Artificial Sequence
  chemically synthesized
ccagttgtggttttgttgcttg

SEQ ID NO: 43526 - DNA, 22 bp, Artificial Sequence
  chemically synthesized
tggttttgttgcttgagcaaat

SEQ ID NO: 43527 - DNA, 22 bp, Artificial Sequence
  chemically synthesized
tgttgcttgagcaaattaacac

SEQ ID NO: 43528 - DNA, 22 bp, Artificial Sequence
  chemically synthesized
gttgcttgagcaaattaacaca

SEQ ID NO: 43529 - DNA, 22 bp, Artificial Sequence
  chemically synthesized
ttgcttgagcaaattaacacat

SEQ ID NO: 43530 - DNA, 22 bp, Artificial Sequence
  chemically synthesized
cttgagcaaattaacacatctc

SEQ ID NO: 43531 - DNA, 22 bp, Artificial Sequence
  chemically synthesized
gagcaaattaacacatctcctg

SEQ ID NO: 43532 - DNA, 22 bp, Artificial Sequence
  chemically synthesized
agcaaattaacacatctcctgg

SEQ ID NO: 43533 - DNA, 22 bp, Artificial Sequence
  chemically synthesized
acacatctcctggtgcctggta

SEQ ID NO: 43534 - DNA, 22 bp, Artificial Sequence
  chemically synthesized
ctggtgcctggtatgcagccat

SEQ ID NO: 43535 - DNA, 22 bp, Artificial Sequence
  chemically synthesized
gtgcctggtatgcagccattgg

SEQ ID NO: 43536 - DNA, 22 bp, Artificial Sequence
  chemically synthesized
gtatgcagccattggcttggca

SEQ ID NO: 43537 - DNA, 22 bp, Artificial Sequence
  chemically synthesized
gcttggcaagtggctttttctc

SEQ ID NO: 43538 - DNA, 22 bp, Artificial Sequence
  chemically synthesized
ggcaagtggctttttctccatt

SEQ ID NO: 43539 - DNA, 22 bp, Artificial Sequence
  chemically synthesized
gcaagtggctttttctccattc

SEQ ID NO: 43540 - DNA, 22 bp, Artificial Sequence
  chemically synthesized
tttctccattcctgtccataag

SEQ ID NO: 43541 - DNA, 22 bp, Artificial Sequence
  chemically synthesized
ttctccattcctgtccataaga

SEQ ID NO: 43542 - DNA, 22 bp, Artificial Sequence
  chemically synthesized
tctccattcctgtccataagac

SEQ ID NO: 43543 - DNA, 22 bp, Artificial Sequence
  chemically synthesized
ctccattcctgtccataagacc

SEQ ID NO: 43544 - DNA, 22 bp, Artificial Sequence
  chemically synthesized
tccattcctgtccataagaccc

SEQ ID NO: 43545 - DNA, 22 bp, Artificial Sequence
  chemically synthesized
cattcctgtccataagacccac

SEQ ID NO: 43546 - DNA, 22 bp, Artificial Sequence
  chemically synthesized
ctgtccataagacccaccagaa

SEQ ID NO: 43547 - DNA, 22 bp, Artificial Sequence
  chemically synthesized
tccataagacccaccagaagca

SEQ ID NO: 43548 - DNA, 22 bp, Artificial Sequence
  chemically synthesized
gccttcagctgacaaggccagc

SEQ ID NO: 43549 - DNA, 22 bp, Artificial Sequence
  chemically synthesized
ccttcagctgacaaggccagca

SEQ ID NO: 43550 - DNA, 22 bp, Artificial Sequence
  chemically synthesized
cagctgacaaggccagcattat

SEQ ID NO: 43551 - DNA, 22 bp, Artificial Sequence
  chemically synthesized
agctgacaaggccagcattata

SEQ ID NO: 43552 - DNA, 22 bp, Artificial Sequence
  chemically synthesized
acaaggccagcattataccttt

SEQ ID NO: 43553 - DNA, 22 bp, Artificial Sequence
  chemically synthesized
tacctttaccaccctacctcag

SEQ ID NO: 43554 - DNA, 22 bp, Artificial Sequence
  chemically synthesized
taccaccctacctcaggggtgt

SEQ ID NO: 43555 - DNA, 22 bp, Artificial Sequence
  chemically synthesized
accaccctacctcaggggtgta

SEQ ID NO: 43556 - DNA, 22 bp, Artificial Sequence
  chemically synthesized
ccaccctacctcaggggtgtat

SEQ ID NO: 43557 - DNA, 22 bp, Artificial Sequence
  chemically synthesized
cctcaggggtgtatcaactctc

SEQ ID NO: 43558 - DNA, 22 bp, Artificial Sequence
  chemically synthesized
aggggtgtatcaactctccagc

SEQ ID NO: 43559 - DNA, 22 bp, Artificial Sequence
  chemically synthesized
tccagctttgtgtcataatctt

SEQ ID NO: 43560 - DNA, 22 bp, Artificial Sequence
  chemically synthesized
cagctttgtgtcataatcttat

SEQ ID NO: 43561 - DNA, 22 bp, Artificial Sequence
  chemically synthesized
tgtgtcataatcttatttggag

SEQ ID NO: 43562 - DNA, 22 bp, Artificial Sequence
  chemically synthesized
gtgtcataatcttatttggaga

SEQ ID NO: 43563 - DNA, 22 bp, Artificial Sequence
  chemically synthesized
tgtcataatcttatttggagag

SEQ ID NO: 43564 - DNA, 22 bp, Artificial Sequence
  chemically synthesized
atttggagagaccttgctcgct

SEQ ID NO: 43565 - DNA, 22 bp, Artificial Sequence
  chemically synthesized
tttggagagaccttgctcgctt

SEQ ID NO: 43566 - DNA, 22 bp, Artificial Sequence
  chemically synthesized
ggagagaccttgctcgcttttc

SEQ ID NO: 43567 - DNA, 22 bp, Artificial Sequence
  chemically synthesized
gagagaccttgctcgcttttca

SEQ ID NO: 43568 - DNA, 22 bp, Artificial Sequence
  chemically synthesized
gctcgcttttcacttccacgag

SEQ ID NO: 43569 - DNA, 22 bp, Artificial Sequence
  chemically synthesized
ctcgcttttcacttccacgaga

SEQ ID NO: 43570 - DNA, 22 bp, Artificial Sequence
  chemically synthesized
gcttttcacttccacgagatat

SEQ ID NO: 43571 - DNA, 22 bp, Artificial Sequence
  chemically synthesized
ttcacttccacgagatataaca

SEQ ID NO: 43572 - DNA, 22 bp, Artificial Sequence
  chemically synthesized
tcacttccacgagatataacac

SEQ ID NO: 43573 - DNA, 22 bp, Artificial Sequence
  chemically synthesized
cacttccacgagatataacact

SEQ ID NO: 43574 - DNA, 22 bp, Artificial Sequence
  chemically synthesized
acttccacgagatataacactg

SEQ ID NO: 43575 - DNA, 22 bp, Artificial Sequence
  chemically synthesized
ccacgagatataacactggtcc

SEQ ID NO: 43576 - DNA, 22 bp, Artificial Sequence
  chemically synthesized
cacgagatataacactggtcca

SEQ ID NO: 43577 - DNA, 22 bp, Artificial Sequence
  chemically synthesized
gtccattacattcatgacatta

SEQ ID NO: 43578 - DNA, 22 bp, Artificial Sequence
  chemically synthesized
cattcatgacattatgatgatt

SEQ ID NO: 43579 - DNA, 22 bp, Artificial Sequence
  chemically synthesized
atgacattatgatgattggata

SEQ ID NO: 43580 - DNA, 22 bp, Artificial Sequence
  chemically synthesized
tgatgattggatacagtgagca

SEQ ID NO: 43581 - DNA, 22 bp, Artificial Sequence
  chemically synthesized
gatacagtgagcaagaagtagc

SEQ ID NO: 43582 - DNA, 22 bp, Artificial Sequence
  chemically synthesized
aacttattggtgagacatttgt

SEQ ID NO: 43583 - DNA, 22 bp, Artificial Sequence
  chemically synthesized
attggtgagacatttgtatgcc

SEQ ID NO: 43584 - DNA, 22 bp, Artificial Sequence
  chemically synthesized
ttggtgagacatttgtatgcca

SEQ ID NO: 43585 - DNA, 22 bp, Artificial Sequence
  chemically synthesized
gtgagacatttgtatgccagag

SEQ ID NO: 43586 - DNA, 22 bp, Artificial Sequence
  chemically synthesized
gtatgccagaggatgggaaata

SEQ ID NO: 43587 - DNA, 22 bp, Artificial Sequence
  chemically synthesized
tatgccagaggatgggaaataa

SEQ ID NO: 43588 - DNA, 22 bp, Artificial Sequence
  chemically synthesized
aaatttagggactttctacctc

SEQ ID NO: 43589 - DNA, 22 bp, Artificial Sequence
  chemically synthesized
agggactttctacctcggtaaa

SEQ ID NO: 43590 - DNA, 22 bp, Artificial Sequence
  chemically synthesized
gggactttctacctcggtaaaa

SEQ ID NO: 43591 - DNA, 22 bp, Artificial Sequence
  chemically synthesized
tctacctcggtaaaatttctag

SEQ ID NO: 43592 - DNA, 22 bp, Artificial Sequence
  chemically synthesized
ctacctcggtaaaatttctagg

SEQ ID NO: 43593 - DNA, 22 bp, Artificial Sequence
  chemically synthesized
tacctcggtaaaatttctaggg

SEQ ID NO: 43594 - DNA, 22 bp, Artificial Sequence
  chemically synthesized
cctcggtaaaatttctagggtt

SEQ ID NO: 43595 - DNA, 22 bp, Artificial Sequence
  chemically synthesized
ggtaaaatttctagggttccag

SEQ ID NO: 43596 - DNA, 22 bp, Artificial Sequence
  chemically synthesized
ctagggttccagtggcatgaga

SEQ ID NO: 43597 - DNA, 22 bp, Artificial Sequence
  chemically synthesized
tagggttccagtggcatgagac

SEQ ID NO: 43598 - DNA, 22 bp, Artificial Sequence
  chemically synthesized
gggttccagtggcatgagacct

SEQ ID NO: 43599 - DNA, 22 bp, Artificial Sequence
  chemically synthesized
cagtggcatgagacctatggag

SEQ ID NO: 43600 - DNA, 22 bp, Artificial Sequence
  chemically synthesized
tggagatattccttctaaggtg

SEQ ID NO: 43601 - DNA, 22 bp, Artificial Sequence
  chemically synthesized
cttctaaggtgaagcataactt

SEQ ID NO: 43602 - DNA, 22 bp, Artificial Sequence
  chemically synthesized
ctaaggtgaagcataacttgct

SEQ ID NO: 43603 - DNA, 22 bp, Artificial Sequence
  chemically synthesized
taaggtgaagcataacttgctg

SEQ ID NO: 43604 - DNA, 22 bp, Artificial Sequence
  chemically synthesized
aggtgaagcataacttgctgcg

SEQ ID NO: 43605 - DNA, 22 bp, Artificial Sequence
  chemically synthesized
gctgcgtttggcccctcttaca

SEQ ID NO: 43606 - DNA, 22 bp, Artificial Sequence
  chemically synthesized
ctgcgtttggcccctcttacaa

SEQ ID NO: 43607 - DNA, 22 bp, Artificial Sequence
  chemically synthesized
cgtttggcccctcttacaacca

SEQ ID NO: 43608 - DNA, 22 bp, Artificial Sequence
  chemically synthesized
ggcccctcttacaaccaagaaa

SEQ ID NO: 43609 - DNA, 22 bp, Artificial Sequence
  chemically synthesized
gcccctcttacaaccaagaaag

SEQ ID NO: 43610 - DNA, 22 bp, Artificial Sequence
  chemically synthesized
ttacaaccaagaaagaggcaca

SEQ ID NO: 43611 - DNA, 22 bp, Artificial Sequence
  chemically synthesized
acaaccaagaaagaggcacaat

SEQ ID NO: 43612 - DNA, 22 bp, Artificial Sequence
  chemically synthesized
caaccaagaaagaggcacaatg

SEQ ID NO: 43613 - DNA, 22 bp, Artificial Sequence
  chemically synthesized
gtgggcctatttggattttgga

SEQ ID NO: 43614 - DNA, 22 bp, Artificial Sequence
  chemically synthesized
tttggattttggaggcaacaca

SEQ ID NO: 43615 - DNA, 22 bp, Artificial Sequence
  chemically synthesized
ggattttggaggcaacacattc

SEQ ID NO: 43616 - DNA, 22 bp, Artificial Sequence
  chemically synthesized
gattttggaggcaacacattcc

SEQ ID NO: 43617 - DNA, 22 bp, Artificial Sequence
  chemically synthesized
tggaggcaacacattcctcgtt

SEQ ID NO: 43618 - DNA, 22 bp, Artificial Sequence
  chemically synthesized
ggaggcaacacattcctcgttt

SEQ ID NO: 43619 - DNA, 22 bp, Artificial Sequence
  chemically synthesized
gaggcaacacattcctcgtttg

SEQ ID NO: 43620 - DNA, 22 bp, Artificial Sequence
  chemically synthesized
ctcgtttgggtgtgttactctg

SEQ ID NO: 43621 - DNA, 22 bp, Artificial Sequence
  chemically synthesized
gtttgggtgtgttactctggcc

SEQ ID NO: 43622 - DNA, 22 bp, Artificial Sequence
  chemically synthesized
gggtgtgttactctggcccatt

SEQ ID NO: 43623 - DNA, 22 bp, Artificial Sequence
  chemically synthesized
ggtgtgttactctggcccattt

SEQ ID NO: 43624 - DNA, 22 bp, Artificial Sequence
  chemically synthesized
ctctggcccatttatcgagtga

SEQ ID NO: 43625 - DNA, 22 bp, Artificial Sequence
  chemically synthesized
tggcccatttatcgagtgacct

SEQ ID NO: 43626 - DNA, 22 bp, Artificial Sequence
  chemically synthesized
gcccatttatcgagtgacctga

SEQ ID NO: 43627 - DNA, 22 bp, Artificial Sequence
  chemically synthesized
atcgagtgacctgaaaggctgc

SEQ ID NO: 43628 - DNA, 22 bp, Artificial Sequence
  chemically synthesized
tcgagtgacctgaaaggctgcc

SEQ ID NO: 43629 - DNA, 22 bp, Artificial Sequence
  chemically synthesized
aaaggctgccagatttaagtgc

SEQ ID NO: 43630 - DNA, 22 bp, Artificial Sequence
  chemically synthesized
ccagatttaagtgcagtctaga

SEQ ID NO: 43631 - DNA, 22 bp, Artificial Sequence
  chemically synthesized
aagtgcagtctagaacaaaaga

SEQ ID NO: 43632 - DNA, 22 bp, Artificial Sequence
  chemically synthesized
agtgcagtctagaacaaaagaa

SEQ ID NO: 43633 - DNA, 22 bp, Artificial Sequence
  chemically synthesized
gaacaaaagaaggctctgaaac

SEQ ID NO: 43634 - DNA, 22 bp, Artificial Sequence
  chemically synthesized
tgaaacaggtccaggctgctgt

SEQ ID NO: 43635 - DNA, 22 bp, Artificial Sequence
  chemically synthesized
aaacaggtccaggctgctgtga

SEQ ID NO: 43636 - DNA, 22 bp, Artificial Sequence
  chemically synthesized
ctgtgaaagctgctctgccatt

SEQ ID NO: 43637 - DNA, 22 bp, Artificial Sequence
  chemically synthesized
tgaaagctgctctgccatttgg

SEQ ID NO: 43638 - DNA, 22 bp, Artificial Sequence
  chemically synthesized
ctctgccatttgggccacatga

SEQ ID NO: 43639 - DNA, 22 bp, Artificial Sequence
  chemically synthesized
tgccatttgggccacatgaccc

SEQ ID NO: 43640 - DNA, 22 bp, Artificial Sequence
  chemically synthesized
ccatttgggccacatgaccccg

SEQ ID NO: 43641 - DNA, 22 bp, Artificial Sequence
  chemically synthesized
gggccacatgaccccgcagatc

SEQ ID NO: 43642 - DNA, 22 bp, Artificial Sequence
  chemically synthesized
ggccacatgaccccgcagatcc

SEQ ID NO: 43643 - DNA, 22 bp, Artificial Sequence
  chemically synthesized
gaggtgtcagtggcagataggg

SEQ ID NO: 43644 - DNA, 22 bp, Artificial Sequence
  chemically synthesized
aggtgtcagtggcagataggga

SEQ ID NO: 43645 - DNA, 22 bp, Artificial Sequence
  chemically synthesized
tttggagcctttggcaggcccc

SEQ ID NO: 43646 - DNA, 22 bp, Artificial Sequence
  chemically synthesized
ggagcctttggcaggcccccat

SEQ ID NO: 43647 - DNA, 22 bp, Artificial Sequence
  chemically synthesized
gagcctttggcaggcccccata

SEQ ID NO: 43648 - DNA, 22 bp, Artificial Sequence
  chemically synthesized
tggcaggcccccataggtgaat

SEQ ID NO: 43649 - DNA, 22 bp, Artificial Sequence
  chemically synthesized
ggcaggcccccataggtgaatc

SEQ ID NO: 43650 - DNA, 22 bp, Artificial Sequence
  chemically synthesized
gcaggcccccataggtgaatca

SEQ ID NO: 43651 - DNA, 22 bp, Artificial Sequence
  chemically synthesized
taggattttggagcaaggccct

SEQ ID NO: 43652 - DNA, 22 bp, Artificial Sequence
  chemically synthesized
ggattttggagcaaggccctgc

SEQ ID NO: 43653 - DNA, 22 bp, Artificial Sequence
  chemically synthesized
tggagcaaggccctgccacttc

SEQ ID NO: 43654 - DNA, 22 bp, Artificial Sequence
  chemically synthesized
ggagcaaggccctgccacttct

SEQ ID NO: 43655 - DNA, 22 bp, Artificial Sequence
  chemically synthesized
gagcaaggccctgccacttctg

SEQ ID NO: 43656 - DNA, 22 bp, Artificial Sequence
  chemically synthesized
ccacttctgcagataactactc

SEQ ID NO: 43657 - DNA, 22 bp, Artificial Sequence
  chemically synthesized
ctgcagataactactctccttt

SEQ ID NO: 43658 - DNA, 22 bp, Artificial Sequence
  chemically synthesized
tgcagataactactctcctttt

SEQ ID NO: 43659 - DNA, 22 bp, Artificial Sequence
  chemically synthesized
cagataactactctccttttga

SEQ ID NO: 43660 - DNA, 22 bp, Artificial Sequence
  chemically synthesized
ctctccttttgagagacagcta

SEQ ID NO: 43661 - DNA, 22 bp, Artificial Sequence
  chemically synthesized
tccttttgagagacagctattg

SEQ ID NO: 43662 - DNA, 22 bp, Artificial Sequence
  chemically synthesized
cttttgagagacagctattggt

SEQ ID NO: 43663 - DNA, 22 bp, Artificial Sequence
  chemically synthesized
ttgagagacagctattggtctg

SEQ ID NO: 43664 - DNA, 22 bp, Artificial Sequence
  chemically synthesized
tgagagacagctattggtctgt

SEQ ID NO: 43665 - DNA, 22 bp, Artificial Sequence
  chemically synthesized
gagagacagctattggtctgtt

SEQ ID NO: 43666 - DNA, 22 bp, Artificial Sequence
  chemically synthesized
agagacagctattggtctgtta

SEQ ID NO: 43667 - DNA, 22 bp, Artificial Sequence
  chemically synthesized
ttggtctgttattgggctttgg

SEQ ID NO: 43668 - DNA, 22 bp, Artificial Sequence
  chemically synthesized
gtctgttattgggctttggtgg

SEQ ID NO: 43669 - DNA, 22 bp, Artificial Sequence
  chemically synthesized
ttattgggctttggtggtaact

SEQ ID NO: 43670 - DNA, 22 bp, Artificial Sequence
  chemically synthesized
ttgggctttggtggtaactgaa

SEQ ID NO: 43671 - DNA, 22 bp, Artificial Sequence
  chemically synthesized
ggctttggtggtaactgaacgt

SEQ ID NO: 43672 - DNA, 22 bp, Artificial Sequence
  chemically synthesized
tggtggtaactgaacgtttgac

SEQ ID NO: 43673 - DNA, 22 bp, Artificial Sequence
  chemically synthesized
ggtggtaactgaacgtttgact

SEQ ID NO: 43674 - DNA, 22 bp, Artificial Sequence
  chemically synthesized
gtggtaactgaacgtttgactg

SEQ ID NO: 43675 - DNA, 22 bp, Artificial Sequence
  chemically synthesized
aacgtttgactgtgggtcataa

SEQ ID NO: 43676 - DNA, 22 bp, Artificial Sequence
  chemically synthesized
gactgtgggtcataaagtcacc

SEQ ID NO: 43677 - DNA, 22 bp, Artificial Sequence
  chemically synthesized
actgtgggtcataaagtcacca

SEQ ID NO: 43678 - DNA, 22 bp, Artificial Sequence
  chemically synthesized
tgggtcataaagtcaccatgct

SEQ ID NO: 43679 - DNA, 22 bp, Artificial Sequence
  chemically synthesized
cctgaacctgcctatcatgaac

SEQ ID NO: 43680 - DNA, 22 bp, Artificial Sequence
  chemically synthesized
aacctgcctatcatgaactggt

SEQ ID NO: 43681 - DNA, 22 bp, Artificial Sequence
  chemically synthesized
cctatcatgaactggttgcttt

SEQ ID NO: 43682 - DNA, 22 bp, Artificial Sequence
  chemically synthesized
tcatgaactggttgctttctga

SEQ ID NO: 43683 - DNA, 22 bp, Artificial Sequence
  chemically synthesized
gttgctttctgacccatctagc

SEQ ID NO: 43684 - DNA, 22 bp, Artificial Sequence
  chemically synthesized
ctttctgacccatctagccatg

SEQ ID NO: 43685 - DNA, 22 bp, Artificial Sequence
  chemically synthesized
tctgacccatctagccatgaag

SEQ ID NO: 43686 - DNA, 22 bp, Artificial Sequence
  chemically synthesized
ctgacccatctagccatgaagt

SEQ ID NO: 43687 - DNA, 22 bp, Artificial Sequence
  chemically synthesized
tgacccatctagccatgaagtg

SEQ ID NO: 43688 - DNA, 22 bp, Artificial Sequence
  chemically synthesized
acccatctagccatgaagtggg

SEQ ID NO: 43689 - DNA, 22 bp, Artificial Sequence
  chemically synthesized
gccatgaagtgggtcagcacag

SEQ ID NO: 43690 - DNA, 22 bp, Artificial Sequence
  chemically synthesized
catcatcaaattgaagtggtgt

SEQ ID NO: 43691 - DNA, 22 bp, Artificial Sequence
  chemically synthesized
atcatcaaattgaagtggtgtg

SEQ ID NO: 43692 - DNA, 22 bp, Artificial Sequence
  chemically synthesized
aagtggtgtgtatgtgatcggg

SEQ ID NO: 43693 - DNA, 22 bp, Artificial Sequence
  chemically synthesized
gagcaggtcctgaaggcacaag

SEQ ID NO: 43694 - DNA, 22 bp, Artificial Sequence
  chemically synthesized
agcaggtcctgaaggcacaagt

SEQ ID NO: 43695 - DNA, 22 bp, Artificial Sequence
  chemically synthesized
aaggcacaagtaagttacataa

SEQ ID NO: 43696 - DNA, 22 bp, Artificial Sequence
  chemically synthesized
cataaggaagtggctcaaatgc

SEQ ID NO: 43697 - DNA, 22 bp, Artificial Sequence
  chemically synthesized
aaatgcccatgttctccactca

SEQ ID NO: 43698 - DNA, 22 bp, Artificial Sequence
  chemically synthesized
tccactcatgccaccctgcctt

SEQ ID NO: 43699 - DNA, 22 bp, Artificial Sequence
  chemically synthesized
cactcatgccaccctgccttcc

SEQ ID NO: 43700 - DNA, 22 bp, Artificial Sequence
  chemically synthesized
atgccaccctgccttccctccc

SEQ ID NO: 43701 - DNA, 22 bp, Artificial Sequence
  chemically synthesized
ccttccctcccccagcctgcac

SEQ ID NO: 43702 - DNA, 22 bp, Artificial Sequence
  chemically synthesized
ccctcccccagcctgcaccaat

SEQ ID NO: 43703 - DNA, 22 bp, Artificial Sequence
  chemically synthesized
cctcccccagcctgcaccaatg

SEQ ID NO: 43704 - DNA, 22 bp, Artificial Sequence
  chemically synthesized
ccccagcctgcaccaatggcct

SEQ ID NO: 43705 - DNA, 22 bp, Artificial Sequence
  chemically synthesized
caccaatggcctcatggggagt

SEQ ID NO: 43706 - DNA, 22 bp, Artificial Sequence
  chemically synthesized
atggggagttccctatgatcag

SEQ ID NO: 43707 - DNA, 22 bp, Artificial Sequence
  chemically synthesized
cctatgatcagttgacagagga

SEQ ID NO: 43708 - DNA, 22 bp, Artificial Sequence
  chemically synthesized
tgatcagttgacagaggaaggg

SEQ ID NO: 43709 - DNA, 22 bp, Artificial Sequence
  chemically synthesized
acagaggaagggaagactaagg

SEQ ID NO: 43710 - DNA, 22 bp, Artificial Sequence
  chemically synthesized
aggactggttcatagatggttc

SEQ ID NO: 43711 - DNA, 22 bp, Artificial Sequence
  chemically synthesized
gttcatagatggttctgcacga

SEQ ID NO: 43712 - DNA, 22 bp, Artificial Sequence
  chemically synthesized
atagatggttctgcacgatatg

SEQ ID NO: 43713 - DNA, 22 bp, Artificial Sequence
  chemically synthesized
tgcacgatatgcaggcaccacc

SEQ ID NO: 43714 - DNA, 22 bp, Artificial Sequence
  chemically synthesized
cacgatatgcaggcaccacccg

SEQ ID NO: 43715 - DNA, 22 bp, Artificial Sequence
  chemically synthesized
cagcactatatccactttctaa

SEQ ID NO: 43716 - DNA, 22 bp, Artificial Sequence
  chemically synthesized
tatccactttctaaatgcatgt

SEQ ID NO: 43717 - DNA, 22 bp, Artificial Sequence
  chemically synthesized
tctaaatgcatgtgtacacttg

SEQ ID NO: 43718 - DNA, 22 bp, Artificial Sequence
  chemically synthesized
ctaaatgcatgtgtacacttgt

SEQ ID NO: 43719 - DNA, 22 bp, Artificial Sequence
  chemically synthesized
taaatgcatgtgtacacttgtg

SEQ ID NO: 43720 - DNA, 22 bp, Artificial Sequence
  chemically synthesized
aatgcatgtgtacacttgtgct

SEQ ID NO: 43721 - DNA, 22 bp, Artificial Sequence
  chemically synthesized
gtgctaagaaaatatctttatt

SEQ ID NO: 43722 - DNA, 22 bp, Artificial Sequence
  chemically synthesized
tgctaagaaaatatctttattt

SEQ ID NO: 43723 - DNA, 22 bp, Artificial Sequence
  chemically synthesized
agaaaatatctttattttattt

SEQ ID NO: 43724 - DNA, 22 bp, Artificial Sequence
  chemically synthesized
tattttatttcctttatttttc

SEQ ID NO: 43725 - DNA, 22 bp, Artificial Sequence
  chemically synthesized
attttatttcctttatttttcc

SEQ ID NO: 43726 - DNA, 22 bp, Artificial Sequence
  chemically synthesized
ttttatttcctttatttttcct

SEQ ID NO: 43727 - DNA, 22 bp, Artificial Sequence
  chemically synthesized
tatttcctttatttttccttta

SEQ ID NO: 43728 - DNA, 22 bp, Artificial Sequence
  chemically synthesized
atttcctttatttttcctttat

SEQ ID NO: 43729 - DNA, 22 bp, Artificial Sequence
  chemically synthesized
tttcctttatttttcctttatc

SEQ ID NO: 43730 - DNA, 22 bp, Artificial Sequence
  chemically synthesized
cctttatttttcctttatcatg

SEQ ID NO: 43731 - DNA, 22 bp, Artificial Sequence
  chemically synthesized
ctttatttttcctttatcatgt

SEQ ID NO: 43732 - DNA, 22 bp, Artificial Sequence
  chemically synthesized
tatttttcctttatcatgtgac

SEQ ID NO: 43733 - DNA, 22 bp, Artificial Sequence
  chemically synthesized
atttttcctttatcatgtgacc

SEQ ID NO: 43734 - DNA, 22 bp, Artificial Sequence
  chemically synthesized
tttttcctttatcatgtgacct

SEQ ID NO: 43735 - DNA, 22 bp, Artificial Sequence
  chemically synthesized
ttcctttatcatgtgaccttag

SEQ ID NO: 43736 - DNA, 22 bp, Artificial Sequence
  chemically synthesized
tcctttatcatgtgaccttaga

SEQ ID NO: 43737 - DNA, 22 bp, Artificial Sequence
  chemically synthesized
cctttatcatgtgaccttagat

SEQ ID NO: 43738 - DNA, 22 bp, Artificial Sequence
  chemically synthesized
ctttatcatgtgaccttagatt

SEQ ID NO: 43739 - DNA, 22 bp, Artificial Sequence
  chemically synthesized
tatcatgtgaccttagatttat

SEQ ID NO: 43740 - DNA, 22 bp, Artificial Sequence
  chemically synthesized
atcatgtgaccttagatttatg

SEQ ID NO: 43741 - DNA, 22 bp, Artificial Sequence
  chemically synthesized
tcatgtgaccttagatttatgg

SEQ ID NO: 43742 - DNA, 22 bp, Artificial Sequence
  chemically synthesized
agatttatggacttcacatcag

SEQ ID NO: 43743 - DNA, 22 bp, Artificial Sequence
  chemically synthesized
gatttatggacttcacatcagc

SEQ ID NO: 43744 - DNA, 22 bp, Artificial Sequence
  chemically synthesized
atggacttcacatcagcattta

SEQ ID NO: 43745 - DNA, 22 bp, Artificial Sequence
  chemically synthesized
tggacttcacatcagcatttaa

SEQ ID NO: 43746 - DNA, 22 bp, Artificial Sequence
  chemically synthesized
cacatcagcatttaagcattta

SEQ ID NO: 43747 - DNA, 22 bp, Artificial Sequence
  chemically synthesized
acatcagcatttaagcatttaa

SEQ ID NO: 43748 - DNA, 22 bp, Artificial Sequence
  chemically synthesized
aagcatttaagtgttgttcata

SEQ ID NO: 43749 - DNA, 22 bp, Artificial Sequence
  chemically synthesized
agcatttaagtgttgttcatat

SEQ ID NO: 43750 - DNA, 22 bp, Artificial Sequence
  chemically synthesized
aagtgttgttcatatcagcatt

SEQ ID NO: 43751 - DNA, 22 bp, Artificial Sequence
  chemically synthesized
agtgttgttcatatcagcattt

SEQ ID NO: 43752 - DNA, 22 bp, Artificial Sequence
  chemically synthesized
ttcatatcagcatttaaatatt

SEQ ID NO: 43753 - DNA, 22 bp, Artificial Sequence
  chemically synthesized
atatcagcatttaaatattgtt

SEQ ID NO: 43754 - DNA, 22 bp, Artificial Sequence
  chemically synthesized
aaatattgttaaccttatgtaa

SEQ ID NO: 43755 - DNA, 22 bp, Artificial Sequence
  chemically synthesized
aatattgttaaccttatgtaat

SEQ ID NO: 43756 - DNA, 22 bp, Artificial Sequence
  chemically synthesized
ttaaccttatgtaataactttt

SEQ ID NO: 43757 - DNA, 22 bp, Artificial Sequence
  chemically synthesized
accttatgtaataacttttggt

SEQ ID NO: 43758 - DNA, 22 bp, Artificial Sequence
  chemically synthesized
atgtaataacttttggtttggg

SEQ ID NO: 43759 - DNA, 22 bp, Artificial Sequence
  chemically synthesized
tgtaataacttttggtttgggg

SEQ ID NO: 43760 - DNA, 22 bp, Artificial Sequence
  chemically synthesized
ttggtttggggattggtgcgtt

SEQ ID NO: 43761 - DNA, 22 bp, Artificial Sequence
  chemically synthesized
tggtttggggattggtgcgttt

SEQ ID NO: 43762 - DNA, 22 bp, Artificial Sequence
  chemically synthesized
ggtttggggattggtgcgtttc

SEQ ID NO: 43763 - DNA, 22 bp, Artificial Sequence
  chemically synthesized
gtttggggattggtgcgtttct

SEQ ID NO: 43764 - DNA, 22 bp, Artificial Sequence
  chemically synthesized
ggggattggtgcgtttctggtt

SEQ ID NO: 43765 - DNA, 22 bp, Artificial Sequence
  chemically synthesized
gggattggtgcgtttctggttg

SEQ ID NO: 43766 - DNA, 22 bp, Artificial Sequence
  chemically synthesized
gtgcgtttctggttgtatgagg

SEQ ID NO: 43767 - DNA, 22 bp, Artificial Sequence
  chemically synthesized
ctggttgtatgaggatagttgt

SEQ ID NO: 43768 - DNA, 22 bp, Artificial Sequence
  chemically synthesized
tggttgtatgaggatagttgta

SEQ ID NO: 43769 - DNA, 22 bp, Artificial Sequence
  chemically synthesized
gttgtatgaggatagttgtatt

SEQ ID NO: 43770 - DNA, 22 bp, Artificial Sequence
  chemically synthesized
tatgaggatagttgtattatat

SEQ ID NO: 43771 - DNA, 22 bp, Artificial Sequence
  chemically synthesized
tattatattaggcataattatg

SEQ ID NO: 43772 - DNA, 22 bp, Artificial Sequence
  chemically synthesized
tattaggcataattatgacctt

SEQ ID NO: 43773 - DNA, 22 bp, Artificial Sequence
  chemically synthesized
ggcataattatgaccttattat

SEQ ID NO: 43774 - DNA, 22 bp, Artificial Sequence
  chemically synthesized
tgaccttattattgtctttatt

SEQ ID NO: 43775 - DNA, 22 bp, Artificial Sequence
  chemically synthesized
attattgtctttatttgaagat

SEQ ID NO: 43776 - DNA, 22 bp, Artificial Sequence
  chemically synthesized
ttattgtctttatttgaagatt

SEQ ID NO: 43777 - DNA, 22 bp, Artificial Sequence
  chemically synthesized
ttgtctttatttgaagattatg

SEQ ID NO: 43778 - DNA, 22 bp, Artificial Sequence
  chemically synthesized
tctttatttgaagattatgtat

SEQ ID NO: 43779 - DNA, 22 bp, Artificial Sequence
  chemically synthesized
tatttgaagattatgtatgatt

SEQ ID NO: 43780 - DNA, 22 bp, Artificial Sequence
  chemically synthesized
atttgaagattatgtatgattt

SEQ ID NO: 43781 - DNA, 22 bp, Artificial Sequence
  chemically synthesized
tttgaagattatgtatgatttc

SEQ ID NO: 43782 - DNA, 22 bp, Artificial Sequence
  chemically synthesized
gaagattatgtatgatttcagg

SEQ ID NO: 43783 - DNA, 22 bp, Artificial Sequence
  chemically synthesized
aagattatgtatgatttcagga

SEQ ID NO: 43784 - DNA, 22 bp, Artificial Sequence
  chemically synthesized
tgtatgatttcaggatgtgtgt

SEQ ID NO: 43785 - DNA, 22 bp, Artificial Sequence
  chemically synthesized
caggatgtgtgtatgggttcaa

SEQ ID NO: 43786 - DNA, 22 bp, Artificial Sequence
  chemically synthesized
aggatgtgtgtatgggttcaag

SEQ ID NO: 43787 - DNA, 22 bp, Artificial Sequence
  chemically synthesized
aagttgacaaggagttggactt

SEQ ID NO: 43788 - DNA, 22 bp, Artificial Sequence
  chemically synthesized
acaaggagttggacttgtgatg

SEQ ID NO: 43789 - DNA, 22 bp, Artificial Sequence
  chemically synthesized
gacttgtgatggttaatactgt

SEQ ID NO: 43790 - DNA, 22 bp, Artificial Sequence
  chemically synthesized
gtgatggttaatactgtcaact

SEQ ID NO: 43791 - DNA, 22 bp, Artificial Sequence
  chemically synthesized
tgatggttaatactgtcaactt

SEQ ID NO: 43792 - DNA, 22 bp, Artificial Sequence
  chemically synthesized
atactgtcaacttgattggatt

SEQ ID NO: 43793 - DNA, 22 bp, Artificial Sequence
  chemically synthesized
tcaacttgattggattgaaaga

SEQ ID NO: 43794 - DNA, 22 bp, Artificial Sequence
  chemically synthesized
gattggattgaaagatgcaaag

SEQ ID NO: 43795 - DNA, 22 bp, Artificial Sequence
  chemically synthesized
attggattgaaagatgcaaagt

SEQ ID NO: 43796 - DNA, 22 bp, Artificial Sequence
  chemically synthesized
gattgaaagatgcaaagtatta

SEQ ID NO: 43797 - DNA, 22 bp, Artificial Sequence
  chemically synthesized
aaagatgcaaagtattaatctc

SEQ ID NO: 43798 - DNA, 22 bp, Artificial Sequence
  chemically synthesized
atctcggttatgtctgtgaggg

SEQ ID NO: 43799 - DNA, 22 bp, Artificial Sequence
  chemically synthesized
ggttatgtctgtgagggtgtgg

SEQ ID NO: 43800 - DNA, 22 bp, Artificial Sequence
  chemically synthesized
tgtctgtgagggtgtggcaaaa

SEQ ID NO: 43801 - DNA, 22 bp, Artificial Sequence
  chemically synthesized
tgagggtgtggcaaaaggagat

SEQ ID NO: 43802 - DNA, 22 bp, Artificial Sequence
  chemically synthesized
acatttgagtcagtgggctggg

SEQ ID NO: 43803 - DNA, 20 bp, Artificial Sequence
  chemically synthesized
taacgaccccggtaggtgag

SEQ ID NO: 43804 - DNA, 20 bp, Artificial Sequence
  chemically synthesized
accccggtaggtgagaggcc

SEQ ID NO: 43805 - DNA, 20 bp, Artificial Sequence
  chemically synthesized
ccccggtaggtgagaggcca

SEQ ID NO: 43806 - DNA, 20 bp, Artificial Sequence
  chemically synthesized
ggtgagaggccaaggtccca

SEQ ID NO: 43807 - DNA, 20 bp, Artificial Sequence
  chemically synthesized
gtgagaggccaaggtcccaa

SEQ ID NO: 43808 - DNA, 20 bp, Artificial Sequence
  chemically synthesized
tgagaggccaaggtcccaaa

SEQ ID NO: 43809 - DNA, 20 bp, Artificial Sequence
  chemically synthesized
gagaggccaaggtcccaaag

SEQ ID NO: 43810 - DNA, 20 bp, Artificial Sequence
  chemically synthesized
gaggccaaggtcccaaaggg

SEQ ID NO: 43811 - DNA, 20 bp, Artificial Sequence
  chemically synthesized
gccaaggtcccaaaggggag

SEQ ID NO: 43812 - DNA, 20 bp, Artificial Sequence
  chemically synthesized
aaggtcccaaaggggagcag

SEQ ID NO: 43813 - DNA, 20 bp, Artificial Sequence
  chemically synthesized
aggtcccaaaggggagcagc

SEQ ID NO: 43814 - DNA, 20 bp, Artificial Sequence
  chemically synthesized
ggtcccaaaggggagcagca

SEQ ID NO: 43815 - DNA, 20 bp, Artificial Sequence
  chemically synthesized
ccaaaggggagcagcaggga

SEQ ID NO: 43816 - DNA, 20 bp, Artificial Sequence
  chemically synthesized
aggggagcagcagggaaagt

SEQ ID NO: 43817 - DNA, 20 bp, Artificial Sequence
  chemically synthesized
gctcccatctattcttgctc

SEQ ID NO: 43818 - DNA, 20 bp, Artificial Sequence
  chemically synthesized
ctcccatctattcttgctcc

SEQ ID NO: 43819 - DNA, 20 bp, Artificial Sequence
  chemically synthesized
tcccatctattcttgctcca

SEQ ID NO: 43820 - DNA, 20 bp, Artificial Sequence
  chemically synthesized
cccatctattcttgctccag

SEQ ID NO: 43821 - DNA, 20 bp, Artificial Sequence
  chemically synthesized
catctattcttgctccaggg

SEQ ID NO: 43822 - DNA, 20 bp, Artificial Sequence
  chemically synthesized
atctattcttgctccagggg

SEQ ID NO: 43823 - DNA, 20 bp, Artificial Sequence
  chemically synthesized
ctccaggggaggcctttgat

SEQ ID NO: 43824 - DNA, 20 bp, Artificial Sequence
  chemically synthesized
tccaggggaggcctttgatg

SEQ ID NO: 43825 - DNA, 20 bp, Artificial Sequence
  chemically synthesized
aggggaggcctttgatgagg

SEQ ID NO: 43826 - DNA, 20 bp, Artificial Sequence
  chemically synthesized
tttgatgaggaagctgccaa

SEQ ID NO: 43827 - DNA, 20 bp, Artificial Sequence
  chemically synthesized
tgcaaatacaattccaatta

SEQ ID NO: 43828 - DNA, 20 bp, Artificial Sequence
  chemically synthesized
gcaaatacaattccaattac

SEQ ID NO: 43829 - DNA, 20 bp, Artificial Sequence
  chemically synthesized
acaattccaattacaggcaa

SEQ ID NO: 43830 - DNA, 20 bp, Artificial Sequence
  chemically synthesized
caattccaattacaggcaac

SEQ ID NO: 43831 - DNA, 20 bp, Artificial Sequence
  chemically synthesized
ttccaattacaggcaacagg

SEQ ID NO: 43832 - DNA, 20 bp, Artificial Sequence
  chemically synthesized
tccaattacaggcaacagga

SEQ ID NO: 43833 - DNA, 20 bp, Artificial Sequence
  chemically synthesized
caattacaggcaacaggaag

SEQ ID NO: 43834 - DNA, 20 bp, Artificial Sequence
  chemically synthesized
accacctctgccacctctgt

SEQ ID NO: 43835 - DNA, 20 bp, Artificial Sequence
  chemically synthesized
cacctctgtcagcaaaccat

SEQ ID NO: 43836 - DNA, 20 bp, Artificial Sequence
  chemically synthesized
gctcctactctgtgctgcga

SEQ ID NO: 43837 - DNA, 20 bp, Artificial Sequence
  chemically synthesized
cctactctgtgctgcgatgg

SEQ ID NO: 43838 - DNA, 20 bp, Artificial Sequence
  chemically synthesized
ctactctgtgctgcgatggc

SEQ ID NO: 43839 - DNA, 20 bp, Artificial Sequence
  chemically synthesized
tgctgcgatggcgggctcga

SEQ ID NO: 43840 - DNA, 20 bp, Artificial Sequence
  chemically synthesized
gctgcgatggcgggctcgat

SEQ ID NO: 43841 - DNA, 20 bp, Artificial Sequence
  chemically synthesized
ctgcgatggcgggctcgatg

SEQ ID NO: 43842 - DNA, 20 bp, Artificial Sequence
  chemically synthesized
ataactctgaccttacctca

SEQ ID NO: 43843 - DNA, 20 bp, Artificial Sequence
  chemically synthesized
aactctgaccttacctcatg

SEQ ID NO: 43844 - DNA, 20 bp, Artificial Sequence
  chemically synthesized
tggagtcactgtcaacccac

SEQ ID NO: 43845 - DNA, 20 bp, Artificial Sequence
  chemically synthesized
gttgcactgtctttgtgcac

SEQ ID NO: 43846 - DNA, 20 bp, Artificial Sequence
  chemically synthesized
gtctttgtgcactggctctc

SEQ ID NO: 43847 - DNA, 20 bp, Artificial Sequence
  chemically synthesized
ctttgtgcactggctctctg

SEQ ID NO: 43848 - DNA, 20 bp, Artificial Sequence
  chemically synthesized
gtgcactggctctctggagt

SEQ ID NO: 43849 - DNA, 20 bp, Artificial Sequence
  chemically synthesized
tgcactggctctctggagtg

SEQ ID NO: 43850 - DNA, 20 bp, Artificial Sequence
  chemically synthesized
gagtgaggtctttgcaaaca

SEQ ID NO: 43851 - DNA, 20 bp, Artificial Sequence
  chemically synthesized
tgaggtctttgcaaacaaag

SEQ ID NO: 43852 - DNA, 20 bp, Artificial Sequence
  chemically synthesized
gtctttgcaaacaaagtgga

SEQ ID NO: 43853 - DNA, 20 bp, Artificial Sequence
  chemically synthesized
ctttgcaaacaaagtggaaa

SEQ ID NO: 43854 - DNA, 20 bp, Artificial Sequence
  chemically synthesized
agtggaaagagcatcaactt

SEQ ID NO: 43855 - DNA, 20 bp, Artificial Sequence
  chemically synthesized
agagcatcaactttggactc

SEQ ID NO: 43856 - DNA, 20 bp, Artificial Sequence
  chemically synthesized
caactttggactccagcacc

SEQ ID NO: 43857 - DNA, 20 bp, Artificial Sequence
  chemically synthesized
tggactccagcacctagatt

SEQ ID NO: 43858 - DNA, 20 bp, Artificial Sequence
  chemically synthesized
gactccagcacctagattca

SEQ ID NO: 43859 - DNA, 20 bp, Artificial Sequence
  chemically synthesized
tccagcacctagattcagag

SEQ ID NO: 43860 - DNA, 20 bp, Artificial Sequence
  chemically synthesized
ccagcacctagattcagagc

SEQ ID NO: 43861 - DNA, 20 bp, Artificial Sequence
  chemically synthesized
tcagagcaggccatttcact

SEQ ID NO: 43862 - DNA, 20 bp, Artificial Sequence
  chemically synthesized
ggaatctgctgtgcatctgc

SEQ ID NO: 43863 - DNA, 20 bp, Artificial Sequence
  chemically synthesized
gaatctgctgtgcatctgca

SEQ ID NO: 43864 - DNA, 20 bp, Artificial Sequence
  chemically synthesized
aatctgctgtgcatctgcaa

SEQ ID NO: 43865 - DNA, 20 bp, Artificial Sequence
  chemically synthesized
tctgctgtgcatctgcaagg

SEQ ID NO: 43866 - DNA, 20 bp, Artificial Sequence
  chemically synthesized
ctgctgtgcatctgcaaggg

SEQ ID NO: 43867 - DNA, 20 bp, Artificial Sequence
  chemically synthesized
aattcgcctttgtttcttcc

SEQ ID NO: 43868 - DNA, 20 bp, Artificial Sequence
  chemically synthesized
ttgtttcttcccagtatcga

SEQ ID NO: 43869 - DNA, 20 bp, Artificial Sequence
  chemically synthesized
cccagtatcgacagcccttc

SEQ ID NO: 43870 - DNA, 20 bp, Artificial Sequence
  chemically synthesized
gtatcgacagcccttccaga

SEQ ID NO: 43871 - DNA, 20 bp, Artificial Sequence
  chemically synthesized
atcgacagcccttccagaaa

SEQ ID NO: 43872 - DNA, 20 bp, Artificial Sequence
  chemically synthesized
acagcccttccagaaagagc

SEQ ID NO: 43873 - DNA, 20 bp, Artificial Sequence
  chemically synthesized
tcatgccacatgtacaatct

SEQ ID NO: 43874 - DNA, 20 bp, Artificial Sequence
  chemically synthesized
catgccacatgtacaatctg

SEQ ID NO: 43875 - DNA, 20 bp, Artificial Sequence
  chemically synthesized
ccacatgtacaatctgaggc

SEQ ID NO: 43876 - DNA, 20 bp, Artificial Sequence
  chemically synthesized
cacatgtacaatctgaggcc

SEQ ID NO: 43877 - DNA, 20 bp, Artificial Sequence
  chemically synthesized
catgtacaatctgaggccag

SEQ ID NO: 43878 - DNA, 20 bp, Artificial Sequence
  chemically synthesized
ccccttttcatcctcctgcc

SEQ ID NO: 43879 - DNA, 20 bp, Artificial Sequence
  chemically synthesized
tcctcctgcctggtacacaa

SEQ ID NO: 43880 - DNA, 20 bp, Artificial Sequence
  chemically synthesized
cctcctgcctggtacacaat

SEQ ID NO: 43881 - DNA, 20 bp, Artificial Sequence
  chemically synthesized
ggtacacaataggtgtttac

SEQ ID NO: 43882 - DNA, 20 bp, Artificial Sequence
  chemically synthesized
gtgtttactggatgcttgtc

SEQ ID NO: 43883 - DNA, 20 bp, Artificial Sequence
  chemically synthesized
tccagttgatttcttgaaca

SEQ ID NO: 43884 - DNA, 20 bp, Artificial Sequence
  chemically synthesized
ttcttgaacatggtgtgtaa

SEQ ID NO: 43885 - DNA, 20 bp, Artificial Sequence
  chemically synthesized
tcttgaacatggtgtgtaaa

SEQ ID NO: 43886 - DNA, 20 bp, Artificial Sequence
  chemically synthesized
tctttgcaaattgaatcttc

SEQ ID NO: 43887 - DNA, 20 bp, Artificial Sequence
  chemically synthesized
tgcaaattgaatcttctgga

SEQ ID NO: 43888 - DNA, 20 bp, Artificial Sequence
  chemically synthesized
attgaatcttctggaaagct

SEQ ID NO: 43889 - DNA, 20 bp, Artificial Sequence
  chemically synthesized
agctgagcttgtgcctacca

SEQ ID NO: 43890 - DNA, 20 bp, Artificial Sequence
  chemically synthesized
acttaaaacctgaatctttg

SEQ ID NO: 43891 - DNA, 20 bp, Artificial Sequence
  chemically synthesized
taaatcccttgaaatgcatg

SEQ ID NO: 43892 - DNA, 20 bp, Artificial Sequence
  chemically synthesized
aaatcccttgaaatgcatgt

SEQ ID NO: 43893 - DNA, 20 bp, Artificial Sequence
  chemically synthesized
cccttgaaatgcatgtaggc

SEQ ID NO: 43894 - DNA, 20 bp, Artificial Sequence
  chemically synthesized
gcatgtaggctggacatcaa

SEQ ID NO: 43895 - DNA, 20 bp, Artificial Sequence
  chemically synthesized
gtaggctggacatcaaaagc

SEQ ID NO: 43896 - DNA, 20 bp, Artificial Sequence
  chemically synthesized
caaaagcaagcaatctcttc

SEQ ID NO: 43897 - DNA, 20 bp, Artificial Sequence
  chemically synthesized
aaaagcaagcaatctcttca

SEQ ID NO: 43898 - DNA, 20 bp, Artificial Sequence
  chemically synthesized
aagcaagcaatctcttcaag

SEQ ID NO: 43899 - DNA, 20 bp, Artificial Sequence
  chemically synthesized
caagcaatctcttcaaggag

SEQ ID NO: 43900 - DNA, 20 bp, Artificial Sequence
  chemically synthesized
caatctcttcaaggagcagc

SEQ ID NO: 43901 - DNA, 20 bp, Artificial Sequence
  chemically synthesized
ctcttcaaggagcagctagt

SEQ ID NO: 43902 - DNA, 20 bp, Artificial Sequence
  chemically synthesized
tcaaggagcagctagttggt

SEQ ID NO: 43903 - DNA, 20 bp, Artificial Sequence
  chemically synthesized
caaggagcagctagttggta

SEQ ID NO: 43904 - DNA, 20 bp, Artificial Sequence
  chemically synthesized
gagcagctagttggtaaggt

SEQ ID NO: 43905 - DNA, 20 bp, Artificial Sequence
  chemically synthesized
tagttggtaaggtcagtgtg

SEQ ID NO: 43906 - DNA, 20 bp, Artificial Sequence
  chemically synthesized
agttggtaaggtcagtgtgc

SEQ ID NO: 43907 - DNA, 20 bp, Artificial Sequence
  chemically synthesized
gttggtaaggtcagtgtgca

SEQ ID NO: 43908 - DNA, 20 bp, Artificial Sequence
  chemically synthesized
gtcagtgtgcagggtgcata

SEQ ID NO: 43909 - DNA, 20 bp, Artificial Sequence
  chemically synthesized
tcagtgtgcagggtgcataa

SEQ ID NO: 43910 - DNA, 20 bp, Artificial Sequence
  chemically synthesized
cagtgtgcagggtgcataaa

SEQ ID NO: 43911 - DNA, 20 bp, Artificial Sequence
  chemically synthesized
tgtgcagggtgcataaaggg

SEQ ID NO: 43912 - DNA, 20 bp, Artificial Sequence
  chemically synthesized
tgcagggtgcataaagggca

SEQ ID NO: 43913 - DNA, 20 bp, Artificial Sequence
  chemically synthesized
gcagggtgcataaagggcag

SEQ ID NO: 43914 - DNA, 20 bp, Artificial Sequence
  chemically synthesized
ggtgcataaagggcagaggc

SEQ ID NO: 43915 - DNA, 20 bp, Artificial Sequence
  chemically synthesized
tgcataaagggcagaggccg

SEQ ID NO: 43916 - DNA, 20 bp, Artificial Sequence
  chemically synthesized
gcataaagggcagaggccgg

SEQ ID NO: 43917 - DNA, 20 bp, Artificial Sequence
  chemically synthesized
cataaagggcagaggccgga

SEQ ID NO: 43918 - DNA, 20 bp, Artificial Sequence
  chemically synthesized
ataaagggcagaggccggag

SEQ ID NO: 43919 - DNA, 20 bp, Artificial Sequence
  chemically synthesized
taaagggcagaggccggagg

SEQ ID NO: 43920 - DNA, 20 bp, Artificial Sequence
  chemically synthesized
ggcagaggccggagggggtc

SEQ ID NO: 43921 - DNA, 20 bp, Artificial Sequence
  chemically synthesized
gcagaggccggagggggtcc

SEQ ID NO: 43922 - DNA, 20 bp, Artificial Sequence
  chemically synthesized
ggccggagggggtccaggct

SEQ ID NO: 43923 - DNA, 20 bp, Artificial Sequence
  chemically synthesized
gagggggtccaggctaagtt

SEQ ID NO: 43924 - DNA, 20 bp, Artificial Sequence
  chemically synthesized
ggggtccaggctaagtttag

SEQ ID NO: 43925 - DNA, 20 bp, Artificial Sequence
  chemically synthesized
gggtccaggctaagtttaga

SEQ ID NO: 43926 - DNA, 20 bp, Artificial Sequence
  chemically synthesized
ggctaagtttagaaggctgc

SEQ ID NO: 43927 - DNA, 20 bp, Artificial Sequence
  chemically synthesized
gctaagtttagaaggctgcc

SEQ ID NO: 43928 - DNA, 20 bp, Artificial Sequence
  chemically synthesized
gtttagaaggctgccaggtt

SEQ ID NO: 43929 - DNA, 20 bp, Artificial Sequence
  chemically synthesized
tttagaaggctgccaggtta

SEQ ID NO: 43930 - DNA, 20 bp, Artificial Sequence
  chemically synthesized
gaaggctgccaggttaaggc

SEQ ID NO: 43931 - DNA, 20 bp, Artificial Sequence
  chemically synthesized
ggctgccaggttaaggccag

SEQ ID NO: 43932 - DNA, 20 bp, Artificial Sequence
  chemically synthesized
gccaggttaaggccagtgga

SEQ ID NO: 43933 - DNA, 20 bp, Artificial Sequence
  chemically synthesized
taaggccagtggaaagaatt

SEQ ID NO: 43934 - DNA, 20 bp, Artificial Sequence
  chemically synthesized
ggccagtggaaagaattcgg

SEQ ID NO: 43935 - DNA, 20 bp, Artificial Sequence
  chemically synthesized
gccagtggaaagaattcggt

SEQ ID NO: 43936 - DNA, 20 bp, Artificial Sequence
  chemically synthesized
agtggaaagaattcggtggg

SEQ ID NO: 43937 - DNA, 20 bp, Artificial Sequence
  chemically synthesized
gaaagaattcggtgggcagc

SEQ ID NO: 43938 - DNA, 20 bp, Artificial Sequence
  chemically synthesized
aaagaattcggtgggcagcg

SEQ ID NO: 43939 - DNA, 20 bp, Artificial Sequence
  chemically synthesized
agaattcggtgggcagcgag

SEQ ID NO: 43940 - DNA, 20 bp, Artificial Sequence
  chemically synthesized
ggtgggcagcgaggagtcca

SEQ ID NO: 43941 - DNA, 20 bp, Artificial Sequence
  chemically synthesized
gggcagcgaggagtccacag

SEQ ID NO: 43942 - DNA, 20 bp, Artificial Sequence
  chemically synthesized
ggcagcgaggagtccacagt

SEQ ID NO: 43943 - DNA, 20 bp, Artificial Sequence
  chemically synthesized
agtccacagtaggattgatt

SEQ ID NO: 43944 - DNA, 20 bp, Artificial Sequence
  chemically synthesized
ccacagtaggattgattcag

SEQ ID NO: 43945 - DNA, 20 bp, Artificial Sequence
  chemically synthesized
gattgattcagaagtctcac

SEQ ID NO: 43946 - DNA, 20 bp, Artificial Sequence
  chemically synthesized
gattcagaagtctcactggt

SEQ ID NO: 43947 - DNA, 20 bp, Artificial Sequence
  chemically synthesized
tcagaagtctcactggtcag

SEQ ID NO: 43948 - DNA, 20 bp, Artificial Sequence
  chemically synthesized
cagaagtctcactggtcagc

SEQ ID NO: 43949 - DNA, 20 bp, Artificial Sequence
  chemically synthesized
gaagtctcactggtcagcag

SEQ ID NO: 43950 - DNA, 20 bp, Artificial Sequence
  chemically synthesized
ctcactggtcagcaggagac

SEQ ID NO: 43951 - DNA, 20 bp, Artificial Sequence
  chemically synthesized
tcactggtcagcaggagaca

SEQ ID NO: 43952 - DNA, 20 bp, Artificial Sequence
  chemically synthesized
ctggtcagcaggagacaagg

SEQ ID NO: 43953 - DNA, 20 bp, Artificial Sequence
  chemically synthesized
agcaggagacaaggtggacc

SEQ ID NO: 43954 - DNA, 20 bp, Artificial Sequence
  chemically synthesized
gcaggagacaaggtggaccc

SEQ ID NO: 43955 - DNA, 20 bp, Artificial Sequence
  chemically synthesized
tggacccaggaaacactgaa

SEQ ID NO: 43956 - DNA, 20 bp, Artificial Sequence
  chemically synthesized
ggacccaggaaacactgaaa

SEQ ID NO: 43957 - DNA, 20 bp, Artificial Sequence
  chemically synthesized
cccaggaaacactgaaaagg

SEQ ID NO: 43958 - DNA, 20 bp, Artificial Sequence
  chemically synthesized
ccaggaaacactgaaaaggt

SEQ ID NO: 43959 - DNA, 20 bp, Artificial Sequence
  chemically synthesized
aaacactgaaaaggtgggcc

SEQ ID NO: 43960 - DNA, 20 bp, Artificial Sequence
  chemically synthesized
cactgaaaaggtgggcccgg

SEQ ID NO: 43961 - DNA, 20 bp, Artificial Sequence
  chemically synthesized
aaggtgggcccggcagaact

SEQ ID NO: 43962 - DNA, 20 bp, Artificial Sequence
  chemically synthesized
ggtgggcccggcagaacttg

SEQ ID NO: 43963 - DNA, 20 bp, Artificial Sequence
  chemically synthesized
gcccggcagaacttggagtc

SEQ ID NO: 43964 - DNA, 20 bp, Artificial Sequence
  chemically synthesized
ttggagtctggcatcccacg

SEQ ID NO: 43965 - DNA, 20 bp, Artificial Sequence
  chemically synthesized
tggagtctggcatcccacgc

SEQ ID NO: 43966 - DNA, 20 bp, Artificial Sequence
  chemically synthesized
ggagtctggcatcccacgca

SEQ ID NO: 43967 - DNA, 20 bp, Artificial Sequence
  chemically synthesized
tctggcatcccacgcagggt

SEQ ID NO: 43968 - DNA, 20 bp, Artificial Sequence
  chemically synthesized
tggcatcccacgcagggtga

SEQ ID NO: 43969 - DNA, 20 bp, Artificial Sequence
  chemically synthesized
ggcatcccacgcagggtgag

SEQ ID NO: 43970 - DNA, 20 bp, Artificial Sequence
  chemically synthesized
atcccacgcagggtgagagg

SEQ ID NO: 43971 - DNA, 20 bp, Artificial Sequence
  chemically synthesized
tcccacgcagggtgagaggc

SEQ ID NO: 43972 - DNA, 20 bp, Artificial Sequence
  chemically synthesized
ccacgcagggtgagaggcgg

SEQ ID NO: 43973 - DNA, 20 bp, Artificial Sequence
  chemically synthesized
acgcagggtgagaggcggga

SEQ ID NO: 43974 - DNA, 20 bp, Artificial Sequence
  chemically synthesized
cgcagggtgagaggcgggag

SEQ ID NO: 43975 - DNA, 20 bp, Artificial Sequence
  chemically synthesized
cagggtgagaggcgggagag

SEQ ID NO: 43976 - DNA, 20 bp, Artificial Sequence
  chemically synthesized
agggtgagaggcgggagagg

SEQ ID NO: 43977 - DNA, 20 bp, Artificial Sequence
  chemically synthesized
ggtgagaggcgggagaggag

SEQ ID NO: 43978 - DNA, 20 bp, Artificial Sequence
  chemically synthesized
ggcgggagaggaggagcccc

SEQ ID NO: 43979 - DNA, 20 bp, Artificial Sequence
  chemically synthesized
gcgggagaggaggagcccct

SEQ ID NO: 43980 - DNA, 20 bp, Artificial Sequence
  chemically synthesized
cgggagaggaggagccccta

SEQ ID NO: 43981 - DNA, 20 bp, Artificial Sequence
  chemically synthesized
aggaggagcccctagggcgc

SEQ ID NO: 43982 - DNA, 20 bp, Artificial Sequence
  chemically synthesized
tagggcgccggcctgccttc

SEQ ID NO: 43983 - DNA, 20 bp, Artificial Sequence
  chemically synthesized
cgccggcctgccttccagcc

SEQ ID NO: 43984 - DNA, 20 bp, Artificial Sequence
  chemically synthesized
ggcctgccttccagcccagt

SEQ ID NO: 43985 - DNA, 20 bp, Artificial Sequence
  chemically synthesized
gcctgccttccagcccagtt

SEQ ID NO: 43986 - DNA, 20 bp, Artificial Sequence
  chemically synthesized
cttccagcccagttaggatt

SEQ ID NO: 43987 - DNA, 20 bp, Artificial Sequence
  chemically synthesized
ttccagcccagttaggattt

SEQ ID NO: 43988 - DNA, 20 bp, Artificial Sequence
  chemically synthesized
ccagcccagttaggatttgg

SEQ ID NO: 43989 - DNA, 20 bp, Artificial Sequence
  chemically synthesized
gcgcgtaatctgacgctgtt

SEQ ID NO: 43990 - DNA, 20 bp, Artificial Sequence
  chemically synthesized
cgcgtaatctgacgctgttt

SEQ ID NO: 43991 - DNA, 20 bp, Artificial Sequence
  chemically synthesized
gcgtaatctgacgctgtttg

SEQ ID NO: 43992 - DNA, 20 bp, Artificial Sequence
  chemically synthesized
gtaatctgacgctgtttggg

SEQ ID NO: 43993 - DNA, 20 bp, Artificial Sequence
  chemically synthesized
taatctgacgctgtttgggg

SEQ ID NO: 43994 - DNA, 20 bp, Artificial Sequence
  chemically synthesized
aatctgacgctgtttgggga

SEQ ID NO: 43995 - DNA, 20 bp, Artificial Sequence
  chemically synthesized
tgacgctgtttggggagggc

SEQ ID NO: 43996 - DNA, 20 bp, Artificial Sequence
  chemically synthesized
gacgctgtttggggagggcg

SEQ ID NO: 43997 - DNA, 20 bp, Artificial Sequence
  chemically synthesized
gaggccgaaacctgatcctc

SEQ ID NO: 43998 - DNA, 20 bp, Artificial Sequence
  chemically synthesized
cgaaacctgatcctccagtc

SEQ ID NO: 43999 - DNA, 20 bp, Artificial Sequence
  chemically synthesized
gaaacctgatcctccagtcc

SEQ ID NO: 44000 - DNA, 20 bp, Artificial Sequence
  chemically synthesized
aaacctgatcctccagtccg

SEQ ID NO: 44001 - DNA, 20 bp, Artificial Sequence
  chemically synthesized
aacctgatcctccagtccgg

SEQ ID NO: 44002 - DNA, 20 bp, Artificial Sequence
  chemically synthesized
gggttccgttaatgtttaat

SEQ ID NO: 44003 - DNA, 20 bp, Artificial Sequence
  chemically synthesized
tccgttaatgtttaatcaga

SEQ ID NO: 44004 - DNA, 20 bp, Artificial Sequence
  chemically synthesized
ccgttaatgtttaatcagat

SEQ ID NO: 44005 - DNA, 20 bp, Artificial Sequence
  chemically synthesized
aatcagataggatcgtccga

SEQ ID NO: 44006 - DNA, 20 bp, Artificial Sequence
  chemically synthesized
atcagataggatcgtccgat

SEQ ID NO: 44007 - DNA, 20 bp, Artificial Sequence
  chemically synthesized
tcagataggatcgtccgatg

SEQ ID NO: 44008 - DNA, 20 bp, Artificial Sequence
  chemically synthesized
aggatcgtccgatggggctc

SEQ ID NO: 44009 - DNA, 20 bp, Artificial Sequence
  chemically synthesized
atcgtccgatggggctctgg

SEQ ID NO: 44010 - DNA, 20 bp, Artificial Sequence
  chemically synthesized
gtggcgtgatctgcgcgccc

SEQ ID NO: 44011 - DNA, 20 bp, Artificial Sequence
  chemically synthesized
tggcgtgatctgcgcgcccc

SEQ ID NO: 44012 - DNA, 20 bp, Artificial Sequence
  chemically synthesized
atctgcgcgccccaggcgtc

SEQ ID NO: 44013 - DNA, 20 bp, Artificial Sequence
  chemically synthesized
ggcgtcaagcacccacaccc

SEQ ID NO: 44014 - DNA, 20 bp, Artificial Sequence
  chemically synthesized
gtcaagcacccacaccctag

SEQ ID NO: 44015 - DNA, 20 bp, Artificial Sequence
  chemically synthesized
tcaagcacccacaccctaga

SEQ ID NO: 44016 - DNA, 20 bp, Artificial Sequence
  chemically synthesized
cacaccctagaaggtttccg

SEQ ID NO: 44017 - DNA, 20 bp, Artificial Sequence
  chemically synthesized
aaggtttccgcagcgacgtc

SEQ ID NO: 44018 - DNA, 20 bp, Artificial Sequence
  chemically synthesized
aggtttccgcagcgacgtcg

SEQ ID NO: 44019 - DNA, 20 bp, Artificial Sequence
  chemically synthesized
cagcgacgtcgaggcgctca

SEQ ID NO: 44020 - DNA, 20 bp, Artificial Sequence
  chemically synthesized
cgtcgaggcgctcatggttg

SEQ ID NO: 44021 - DNA, 20 bp, Artificial Sequence
  chemically synthesized
gtcgaggcgctcatggttgc

SEQ ID NO: 44022 - DNA, 20 bp, Artificial Sequence
  chemically synthesized
gaggcgctcatggttgcagg

SEQ ID NO: 44023 - DNA, 20 bp, Artificial Sequence
  chemically synthesized
aggcgctcatggttgcaggc

SEQ ID NO: 44024 - DNA, 20 bp, Artificial Sequence
  chemically synthesized
tgcaggcgggcgccgccgtt

SEQ ID NO: 44025 - DNA, 20 bp, Artificial Sequence
  chemically synthesized
gcgggcgccgccgttcagtt

SEQ ID NO: 44026 - DNA, 20 bp, Artificial Sequence
  chemically synthesized
cgggcgccgccgttcagttc

SEQ ID NO: 44027 - DNA, 20 bp, Artificial Sequence
  chemically synthesized
gggcgccgccgttcagttca

SEQ ID NO: 44028 - DNA, 20 bp, Artificial Sequence
  chemically synthesized
cgccgttcagttcagggtct

SEQ ID NO: 44029 - DNA, 20 bp, Artificial Sequence
  chemically synthesized
ttcagttcagggtctgagcc

SEQ ID NO: 44030 - DNA, 20 bp, Artificial Sequence
  chemically synthesized
cagttcagggtctgagcctg

SEQ ID NO: 44031 - DNA, 20 bp, Artificial Sequence
  chemically synthesized
agttcagggtctgagcctgg

SEQ ID NO: 44032 - DNA, 20 bp, Artificial Sequence
  chemically synthesized
ttcagggtctgagcctggag

SEQ ID NO: 44033 - DNA, 20 bp, Artificial Sequence
  chemically synthesized
gggtctgagcctggaggagt

SEQ ID NO: 44034 - DNA, 20 bp, Artificial Sequence
  chemically synthesized
ctgagcctggaggagtgagc

SEQ ID NO: 44035 - DNA, 20 bp, Artificial Sequence
  chemically synthesized
tgagcctggaggagtgagcc

SEQ ID NO: 44036 - DNA, 20 bp, Artificial Sequence
  chemically synthesized
gcctggaggagtgagccagg

SEQ ID NO: 44037 - DNA, 20 bp, Artificial Sequence
  chemically synthesized
ggaggagtgagccaggcagt

SEQ ID NO: 44038 - DNA, 20 bp, Artificial Sequence
  chemically synthesized
agtgagccaggcagtgagac

SEQ ID NO: 44039 - DNA, 20 bp, Artificial Sequence
  chemically synthesized
gccaggcagtgagactggct

SEQ ID NO: 44040 - DNA, 20 bp, Artificial Sequence
  chemically synthesized
ccaggcagtgagactggctc

SEQ ID NO: 44041 - DNA, 20 bp, Artificial Sequence
  chemically synthesized
ggcagtgagactggctcggg

SEQ ID NO: 44042 - DNA, 20 bp, Artificial Sequence
  chemically synthesized
gcagtgagactggctcgggc

SEQ ID NO: 44043 - DNA, 20 bp, Artificial Sequence
  chemically synthesized
tgagactggctcgggcgggc

SEQ ID NO: 44044 - DNA, 20 bp, Artificial Sequence
  chemically synthesized
gagactggctcgggcgggcc

SEQ ID NO: 44045 - DNA, 20 bp, Artificial Sequence
  chemically synthesized
cgggccgggacgcgtcgttg

SEQ ID NO: 44046 - DNA, 20 bp, Artificial Sequence
  chemically synthesized
gccgggacgcgtcgttgcag

SEQ ID NO: 44047 - DNA, 20 bp, Artificial Sequence
  chemically synthesized
gggacgcgtcgttgcagcag

SEQ ID NO: 44048 - DNA, 20 bp, Artificial Sequence
  chemically synthesized
gtcgttgcagcagcggctcc

SEQ ID NO: 44049 - DNA, 20 bp, Artificial Sequence
  chemically synthesized
cagcagcggctcccagctcc

SEQ ID NO: 44050 - DNA, 20 bp, Artificial Sequence
  chemically synthesized
agcggctcccagctcccagc

SEQ ID NO: 44051 - DNA, 20 bp, Artificial Sequence
  chemically synthesized
gcggctcccagctcccagcc

SEQ ID NO: 44052 - DNA, 20 bp, Artificial Sequence
  chemically synthesized
cgcgccctgctcctgaactt

SEQ ID NO: 44053 - DNA, 20 bp, Artificial Sequence
  chemically synthesized
cctgaacttcagctcctgca

SEQ ID NO: 44054 - DNA, 20 bp, Artificial Sequence
  chemically synthesized
tgcacagtcctccccaccgc

SEQ ID NO: 44055 - DNA, 20 bp, Artificial Sequence
  chemically synthesized
gcacagtcctccccaccgca

SEQ ID NO: 44056 - DNA, 20 bp, Artificial Sequence
  chemically synthesized
tcctccccaccgcaaggctc

SEQ ID NO: 44057 - DNA, 20 bp, Artificial Sequence
  chemically synthesized
cctccccaccgcaaggctca

SEQ ID NO: 44058 - DNA, 20 bp, Artificial Sequence
  chemically synthesized
cgcaaggctcaaggcgccgc

SEQ ID NO: 44059 - DNA, 20 bp, Artificial Sequence
  chemically synthesized
ggctcaaggcgccgccggcg

SEQ ID NO: 44060 - DNA, 20 bp, Artificial Sequence
  chemically synthesized
ccgccggcgtggaccgcgca

SEQ ID NO: 44061 - DNA, 20 bp, Artificial Sequence
  chemically synthesized
cgtggaccgcgcacggcctc

SEQ ID NO: 44062 - DNA, 20 bp, Artificial Sequence
  chemically synthesized
gtggaccgcgcacggcctct

SEQ ID NO: 44063 - DNA, 20 bp, Artificial Sequence
  chemically synthesized
cggcctctaggtctcctcgc

SEQ ID NO: 44064 - DNA, 20 bp, Artificial Sequence
  chemically synthesized
ggcctctaggtctcctcgcc

SEQ ID NO: 44065 - DNA, 20 bp, Artificial Sequence
  chemically synthesized
tctaggtctcctcgccagga

SEQ ID NO: 44066 - DNA, 20 bp, Artificial Sequence
  chemically synthesized
caggacagcaacctctcccc

SEQ ID NO: 44067 - DNA, 20 bp, Artificial Sequence
  chemically synthesized
aacctctcccctggccctca

SEQ ID NO: 44068 - DNA, 20 bp, Artificial Sequence
  chemically synthesized
acctctcccctggccctcat

SEQ ID NO: 44069 - DNA, 20 bp, Artificial Sequence
  chemically synthesized
ctggccctcatgggcaccgt

SEQ ID NO: 44070 - DNA, 20 bp, Artificial Sequence
  chemically synthesized
ctcatgggcaccgtcagctc

SEQ ID NO: 44071 - DNA, 20 bp, Artificial Sequence
  chemically synthesized
tcatgggcaccgtcagctcc

SEQ ID NO: 44072 - DNA, 20 bp, Artificial Sequence
  chemically synthesized
tgggcaccgtcagctccagg

SEQ ID NO: 44073 - DNA, 20 bp, Artificial Sequence
  chemically synthesized
ccgtcagctccaggcggtcc

SEQ ID NO: 44074 - DNA, 20 bp, Artificial Sequence
  chemically synthesized
tcagctccaggcggtcctgg

SEQ ID NO: 44075 - DNA, 20 bp, Artificial Sequence
  chemically synthesized
gctgctgctgctgctgctcc

SEQ ID NO: 44076 - DNA, 20 bp, Artificial Sequence
  chemically synthesized
ctgctgctgctgctgctcct

SEQ ID NO: 44077 - DNA, 20 bp, Artificial Sequence
  chemically synthesized
gctgctgctcctgggtcccg

SEQ ID NO: 44078 - DNA, 20 bp, Artificial Sequence
  chemically synthesized
ctgctgctcctgggtcccgc

SEQ ID NO: 44079 - DNA, 20 bp, Artificial Sequence
  chemically synthesized
gtcccgcgggcgcccgtgcg

SEQ ID NO: 44080 - DNA, 20 bp, Artificial Sequence
  chemically synthesized
tcccgcgggcgcccgtgcgc

SEQ ID NO: 44081 - DNA, 20 bp, Artificial Sequence
  chemically synthesized
ccgcgggcgcccgtgcgcag

SEQ ID NO: 44082 - DNA, 20 bp, Artificial Sequence
  chemically synthesized
cgcgggcgcccgtgcgcagg

SEQ ID NO: 44083 - DNA, 20 bp, Artificial Sequence
  chemically synthesized
gcgcccgtgcgcaggaggac

SEQ ID NO: 44084 - DNA, 20 bp, Artificial Sequence
  chemically synthesized
cgcccgtgcgcaggaggacg

SEQ ID NO: 44085 - DNA, 20 bp, Artificial Sequence
  chemically synthesized
cgtgcgcaggaggacgagga

SEQ ID NO: 44086 - DNA, 20 bp, Artificial Sequence
  chemically synthesized
aggacgaggacggcgactac

SEQ ID NO: 44087 - DNA, 20 bp, Artificial Sequence
  chemically synthesized
ggacgaggacggcgactacg

SEQ ID NO: 44088 - DNA, 20 bp, Artificial Sequence
  chemically synthesized
acgaggacggcgactacgag

SEQ ID NO: 44089 - DNA, 20 bp, Artificial Sequence
  chemically synthesized
ggacggcgactacgaggagc

SEQ ID NO: 44090 - DNA, 20 bp, Artificial Sequence
  chemically synthesized
cgactacgaggagctggtgc

SEQ ID NO: 44091 - DNA, 20 bp, Artificial Sequence
  chemically synthesized
tggtgctagccttgcgttcc

SEQ ID NO: 44092 - DNA, 20 bp, Artificial Sequence
  chemically synthesized
ggtgctagccttgcgttccg

SEQ ID NO: 44093 - DNA, 20 bp, Artificial Sequence
  chemically synthesized
tgctagccttgcgttccgag

SEQ ID NO: 44094 - DNA, 20 bp, Artificial Sequence
  chemically synthesized
gctagccttgcgttccgagg

SEQ ID NO: 44095 - DNA, 20 bp, Artificial Sequence
  chemically synthesized
gccttgcgttccgaggagga

SEQ ID NO: 44096 - DNA, 20 bp, Artificial Sequence
  chemically synthesized
gcgttccgaggaggacggcc

SEQ ID NO: 44097 - DNA, 20 bp, Artificial Sequence
  chemically synthesized
cgaggaggacggcctggccg

SEQ ID NO: 44098 - DNA, 20 bp, Artificial Sequence
  chemically synthesized
acggcctggccgaagcaccc

SEQ ID NO: 44099 - DNA, 20 bp, Artificial Sequence
  chemically synthesized
ctggccgaagcacccgagca

SEQ ID NO: 44100 - DNA, 20 bp, Artificial Sequence
  chemically synthesized
agcacccgagcacggaacca

SEQ ID NO: 44101 - DNA, 20 bp, Artificial Sequence
  chemically synthesized
ccaccttccaccgctgcgcc

SEQ ID NO: 44102 - DNA, 20 bp, Artificial Sequence
  chemically synthesized
caccttccaccgctgcgcca

SEQ ID NO: 44103 - DNA, 20 bp, Artificial Sequence
  chemically synthesized
tccaccgctgcgccaaggtg

SEQ ID NO: 44104 - DNA, 20 bp, Artificial Sequence
  chemically synthesized
ccaccgctgcgccaaggtgc

SEQ ID NO: 44105 - DNA, 20 bp, Artificial Sequence
  chemically synthesized
gctgcgccaaggtgcgggtg

SEQ ID NO: 44106 - DNA, 20 bp, Artificial Sequence
  chemically synthesized
ctgcgccaaggtgcgggtgt

SEQ ID NO: 44107 - DNA, 20 bp, Artificial Sequence
  chemically synthesized
tgcgccaaggtgcgggtgta

SEQ ID NO: 44108 - DNA, 20 bp, Artificial Sequence
  chemically synthesized
ccaaggtgcgggtgtaggga

SEQ ID NO: 44109 - DNA, 20 bp, Artificial Sequence
  chemically synthesized
caaggtgcgggtgtagggat

SEQ ID NO: 44110 - DNA, 20 bp, Artificial Sequence
  chemically synthesized
aggtgcgggtgtagggatgg

SEQ ID NO: 44111 - DNA, 20 bp, Artificial Sequence
  chemically synthesized
ggtgcgggtgtagggatggg

SEQ ID NO: 44112 - DNA, 20 bp, Artificial Sequence
  chemically synthesized
cgggtgtagggatgggaggc

SEQ ID NO: 44113 - DNA, 20 bp, Artificial Sequence
  chemically synthesized
gggtgtagggatgggaggcc

SEQ ID NO: 44114 - DNA, 20 bp, Artificial Sequence
  chemically synthesized
ggtgtagggatgggaggccg

SEQ ID NO: 44115 - DNA, 20 bp, Artificial Sequence
  chemically synthesized
gggaggccggggcgaacccg

SEQ ID NO: 44116 - DNA, 20 bp, Artificial Sequence
  chemically synthesized
ggccggggcgaacccgcagc

SEQ ID NO: 44117 - DNA, 20 bp, Artificial Sequence
  chemically synthesized
gccggggcgaacccgcagcc

SEQ ID NO: 44118 - DNA, 20 bp, Artificial Sequence
  chemically synthesized
gggcgaacccgcagccggga

SEQ ID NO: 44119 - DNA, 20 bp, Artificial Sequence
  chemically synthesized
aacccgcagccgggacggtg

SEQ ID NO: 44120 - DNA, 20 bp, Artificial Sequence
  chemically synthesized
ggtgcggtgctgtttcctct

SEQ ID NO: 44121 - DNA, 20 bp, Artificial Sequence
  chemically synthesized
gtgcggtgctgtttcctctc

SEQ ID NO: 44122 - DNA, 20 bp, Artificial Sequence
  chemically synthesized
tgctgtttcctctcgggcct

SEQ ID NO: 44123 - DNA, 20 bp, Artificial Sequence
  chemically synthesized
gcctcagtttccccccatgt

SEQ ID NO: 44124 - DNA, 20 bp, Artificial Sequence
  chemically synthesized
ctcagtttccccccatgtaa

SEQ ID NO: 44125 - DNA, 20 bp, Artificial Sequence
  chemically synthesized
cagtttccccccatgtaaga

SEQ ID NO: 44126 - DNA, 20 bp, Artificial Sequence
  chemically synthesized
agtttccccccatgtaagag

SEQ ID NO: 44127 - DNA, 20 bp, Artificial Sequence
  chemically synthesized
ttccccccatgtaagagagg

SEQ ID NO: 44128 - DNA, 20 bp, Artificial Sequence
  chemically synthesized
cccccatgtaagagaggaag

SEQ ID NO: 44129 - DNA, 20 bp, Artificial Sequence
  chemically synthesized
cccatgtaagagaggaagtg

SEQ ID NO: 44130 - DNA, 20 bp, Artificial Sequence
  chemically synthesized
gtaagagaggaagtggagtg

SEQ ID NO: 44131 - DNA, 20 bp, Artificial Sequence
  chemically synthesized
taagagaggaagtggagtgc

SEQ ID NO: 44132 - DNA, 20 bp, Artificial Sequence
  chemically synthesized
gaagtggagtgcaggtcgcc

SEQ ID NO: 44133 - DNA, 20 bp, Artificial Sequence
  chemically synthesized
aagtggagtgcaggtcgccg

SEQ ID NO: 44134 - DNA, 20 bp, Artificial Sequence
  chemically synthesized
agtggagtgcaggtcgccga

SEQ ID NO: 44135 - DNA, 20 bp, Artificial Sequence
  chemically synthesized
gtcgccgagggctcttcgct

SEQ ID NO: 44136 - DNA, 20 bp, Artificial Sequence
  chemically synthesized
ctcttcgcttggcacgatct

SEQ ID NO: 44137 - DNA, 20 bp, Artificial Sequence
  chemically synthesized
tcttcgcttggcacgatctt

SEQ ID NO: 44138 - DNA, 20 bp, Artificial Sequence
  chemically synthesized
cttcgcttggcacgatcttg

SEQ ID NO: 44139 - DNA, 20 bp, Artificial Sequence
  chemically synthesized
tggcacgatcttggggactg

SEQ ID NO: 44140 - DNA, 20 bp, Artificial Sequence
  chemically synthesized
ggcacgatcttggggactgc

SEQ ID NO: 44141 - DNA, 20 bp, Artificial Sequence
  chemically synthesized
cgatcttggggactgcaggc

SEQ ID NO: 44142 - DNA, 20 bp, Artificial Sequence
  chemically synthesized
gatcttggggactgcaggca

SEQ ID NO: 44143 - DNA, 20 bp, Artificial Sequence
  chemically synthesized
cttggggactgcaggcaagg

SEQ ID NO: 44144 - DNA, 20 bp, Artificial Sequence
  chemically synthesized
ggggactgcaggcaaggcgg

SEQ ID NO: 44145 - DNA, 20 bp, Artificial Sequence
  chemically synthesized
gggactgcaggcaaggcggc

SEQ ID NO: 44146 - DNA, 20 bp, Artificial Sequence
  chemically synthesized
ggactgcaggcaaggcggcg

SEQ ID NO: 44147 - DNA, 20 bp, Artificial Sequence
  chemically synthesized
gactgcaggcaaggcggcgg

SEQ ID NO: 44148 - DNA, 20 bp, Artificial Sequence
  chemically synthesized
ctgcaggcaaggcggcgggg

SEQ ID NO: 44149 - DNA, 20 bp, Artificial Sequence
  chemically synthesized
tgcaggcaaggcggcggggg

SEQ ID NO: 44150 - DNA, 20 bp, Artificial Sequence
  chemically synthesized
ggcaaggcggcgggggagga

SEQ ID NO: 44151 - DNA, 20 bp, Artificial Sequence
  chemically synthesized
gcaaggcggcgggggaggac

SEQ ID NO: 44152 - DNA, 20 bp, Artificial Sequence
  chemically synthesized
aggcggcgggggaggacggg

SEQ ID NO: 44153 - DNA, 20 bp, Artificial Sequence
  chemically synthesized
cggcgggggaggacgggtag

SEQ ID NO: 44154 - DNA, 20 bp, Artificial Sequence
  chemically synthesized
ggcgggggaggacgggtagt

SEQ ID NO: 44155 - DNA, 20 bp, Artificial Sequence
  chemically synthesized
gcgggggaggacgggtagtg

SEQ ID NO: 44156 - DNA, 20 bp, Artificial Sequence
  chemically synthesized
gggggaggacgggtagtggg

SEQ ID NO: 44157 - DNA, 20 bp, Artificial Sequence
  chemically synthesized
aggacgggtagtggggagca

SEQ ID NO: 44158 - DNA, 20 bp, Artificial Sequence
  chemically synthesized
acgggtagtggggagcacgg

SEQ ID NO: 44159 - DNA, 20 bp, Artificial Sequence
  chemically synthesized
gggtagtggggagcacggtg

SEQ ID NO: 44160 - DNA, 20 bp, Artificial Sequence
  chemically synthesized
gtagtggggagcacggtgga

SEQ ID NO: 44161 - DNA, 20 bp, Artificial Sequence
  chemically synthesized
gtggggagcacggtggagag

SEQ ID NO: 44162 - DNA, 20 bp, Artificial Sequence
  chemically synthesized
tggggagcacggtggagagc

SEQ ID NO: 44163 - DNA, 20 bp, Artificial Sequence
  chemically synthesized
ggggagcacggtggagagcg

SEQ ID NO: 44164 - DNA, 20 bp, Artificial Sequence
  chemically synthesized
agcacggtggagagcgggga

SEQ ID NO: 44165 - DNA, 20 bp, Artificial Sequence
  chemically synthesized
cggtggagagcggggacggc

SEQ ID NO: 44166 - DNA, 20 bp, Artificial Sequence
  chemically synthesized
agcggggacggccggctctt

SEQ ID NO: 44167 - DNA, 20 bp, Artificial Sequence
  chemically synthesized
gcggggacggccggctcttt

SEQ ID NO: 44168 - DNA, 20 bp, Artificial Sequence
  chemically synthesized
cggggacggccggctctttg

SEQ ID NO: 44169 - DNA, 20 bp, Artificial Sequence
  chemically synthesized
ccggctctttggggacttgc

SEQ ID NO: 44170 - DNA, 20 bp, Artificial Sequence
  chemically synthesized
cggctctttggggacttgct

SEQ ID NO: 44171 - DNA, 20 bp, Artificial Sequence
  chemically synthesized
ggctctttggggacttgctg

SEQ ID NO: 44172 - DNA, 20 bp, Artificial Sequence
  chemically synthesized
tggggacttgctggggcgtg

SEQ ID NO: 44173 - DNA, 20 bp, Artificial Sequence
  chemically synthesized
gggcgtgcggctgcgctatt

SEQ ID NO: 44174 - DNA, 20 bp, Artificial Sequence
  chemically synthesized
cgtgcggctgcgctattcag

SEQ ID NO: 44175 - DNA, 20 bp, Artificial Sequence
  chemically synthesized
gtgcggctgcgctattcagt

SEQ ID NO: 44176 - DNA, 20 bp, Artificial Sequence
  chemically synthesized
cggctgcgctattcagtggg

SEQ ID NO: 44177 - DNA, 20 bp, Artificial Sequence
  chemically synthesized
ggctgcgctattcagtggga

SEQ ID NO: 44178 - DNA, 20 bp, Artificial Sequence
  chemically synthesized
ctattcagtgggaaggttcg

SEQ ID NO: 44179 - DNA, 20 bp, Artificial Sequence
  chemically synthesized
tattcagtgggaaggttcgc

SEQ ID NO: 44180 - DNA, 20 bp, Artificial Sequence
  chemically synthesized
attcagtgggaaggttcgcg

SEQ ID NO: 44181 - DNA, 20 bp, Artificial Sequence
  chemically synthesized
agtgggaaggttcgcggggt

SEQ ID NO: 44182 - DNA, 20 bp, Artificial Sequence
  chemically synthesized
gtgggaaggttcgcggggtt

SEQ ID NO: 44183 - DNA, 20 bp, Artificial Sequence
  chemically synthesized
gggaaggttcgcggggttgg

SEQ ID NO: 44184 - DNA, 20 bp, Artificial Sequence
  chemically synthesized
gttcgcggggttgggagacc

SEQ ID NO: 44185 - DNA, 20 bp, Artificial Sequence
  chemically synthesized
tcgcggggttgggagacccg

SEQ ID NO: 44186 - DNA, 20 bp, Artificial Sequence
  chemically synthesized
cgcggggttgggagacccgg

SEQ ID NO: 44187 - DNA, 20 bp, Artificial Sequence
  chemically synthesized
ggttgggagacccggaggcc

SEQ ID NO: 44188 - DNA, 20 bp, Artificial Sequence
  chemically synthesized
gttgggagacccggaggccg

SEQ ID NO: 44189 - DNA, 20 bp, Artificial Sequence
  chemically synthesized
gggagacccggaggccgagg

SEQ ID NO: 44190 - DNA, 20 bp, Artificial Sequence
  chemically synthesized
ggagacccggaggccgagga

SEQ ID NO: 44191 - DNA, 20 bp, Artificial Sequence
  chemically synthesized
gagacccggaggccgaggaa

SEQ ID NO: 44192 - DNA, 20 bp, Artificial Sequence
  chemically synthesized
cccggaggccgaggaagggc

SEQ ID NO: 44193 - DNA, 20 bp, Artificial Sequence
  chemically synthesized
ggaggccgaggaagggcgag

SEQ ID NO: 44194 - DNA, 20 bp, Artificial Sequence
  chemically synthesized
aggccgaggaagggcgagca

SEQ ID NO: 44195 - DNA, 20 bp, Artificial Sequence
  chemically synthesized
aagggcgagcagagcactgc

SEQ ID NO: 44196 - DNA, 20 bp, Artificial Sequence
  chemically synthesized
agggcgagcagagcactgcc

SEQ ID NO: 44197 - DNA, 20 bp, Artificial Sequence
  chemically synthesized
cactgccaggatatcctgcc

SEQ ID NO: 44198 - DNA, 20 bp, Artificial Sequence
  chemically synthesized
gatatcctgcccagatttcc

SEQ ID NO: 44199 - DNA, 20 bp, Artificial Sequence
  chemically synthesized
tcccagtttctgcctcgccg

SEQ ID NO: 44200 - DNA, 20 bp, Artificial Sequence
  chemically synthesized
gtttctgcctcgccgcggca

SEQ ID NO: 44201 - DNA, 20 bp, Artificial Sequence
  chemically synthesized
tttctgcctcgccgcggcac

SEQ ID NO: 44202 - DNA, 20 bp, Artificial Sequence
  chemically synthesized
ctgcctcgccgcggcacagg

SEQ ID NO: 44203 - DNA, 20 bp, Artificial Sequence
  chemically synthesized
tgcctcgccgcggcacaggt

SEQ ID NO: 44204 - DNA, 20 bp, Artificial Sequence
  chemically synthesized
cgccgcggcacaggtgggtg

SEQ ID NO: 44205 - DNA, 20 bp, Artificial Sequence
  chemically synthesized
gccgcggcacaggtgggtga

SEQ ID NO: 44206 - DNA, 20 bp, Artificial Sequence
  chemically synthesized
cgcggcacaggtgggtgaag

SEQ ID NO: 44207 - DNA, 20 bp, Artificial Sequence
  chemically synthesized
tgggtgaaggagtgaatgcc

SEQ ID NO: 44208 - DNA, 20 bp, Artificial Sequence
  chemically synthesized
agtgaatgcctggaacgtac

SEQ ID NO: 44209 - DNA, 20 bp, Artificial Sequence
  chemically synthesized
gtgaatgcctggaacgtact

SEQ ID NO: 44210 - DNA, 20 bp, Artificial Sequence
  chemically synthesized
gaacgtactgggaactgcac

SEQ ID NO: 44211 - DNA, 20 bp, Artificial Sequence
  chemically synthesized
aacgtactgggaactgcacc

SEQ ID NO: 44212 - DNA, 20 bp, Artificial Sequence
  chemically synthesized
actgggaactgcaccaggca

SEQ ID NO: 44213 - DNA, 20 bp, Artificial Sequence
  chemically synthesized
tgggaactgcaccaggcaca

SEQ ID NO: 44214 - DNA, 20 bp, Artificial Sequence
  chemically synthesized
aactgcaccaggcacagaga

SEQ ID NO: 44215 - DNA, 20 bp, Artificial Sequence
  chemically synthesized
tgcaccaggcacagagaaag

SEQ ID NO: 44216 - DNA, 20 bp, Artificial Sequence
  chemically synthesized
gcaccaggcacagagaaagc

SEQ ID NO: 44217 - DNA, 20 bp, Artificial Sequence
  chemically synthesized
agaaagcgggcttgccatta

SEQ ID NO: 44218 - DNA, 20 bp, Artificial Sequence
  chemically synthesized
aagcgggcttgccattatag

SEQ ID NO: 44219 - DNA, 20 bp, Artificial Sequence
  chemically synthesized
agcgggcttgccattatagt

SEQ ID NO: 44220 - DNA, 20 bp, Artificial Sequence
  chemically synthesized
cattatagtgggttccgatt

SEQ ID NO: 44221 - DNA, 20 bp, Artificial Sequence
  chemically synthesized
tagtgggttccgatttggtt

SEQ ID NO: 44222 - DNA, 20 bp, Artificial Sequence
  chemically synthesized
ccgatttggtttggaaaaca

SEQ ID NO: 44223 - DNA, 20 bp, Artificial Sequence
  chemically synthesized
cgatttggtttggaaaacat

SEQ ID NO: 44224 - DNA, 20 bp, Artificial Sequence
  chemically synthesized
tttggtttggaaaacatggg

SEQ ID NO: 44225 - DNA, 20 bp, Artificial Sequence
  chemically synthesized
ggtttggaaaacatgggcag

SEQ ID NO: 44226 - DNA, 20 bp, Artificial Sequence
  chemically synthesized
tttggaaaacatgggcagcg

SEQ ID NO: 44227 - DNA, 20 bp, Artificial Sequence
  chemically synthesized
ttggaaaacatgggcagcgg

SEQ ID NO: 44228 - DNA, 20 bp, Artificial Sequence
  chemically synthesized
tggaaaacatgggcagcgga

SEQ ID NO: 44229 - DNA, 20 bp, Artificial Sequence
  chemically synthesized
aaaacatgggcagcggaggg

SEQ ID NO: 44230 - DNA, 20 bp, Artificial Sequence
  chemically synthesized
aacatgggcagcggagggtg

SEQ ID NO: 44231 - DNA, 20 bp, Artificial Sequence
  chemically synthesized
acatgggcagcggagggtgg

SEQ ID NO: 44232 - DNA, 20 bp, Artificial Sequence
  chemically synthesized
catgggcagcggagggtgga

SEQ ID NO: 44233 - DNA, 20 bp, Artificial Sequence
  chemically synthesized
gcagcggagggtggagggcc

SEQ ID NO: 44234 - DNA, 20 bp, Artificial Sequence
  chemically synthesized
agcggagggtggagggcctg

SEQ ID NO: 44235 - DNA, 20 bp, Artificial Sequence
  chemically synthesized
cggagggtggagggcctgga

SEQ ID NO: 44236 - DNA, 20 bp, Artificial Sequence
  chemically synthesized
agggtggagggcctggagag

SEQ ID NO: 44237 - DNA, 20 bp, Artificial Sequence
  chemically synthesized
gggtggagggcctggagaga

SEQ ID NO: 44238 - DNA, 20 bp, Artificial Sequence
  chemically synthesized
ctggagagaaggccctaccc

SEQ ID NO: 44239 - DNA, 20 bp, Artificial Sequence
  chemically synthesized
agagaaggccctacccgaga

SEQ ID NO: 44240 - DNA, 20 bp, Artificial Sequence
  chemically synthesized
gagaaggccctacccgagac

SEQ ID NO: 44241 - DNA, 20 bp, Artificial Sequence
  chemically synthesized
agaaggccctacccgagaca

SEQ ID NO: 44242 - DNA, 20 bp, Artificial Sequence
  chemically synthesized
gaaggccctacccgagacag

SEQ ID NO: 44243 - DNA, 20 bp, Artificial Sequence
  chemically synthesized
ggccctacccgagacagggg

SEQ ID NO: 44244 - DNA, 20 bp, Artificial Sequence
  chemically synthesized
gccctacccgagacaggggc

SEQ ID NO: 44245 - DNA, 20 bp, Artificial Sequence
  chemically synthesized
ccctacccgagacaggggcg

SEQ ID NO: 44246 - DNA, 20 bp, Artificial Sequence
  chemically synthesized
tacccgagacaggggcgggg

SEQ ID NO: 44247 - DNA, 20 bp, Artificial Sequence
  chemically synthesized
acccgagacaggggcggggt

SEQ ID NO: 44248 - DNA, 20 bp, Artificial Sequence
  chemically synthesized
cgagacaggggcggggtggg

SEQ ID NO: 44249 - DNA, 20 bp, Artificial Sequence
  chemically synthesized
gagacaggggcggggtggga

SEQ ID NO: 44250 - DNA, 20 bp, Artificial Sequence
  chemically synthesized
caggggcggggtgggaagga

SEQ ID NO: 44251 - DNA, 20 bp, Artificial Sequence
  chemically synthesized
gggcggggtgggaaggacgg

SEQ ID NO: 44252 - DNA, 20 bp, Artificial Sequence
  chemically synthesized
gtgggaaggacggcagatgc

SEQ ID NO: 44253 - DNA, 20 bp, Artificial Sequence
  chemically synthesized
tgggaaggacggcagatgct

SEQ ID NO: 44254 - DNA, 20 bp, Artificial Sequence
  chemically synthesized
ggaaggacggcagatgctgg

SEQ ID NO: 44255 - DNA, 20 bp, Artificial Sequence
  chemically synthesized
acggcagatgctgggagcac

SEQ ID NO: 44256 - DNA, 20 bp, Artificial Sequence
  chemically synthesized
cggcagatgctgggagcacg

SEQ ID NO: 44257 - DNA, 20 bp, Artificial Sequence
  chemically synthesized
gaggcaatttctttatgaca

SEQ ID NO: 44258 - DNA, 20 bp, Artificial Sequence
  chemically synthesized
atgacacagaactcatgctc

SEQ ID NO: 44259 - DNA, 20 bp, Artificial Sequence
  chemically synthesized
ctctagtattccatctgttt

SEQ ID NO: 44260 - DNA, 20 bp, Artificial Sequence
  chemically synthesized
tattccatctgtttcagccg

SEQ ID NO: 44261 - DNA, 20 bp, Artificial Sequence
  chemically synthesized
catctgtttcagccgaagaa

SEQ ID NO: 44262 - DNA, 20 bp, Artificial Sequence
  chemically synthesized
tttcagccgaagaaaagaac

SEQ ID NO: 44263 - DNA, 20 bp, Artificial Sequence
  chemically synthesized
ccgaagaaaagaaccagctg

SEQ ID NO: 44264 - DNA, 20 bp, Artificial Sequence
  chemically synthesized
cgaagaaaagaaccagctga

SEQ ID NO: 44265 - DNA, 20 bp, Artificial Sequence
  chemically synthesized
gaagaaaagaaccagctgaa

SEQ ID NO: 44266 - DNA, 20 bp, Artificial Sequence
  chemically synthesized
aagaaaagaaccagctgaag

SEQ ID NO: 44267 - DNA, 20 bp, Artificial Sequence
  chemically synthesized
aaaagaaccagctgaagggg

SEQ ID NO: 44268 - DNA, 20 bp, Artificial Sequence
  chemically synthesized
aaagaaccagctgaaggggc

SEQ ID NO: 44269 - DNA, 20 bp, Artificial Sequence
  chemically synthesized
aagaaccagctgaaggggca

SEQ ID NO: 44270 - DNA, 20 bp, Artificial Sequence
  chemically synthesized
agaaccagctgaaggggcag

SEQ ID NO: 44271 - DNA, 20 bp, Artificial Sequence
  chemically synthesized
aaccagctgaaggggcaggg

SEQ ID NO: 44272 - DNA, 20 bp, Artificial Sequence
  chemically synthesized
cagctgaaggggcaggggag

SEQ ID NO: 44273 - DNA, 20 bp, Artificial Sequence
  chemically synthesized
agctgaaggggcaggggaga

SEQ ID NO: 44274 - DNA, 20 bp, Artificial Sequence
  chemically synthesized
gctgaaggggcaggggagaa

SEQ ID NO: 44275 - DNA, 20 bp, Artificial Sequence
  chemically synthesized
ctgaaggggcaggggagaag

SEQ ID NO: 44276 - DNA, 20 bp, Artificial Sequence
  chemically synthesized
aaggggcaggggagaagggg

SEQ ID NO: 44277 - DNA, 20 bp, Artificial Sequence
  chemically synthesized
ggggcaggggagaaggggcg

SEQ ID NO: 44278 - DNA, 20 bp, Artificial Sequence
  chemically synthesized
gggcaggggagaaggggcgg

SEQ ID NO: 44279 - DNA, 20 bp, Artificial Sequence
  chemically synthesized
gaaggggcggaggtattctc

SEQ ID NO: 44280 - DNA, 20 bp, Artificial Sequence
  chemically synthesized
aaggggcggaggtattctcg

SEQ ID NO: 44281 - DNA, 20 bp, Artificial Sequence
  chemically synthesized
gaggtattctcgaggcccat

SEQ ID NO: 44282 - DNA, 20 bp, Artificial Sequence
  chemically synthesized
cgaggcccattggcgtcctt

SEQ ID NO: 44283 - DNA, 20 bp, Artificial Sequence
  chemically synthesized
gaggcccattggcgtccttt

SEQ ID NO: 44284 - DNA, 20 bp, Artificial Sequence
  chemically synthesized
cattggcgtcctttaggact

SEQ ID NO: 44285 - DNA, 20 bp, Artificial Sequence
  chemically synthesized
attggcgtcctttaggactc

SEQ ID NO: 44286 - DNA, 20 bp, Artificial Sequence
  chemically synthesized
ggcgtcctttaggactcagg

SEQ ID NO: 44287 - DNA, 20 bp, Artificial Sequence
  chemically synthesized
gcgtcctttaggactcaggc

SEQ ID NO: 44288 - DNA, 20 bp, Artificial Sequence
  chemically synthesized
cgtcctttaggactcaggca

SEQ ID NO: 44289 - DNA, 20 bp, Artificial Sequence
  chemically synthesized
cctttaggactcaggcaggg

SEQ ID NO: 44290 - DNA, 20 bp, Artificial Sequence
  chemically synthesized
ctttaggactcaggcaggga

SEQ ID NO: 44291 - DNA, 20 bp, Artificial Sequence
  chemically synthesized
tttaggactcaggcagggaa

SEQ ID NO: 44292 - DNA, 20 bp, Artificial Sequence
  chemically synthesized
ctcaggcagggaagggccct

SEQ ID NO: 44293 - DNA, 20 bp, Artificial Sequence
  chemically synthesized
gggaagggcccttggtgctc

SEQ ID NO: 44294 - DNA, 20 bp, Artificial Sequence
  chemically synthesized
gaagggcccttggtgctctg

SEQ ID NO: 44295 - DNA, 20 bp, Artificial Sequence
  chemically synthesized
ggcccttggtgctctggagc

SEQ ID NO: 44296 - DNA, 20 bp, Artificial Sequence
  chemically synthesized
cccttggtgctctggagccg

SEQ ID NO: 44297 - DNA, 20 bp, Artificial Sequence
  chemically synthesized
ccttggtgctctggagccgg

SEQ ID NO: 44298 - DNA, 20 bp, Artificial Sequence
  chemically synthesized
tggtgctctggagccggagg

SEQ ID NO: 44299 - DNA, 20 bp, Artificial Sequence
  chemically synthesized
ggagccggaggtggtgcgcc

SEQ ID NO: 44300 - DNA, 20 bp, Artificial Sequence
  chemically synthesized
ggaggtggtgcgcctggtac

SEQ ID NO: 44301 - DNA, 20 bp, Artificial Sequence
  chemically synthesized
gaggtggtgcgcctggtact

SEQ ID NO: 44302 - DNA, 20 bp, Artificial Sequence
  chemically synthesized
tgcgcctggtactgggaccc

SEQ ID NO: 44303 - DNA, 20 bp, Artificial Sequence
  chemically synthesized
cgcctggtactgggaccccg

SEQ ID NO: 44304 - DNA, 20 bp, Artificial Sequence
  chemically synthesized
ggtactgggaccccggagct

SEQ ID NO: 44305 - DNA, 20 bp, Artificial Sequence
  chemically synthesized
tgggaccccggagctgagcc

SEQ ID NO: 44306 - DNA, 20 bp, Artificial Sequence
  chemically synthesized
cggagctgagcccggcgcct

SEQ ID NO: 44307 - DNA, 20 bp, Artificial Sequence
  chemically synthesized
gcccggcgcctcagcccacc

SEQ ID NO: 44308 - DNA, 20 bp, Artificial Sequence
  chemically synthesized
ggctgtctgccgaccgtgtg

SEQ ID NO: 44309 - DNA, 20 bp, Artificial Sequence
  chemically synthesized
gctgtctgccgaccgtgtgc

SEQ ID NO: 44310 - DNA, 20 bp, Artificial Sequence
  chemically synthesized
ctgtctgccgaccgtgtgcg

SEQ ID NO: 44311 - DNA, 20 bp, Artificial Sequence
  chemically synthesized
ctgccgaccgtgtgcggggc

SEQ ID NO: 44312 - DNA, 20 bp, Artificial Sequence
  chemically synthesized
agtttgctcaacaactctgc

SEQ ID NO: 44313 - DNA, 20 bp, Artificial Sequence
  chemically synthesized
tcaacaactctgccagcttc

SEQ ID NO: 44314 - DNA, 20 bp, Artificial Sequence
  chemically synthesized
ctctgccagcttctggccct

SEQ ID NO: 44315 - DNA, 20 bp, Artificial Sequence
  chemically synthesized
tctgccagcttctggccctc

SEQ ID NO: 44316 - DNA, 20 bp, Artificial Sequence
  chemically synthesized
agcttctggccctcaggctg

SEQ ID NO: 44317 - DNA, 20 bp, Artificial Sequence
  chemically synthesized
gcttctggccctcaggctgt

SEQ ID NO: 44318 - DNA, 20 bp, Artificial Sequence
  chemically synthesized
tctggccctcaggctgtggg

SEQ ID NO: 44319 - DNA, 20 bp, Artificial Sequence
  chemically synthesized
ggctgtgggaagcttcttcc

SEQ ID NO: 44320 - DNA, 20 bp, Artificial Sequence
  chemically synthesized
gctgtgggaagcttcttccc

SEQ ID NO: 44321 - DNA, 20 bp, Artificial Sequence
  chemically synthesized
ctgtgggaagcttcttcccg

SEQ ID NO: 44322 - DNA, 20 bp, Artificial Sequence
  chemically synthesized
gggaagcttcttcccggggc

SEQ ID NO: 44323 - DNA, 20 bp, Artificial Sequence
  chemically synthesized
tcttcccggggcgagaccac

SEQ ID NO: 44324 - DNA, 20 bp, Artificial Sequence
  chemically synthesized
cgagaccactagctttttct

SEQ ID NO: 44325 - DNA, 20 bp, Artificial Sequence
  chemically synthesized
tagctttttctaagtattac

SEQ ID NO: 44326 - DNA, 20 bp, Artificial Sequence
  chemically synthesized
ttttctaagtattaccagcc

SEQ ID NO: 44327 - DNA, 20 bp, Artificial Sequence
  chemically synthesized
tttctaagtattaccagccc

SEQ ID NO: 44328 - DNA, 20 bp, Artificial Sequence
  chemically synthesized
agtattaccagcccaggact

SEQ ID NO: 44329 - DNA, 20 bp, Artificial Sequence
  chemically synthesized
taccagcccaggacttggct

SEQ ID NO: 44330 - DNA, 20 bp, Artificial Sequence
  chemically synthesized
accagcccaggacttggctg

SEQ ID NO: 44331 - DNA, 20 bp, Artificial Sequence
  chemically synthesized
ggctgaggttctgtgtcccc

SEQ ID NO: 44332 - DNA, 20 bp, Artificial Sequence
  chemically synthesized
aggttctgtgtcccccagct

SEQ ID NO: 44333 - DNA, 20 bp, Artificial Sequence
  chemically synthesized
gttctgtgtcccccagcttg

SEQ ID NO: 44334 - DNA, 20 bp, Artificial Sequence
  chemically synthesized
tgtgtcccccagcttggagt

SEQ ID NO: 44335 - DNA, 20 bp, Artificial Sequence
  chemically synthesized
ccccagcttggagtcagatg

SEQ ID NO: 44336 - DNA, 20 bp, Artificial Sequence
  chemically synthesized
cccagcttggagtcagatgt

SEQ ID NO: 44337 - DNA, 20 bp, Artificial Sequence
  chemically synthesized
ccagcttggagtcagatgtg

SEQ ID NO: 44338 - DNA, 20 bp, Artificial Sequence
  chemically synthesized
tcagatgtggggttgaatct

SEQ ID NO: 44339 - DNA, 20 bp, Artificial Sequence
  chemically synthesized
gaatcttggcttcctctcac

SEQ ID NO: 44340 - DNA, 20 bp, Artificial Sequence
  chemically synthesized
tggcttcctctcactagctg

SEQ ID NO: 44341 - DNA, 20 bp, Artificial Sequence
  chemically synthesized
cactagctgtggtgcttgac

SEQ ID NO: 44342 - DNA, 20 bp, Artificial Sequence
  chemically synthesized
ttgacaagtcacttatcctt

SEQ ID NO: 44343 - DNA, 20 bp, Artificial Sequence
  chemically synthesized
ctccattgcctaatctttaa

SEQ ID NO: 44344 - DNA, 20 bp, Artificial Sequence
  chemically synthesized
tccattgcctaatctttaaa

SEQ ID NO: 44345 - DNA, 20 bp, Artificial Sequence
  chemically synthesized
ccattgcctaatctttaaaa

SEQ ID NO: 44346 - DNA, 20 bp, Artificial Sequence
  chemically synthesized
attgcctaatctttaaaagg

SEQ ID NO: 44347 - DNA, 20 bp, Artificial Sequence
  chemically synthesized
ttgcctaatctttaaaaggg

SEQ ID NO: 44348 - DNA, 20 bp, Artificial Sequence
  chemically synthesized
ggaggtgacaatcgtcccta

SEQ ID NO: 44349 - DNA, 20 bp, Artificial Sequence
  chemically synthesized
tgacaatcgtccctacggct

SEQ ID NO: 44350 - DNA, 20 bp, Artificial Sequence
  chemically synthesized
caatcgtccctacggctcag

SEQ ID NO: 44351 - DNA, 20 bp, Artificial Sequence
  chemically synthesized
tcgtccctacggctcagtgg

SEQ ID NO: 44352 - DNA, 20 bp, Artificial Sequence
  chemically synthesized
tccctacggctcagtggcag

SEQ ID NO: 44353 - DNA, 20 bp, Artificial Sequence
  chemically synthesized
tacggctcagtggcagcaga

SEQ ID NO: 44354 - DNA, 20 bp, Artificial Sequence
  chemically synthesized
acggctcagtggcagcagat

SEQ ID NO: 44355 - DNA, 20 bp, Artificial Sequence
  chemically synthesized
cggctcagtggcagcagatg

SEQ ID NO: 44356 - DNA, 20 bp, Artificial Sequence
  chemically synthesized
gctcagtggcagcagatggg

SEQ ID NO: 44357 - DNA, 20 bp, Artificial Sequence
  chemically synthesized
tggcagcagatggggagatg

SEQ ID NO: 44358 - DNA, 20 bp, Artificial Sequence
  chemically synthesized
ggcagcagatggggagatga

SEQ ID NO: 44359 - DNA, 20 bp, Artificial Sequence
  chemically synthesized
gcagcagatggggagatgaa

SEQ ID NO: 44360 - DNA, 20 bp, Artificial Sequence
  chemically synthesized
cagatggggagatgaaggga

SEQ ID NO: 44361 - DNA, 20 bp, Artificial Sequence
  chemically synthesized
gggaaagttctgttgaccat

SEQ ID NO: 44362 - DNA, 20 bp, Artificial Sequence
  chemically synthesized
catgagtgaacttacaatgc

SEQ ID NO: 44363 - DNA, 20 bp, Artificial Sequence
  chemically synthesized
tgaacttacaatgcaagccc

SEQ ID NO: 44364 - DNA, 20 bp, Artificial Sequence
  chemically synthesized
gaacttacaatgcaagcccc

SEQ ID NO: 44365 - DNA, 20 bp, Artificial Sequence
  chemically synthesized
aacttacaatgcaagccccg

SEQ ID NO: 44366 - DNA, 20 bp, Artificial Sequence
  chemically synthesized
acttacaatgcaagccccgg

SEQ ID NO: 44367 - DNA, 20 bp, Artificial Sequence
  chemically synthesized
cttacaatgcaagccccggg

SEQ ID NO: 44368 - DNA, 20 bp, Artificial Sequence
  chemically synthesized
agccccggggggatcacttg

SEQ ID NO: 44369 - DNA, 20 bp, Artificial Sequence
  chemically synthesized
tgcagttttgtccctgtctg

SEQ ID NO: 44370 - DNA, 20 bp, Artificial Sequence
  chemically synthesized
ctgtctgcagtgtgacctgt

SEQ ID NO: 44371 - DNA, 20 bp, Artificial Sequence
  chemically synthesized
attgtctttgctccaaacca

SEQ ID NO: 44372 - DNA, 20 bp, Artificial Sequence
  chemically synthesized
ttgctccaaaccacagctcc

SEQ ID NO: 44373 - DNA, 20 bp, Artificial Sequence
  chemically synthesized
tgctccaaaccacagctcct

SEQ ID NO: 44374 - DNA, 20 bp, Artificial Sequence
  chemically synthesized
gctccaaaccacagctcctg

SEQ ID NO: 44375 - DNA, 20 bp, Artificial Sequence
  chemically synthesized
ccaaaccacagctcctgggg

SEQ ID NO: 44376 - DNA, 20 bp, Artificial Sequence
  chemically synthesized
aaaccacagctcctggggca

SEQ ID NO: 44377 - DNA, 20 bp, Artificial Sequence
  chemically synthesized
aaccacagctcctggggcag

SEQ ID NO: 44378 - DNA, 20 bp, Artificial Sequence
  chemically synthesized
accacagctcctggggcaga

SEQ ID NO: 44379 - DNA, 20 bp, Artificial Sequence
  chemically synthesized
ccacagctcctggggcagag

SEQ ID NO: 44380 - DNA, 20 bp, Artificial Sequence
  chemically synthesized
ggggaaaattctgccactca

SEQ ID NO: 44381 - DNA, 20 bp, Artificial Sequence
  chemically synthesized
gcctgcccacgcttctgtct

SEQ ID NO: 44382 - DNA, 20 bp, Artificial Sequence
  chemically synthesized
acgcttctgtctgagtgtgc

SEQ ID NO: 44383 - DNA, 20 bp, Artificial Sequence
  chemically synthesized
cgcttctgtctgagtgtgct

SEQ ID NO: 44384 - DNA, 20 bp, Artificial Sequence
  chemically synthesized
ttctgtctgagtgtgctggg

SEQ ID NO: 44385 - DNA, 20 bp, Artificial Sequence
  chemically synthesized
tgtctgagtgtgctgggtgg

SEQ ID NO: 44386 - DNA, 20 bp, Artificial Sequence
  chemically synthesized
gtctgagtgtgctgggtggc

SEQ ID NO: 44387 - DNA, 20 bp, Artificial Sequence
  chemically synthesized
gagtgtgctgggtggcagga

SEQ ID NO: 44388 - DNA, 20 bp, Artificial Sequence
  chemically synthesized
gtgctgggtggcaggatggc

SEQ ID NO: 44389 - DNA, 20 bp, Artificial Sequence
  chemically synthesized
caggatggcaagtccttact

SEQ ID NO: 44390 - DNA, 20 bp, Artificial Sequence
  chemically synthesized
tggcaagtccttactcagct

SEQ ID NO: 44391 - DNA, 20 bp, Artificial Sequence
  chemically synthesized
agtccttactcagctcagta

SEQ ID NO: 44392 - DNA, 20 bp, Artificial Sequence
  chemically synthesized
agccctcttccttgttccct

SEQ ID NO: 44393 - DNA, 20 bp, Artificial Sequence
  chemically synthesized
cctgagcctttgactttctc

SEQ ID NO: 44394 - DNA, 20 bp, Artificial Sequence
  chemically synthesized
ctgagcctttgactttctcg

SEQ ID NO: 44395 - DNA, 20 bp, Artificial Sequence
  chemically synthesized
tgagcctttgactttctcga

SEQ ID NO: 44396 - DNA, 20 bp, Artificial Sequence
  chemically synthesized
gactttctcgagggatgttg

SEQ ID NO: 44397 - DNA, 20 bp, Artificial Sequence
  chemically synthesized
actttctcgagggatgttgt

SEQ ID NO: 44398 - DNA, 20 bp, Artificial Sequence
  chemically synthesized
ctttctcgagggatgttgtg

SEQ ID NO: 44399 - DNA, 20 bp, Artificial Sequence
  chemically synthesized
cgagggatgttgtggggttg

SEQ ID NO: 44400 - DNA, 20 bp, Artificial Sequence
  chemically synthesized
ggatgttgtggggttgtggc

SEQ ID NO: 44401 - DNA, 20 bp, Artificial Sequence
  chemically synthesized
gatgttgtggggttgtggcc

SEQ ID NO: 44402 - DNA, 20 bp, Artificial Sequence
  chemically synthesized
tgtggggttgtggccaggat

SEQ ID NO: 44403 - DNA, 20 bp, Artificial Sequence
  chemically synthesized
gggttgtggccaggataaga

SEQ ID NO: 44404 - DNA, 20 bp, Artificial Sequence
  chemically synthesized
ggttgtggccaggataagaa

SEQ ID NO: 44405 - DNA, 20 bp, Artificial Sequence
  chemically synthesized
gttgtggccaggataagaaa

SEQ ID NO: 44406 - DNA, 20 bp, Artificial Sequence
  chemically synthesized
aggataagaaagggcatttc

SEQ ID NO: 44407 - DNA, 20 bp, Artificial Sequence
  chemically synthesized
ctgctccaaaacaactgttc

SEQ ID NO: 44408 - DNA, 20 bp, Artificial Sequence
  chemically synthesized
caaaacaactgttctggaaa

SEQ ID NO: 44409 - DNA, 20 bp, Artificial Sequence
  chemically synthesized
acaactgttctggaaatagt

SEQ ID NO: 44410 - DNA, 20 bp, Artificial Sequence
  chemically synthesized
aatagtgagtaccccatcct

SEQ ID NO: 44411 - DNA, 20 bp, Artificial Sequence
  chemically synthesized
tagtgagtaccccatcctga

SEQ ID NO: 44412 - DNA, 20 bp, Artificial Sequence
  chemically synthesized
agtgagtaccccatcctgag

SEQ ID NO: 44413 - DNA, 20 bp, Artificial Sequence
  chemically synthesized
agtaccccatcctgagaggt

SEQ ID NO: 44414 - DNA, 20 bp, Artificial Sequence
  chemically synthesized
ccccatcctgagaggtgagt

SEQ ID NO: 44415 - DNA, 20 bp, Artificial Sequence
  chemically synthesized
catcctgagaggtgagtaag

SEQ ID NO: 44416 - DNA, 20 bp, Artificial Sequence
  chemically synthesized
tcctgagaggtgagtaagca

SEQ ID NO: 44417 - DNA, 20 bp, Artificial Sequence
  chemically synthesized
cctgagaggtgagtaagcag

SEQ ID NO: 44418 - DNA, 20 bp, Artificial Sequence
  chemically synthesized
gctgtatgaccacctgaacc

SEQ ID NO: 44419 - DNA, 20 bp, Artificial Sequence
  chemically synthesized
accacctgaaccaagccctt

SEQ ID NO: 44420 - DNA, 20 bp, Artificial Sequence
  chemically synthesized
ccacctgaaccaagcccttg

SEQ ID NO: 44421 - DNA, 20 bp, Artificial Sequence
  chemically synthesized
ccttgaggatgtttcttctc

SEQ ID NO: 44422 - DNA, 20 bp, Artificial Sequence
  chemically synthesized
tgaggatgtttcttctctgg

SEQ ID NO: 44423 - DNA, 20 bp, Artificial Sequence
  chemically synthesized
ggatgtttcttctctggtgg

SEQ ID NO: 44424 - DNA, 20 bp, Artificial Sequence
  chemically synthesized
tttcttctctggtggaagtt

SEQ ID NO: 44425 - DNA, 20 bp, Artificial Sequence
  chemically synthesized
tctctggtggaagtttggaa

SEQ ID NO: 44426 - DNA, 20 bp, Artificial Sequence
  chemically synthesized
ctctggtggaagtttggaac

SEQ ID NO: 44427 - DNA, 20 bp, Artificial Sequence
  chemically synthesized
ctggtggaagtttggaacag

SEQ ID NO: 44428 - DNA, 20 bp, Artificial Sequence
  chemically synthesized
tttggaacaggagcctcctc

SEQ ID NO: 44429 - DNA, 20 bp, Artificial Sequence
  chemically synthesized
tcatttattcattcattcaa

SEQ ID NO: 44430 - DNA, 20 bp, Artificial Sequence
  chemically synthesized
ttcattcaatggttattttg

SEQ ID NO: 44431 - DNA, 20 bp, Artificial Sequence
  chemically synthesized
tcattcaatggttattttgt

SEQ ID NO: 44432 - DNA, 20 bp, Artificial Sequence
  chemically synthesized
tattttgtgggaatcgaatt

SEQ ID NO: 44433 - DNA, 20 bp, Artificial Sequence
  chemically synthesized
tttagaatgaaaatattttt

SEQ ID NO: 44434 - DNA, 20 bp, Artificial Sequence
  chemically synthesized
gaatgaaaatattttttggc

SEQ ID NO: 44435 - DNA, 20 bp, Artificial Sequence
  chemically synthesized
tgaaaatattttttggcaag

SEQ ID NO: 44436 - DNA, 20 bp, Artificial Sequence
  chemically synthesized
ggcaagcagaaaataatttt

SEQ ID NO: 44437 - DNA, 20 bp, Artificial Sequence
  chemically synthesized
ttagaccaatccttttcttt

SEQ ID NO: 44438 - DNA, 20 bp, Artificial Sequence
  chemically synthesized
aatccttttcttttagtcat

SEQ ID NO: 44439 - DNA, 20 bp, Artificial Sequence
  chemically synthesized
tcttttagtcatgagaaact

SEQ ID NO: 44440 - DNA, 20 bp, Artificial Sequence
  chemically synthesized
cttttagtcatgagaaactg

SEQ ID NO: 44441 - DNA, 20 bp, Artificial Sequence
  chemically synthesized
agtcatgagaaactgaggcc

SEQ ID NO: 44442 - DNA, 20 bp, Artificial Sequence
  chemically synthesized
tcatgagaaactgaggccca

SEQ ID NO: 44443 - DNA, 20 bp, Artificial Sequence
  chemically synthesized
atgagaaactgaggcccaga

SEQ ID NO: 44444 - DNA, 20 bp, Artificial Sequence
  chemically synthesized
gagaaactgaggcccagaga

SEQ ID NO: 44445 - DNA, 20 bp, Artificial Sequence
  chemically synthesized
agaaactgaggcccagagag

SEQ ID NO: 44446 - DNA, 20 bp, Artificial Sequence
  chemically synthesized
aaactgaggcccagagagag

SEQ ID NO: 44447 - DNA, 20 bp, Artificial Sequence
  chemically synthesized
aactgaggcccagagagagg

SEQ ID NO: 44448 - DNA, 20 bp, Artificial Sequence
  chemically synthesized
ccagagagaggaggtcaccc

SEQ ID NO: 44449 - DNA, 20 bp, Artificial Sequence
  chemically synthesized
cagagagaggaggtcacccc

SEQ ID NO: 44450 - DNA, 20 bp, Artificial Sequence
  chemically synthesized
ggaggtcaccccaggtgcat

SEQ ID NO: 44451 - DNA, 20 bp, Artificial Sequence
  chemically synthesized
caccccaggtgcattagaac

SEQ ID NO: 44452 - DNA, 20 bp, Artificial Sequence
  chemically synthesized
accccaggtgcattagaact

SEQ ID NO: 44453 - DNA, 20 bp, Artificial Sequence
  chemically synthesized
gtgcattagaactgggtttc

SEQ ID NO: 44454 - DNA, 20 bp, Artificial Sequence
  chemically synthesized
agaactgacactccactgca

SEQ ID NO: 44455 - DNA, 20 bp, Artificial Sequence
  chemically synthesized
aactgacactccactgcaca

SEQ ID NO: 44456 - DNA, 20 bp, Artificial Sequence
  chemically synthesized
caattcattcaatttttatt

SEQ ID NO: 44457 - DNA, 20 bp, Artificial Sequence
  chemically synthesized
ttcattcaatttttatttag

SEQ ID NO: 44458 - DNA, 20 bp, Artificial Sequence
  chemically synthesized
attcaatttttatttagcgg

SEQ ID NO: 44459 - DNA, 20 bp, Artificial Sequence
  chemically synthesized
ttcaatttttatttagcgga

SEQ ID NO: 44460 - DNA, 20 bp, Artificial Sequence
  chemically synthesized
tatttagcggaaggcatttt

SEQ ID NO: 44461 - DNA, 20 bp, Artificial Sequence
  chemically synthesized
tagcggaaggcattttcaga

SEQ ID NO: 44462 - DNA, 20 bp, Artificial Sequence
  chemically synthesized
agcggaaggcattttcagat

SEQ ID NO: 44463 - DNA, 20 bp, Artificial Sequence
  chemically synthesized
cattttcagatgggtctttg

SEQ ID NO: 44464 - DNA, 20 bp, Artificial Sequence
  chemically synthesized
cagatgggtctttgaagcat

SEQ ID NO: 44465 - DNA, 20 bp, Artificial Sequence
  chemically synthesized
atgggtctttgaagcattag

SEQ ID NO: 44466 - DNA, 20 bp, Artificial Sequence
  chemically synthesized
tgggtctttgaagcattagt

SEQ ID NO: 44467 - DNA, 20 bp, Artificial Sequence
  chemically synthesized
ggtctttgaagcattagtag

SEQ ID NO: 44468 - DNA, 20 bp, Artificial Sequence
  chemically synthesized
ttgaagcattagtaggagtt

SEQ ID NO: 44469 - DNA, 20 bp, Artificial Sequence
  chemically synthesized
tagtaggagttcagcgatga

SEQ ID NO: 44470 - DNA, 20 bp, Artificial Sequence
  chemically synthesized
ttcagcgatgatggtgtcat

SEQ ID NO: 44471 - DNA, 20 bp, Artificial Sequence
  chemically synthesized
gtgtcatgagaattttattc

SEQ ID NO: 44472 - DNA, 20 bp, Artificial Sequence
  chemically synthesized
tgtcatgagaattttattct

SEQ ID NO: 44473 - DNA, 20 bp, Artificial Sequence
  chemically synthesized
tgagaattttattctaggat

SEQ ID NO: 44474 - DNA, 20 bp, Artificial Sequence
  chemically synthesized
gagaattttattctaggatt

SEQ ID NO: 44475 - DNA, 20 bp, Artificial Sequence
  chemically synthesized
gaattttattctaggattag

SEQ ID NO: 44476 - DNA, 20 bp, Artificial Sequence
  chemically synthesized
aattttattctaggattagg

SEQ ID NO: 44477 - DNA, 20 bp, Artificial Sequence
  chemically synthesized
attaggaggtaccatgaaca

SEQ ID NO: 44478 - DNA, 20 bp, Artificial Sequence
  chemically synthesized
aggtaccatgaacaaagata

SEQ ID NO: 44479 - DNA, 20 bp, Artificial Sequence
  chemically synthesized
gtaccatgaacaaagataca

SEQ ID NO: 44480 - DNA, 20 bp, Artificial Sequence
  chemically synthesized
catgaacaaagatacagagc

SEQ ID NO: 44481 - DNA, 20 bp, Artificial Sequence
  chemically synthesized
atgaacaaagatacagagct

SEQ ID NO: 44482 - DNA, 20 bp, Artificial Sequence
  chemically synthesized
agatacagagctgggaaaac

SEQ ID NO: 44483 - DNA, 20 bp, Artificial Sequence
  chemically synthesized
atacagagctgggaaaacca

SEQ ID NO: 44484 - DNA, 20 bp, Artificial Sequence
  chemically synthesized
tacagagctgggaaaaccag

SEQ ID NO: 44485 - DNA, 20 bp, Artificial Sequence
  chemically synthesized
agagctgggaaaaccagagg

SEQ ID NO: 44486 - DNA, 20 bp, Artificial Sequence
  chemically synthesized
gctgggaaaaccagaggtgg

SEQ ID NO: 44487 - DNA, 20 bp, Artificial Sequence
  chemically synthesized
gaaaaccagaggtggaagat

SEQ ID NO: 44488 - DNA, 20 bp, Artificial Sequence
  chemically synthesized
aaaaccagaggtggaagata

SEQ ID NO: 44489 - DNA, 20 bp, Artificial Sequence
  chemically synthesized
aaccagaggtggaagataag

SEQ ID NO: 44490 - DNA, 20 bp, Artificial Sequence
  chemically synthesized
agataaggagcacatgtcca

SEQ ID NO: 44491 - DNA, 20 bp, Artificial Sequence
  chemically synthesized
gttctttttctttttttttt

SEQ ID NO: 44492 - DNA, 20 bp, Artificial Sequence
  chemically synthesized
tttttcttttttttttgaga

SEQ ID NO: 44493 - DNA, 20 bp, Artificial Sequence
  chemically synthesized
tttcttttttttttgagatg

SEQ ID NO: 44494 - DNA, 20 bp, Artificial Sequence
  chemically synthesized
ggagtttcgctcttgttgcc

SEQ ID NO: 44495 - DNA, 20 bp, Artificial Sequence
  chemically synthesized
gagtttcgctcttgttgccc

SEQ ID NO: 44496 - DNA, 20 bp, Artificial Sequence
  chemically synthesized
ttcgctcttgttgcccaggc

SEQ ID NO: 44497 - DNA, 20 bp, Artificial Sequence
  chemically synthesized
cgctcttgttgcccaggctg

SEQ ID NO: 44498 - DNA, 20 bp, Artificial Sequence
  chemically synthesized
ttgcccaggctggagtgcaa

SEQ ID NO: 44499 - DNA, 20 bp, Artificial Sequence
  chemically synthesized
caggctggagtgcaatggtg

SEQ ID NO: 44500 - DNA, 20 bp, Artificial Sequence
  chemically synthesized
ggagtgcaatggtgcagtct

SEQ ID NO: 44501 - DNA, 20 bp, Artificial Sequence
  chemically synthesized
tcactgcaacatctgtctcc

SEQ ID NO: 44502 - DNA, 20 bp, Artificial Sequence
  chemically synthesized
cactgcaacatctgtctccc

SEQ ID NO: 44503 - DNA, 20 bp, Artificial Sequence
  chemically synthesized
aacatctgtctcccgggttc

SEQ ID NO: 44504 - DNA, 20 bp, Artificial Sequence
  chemically synthesized
atctgtctcccgggttcaag

SEQ ID NO: 44505 - DNA, 20 bp, Artificial Sequence
  chemically synthesized
ttcaagtggttctcctgcct

SEQ ID NO: 44506 - DNA, 20 bp, Artificial Sequence
  chemically synthesized
ttctcctgcctcagcctccc

SEQ ID NO: 44507 - DNA, 20 bp, Artificial Sequence
  chemically synthesized
tcctgcctcagcctcccaag

SEQ ID NO: 44508 - DNA, 20 bp, Artificial Sequence
  chemically synthesized
gcctcagcctcccaagaagc

SEQ ID NO: 44509 - DNA, 20 bp, Artificial Sequence
  chemically synthesized
cctcagcctcccaagaagct

SEQ ID NO: 44510 - DNA, 20 bp, Artificial Sequence
  chemically synthesized
ctcccaagaagctgggatta

SEQ ID NO: 44511 - DNA, 20 bp, Artificial Sequence
  chemically synthesized
tcccaagaagctgggattac

SEQ ID NO: 44512 - DNA, 20 bp, Artificial Sequence
  chemically synthesized
caggtacctgccaccacgcc

SEQ ID NO: 44513 - DNA, 20 bp, Artificial Sequence
  chemically synthesized
ccggctaatttttgtatttt

SEQ ID NO: 44514 - DNA, 20 bp, Artificial Sequence
  chemically synthesized
gctaatttttgtatttttag

SEQ ID NO: 44515 - DNA, 20 bp, Artificial Sequence
  chemically synthesized
taatttttgtatttttagta

SEQ ID NO: 44516 - DNA, 20 bp, Artificial Sequence
  chemically synthesized
tttttgtatttttagtagag

SEQ ID NO: 44517 - DNA, 20 bp, Artificial Sequence
  chemically synthesized
ttttgtatttttagtagaga

SEQ ID NO: 44518 - DNA, 20 bp, Artificial Sequence
  chemically synthesized
tttgtatttttagtagagaa

SEQ ID NO: 44519 - DNA, 20 bp, Artificial Sequence
  chemically synthesized
ttgtatttttagtagagaag

SEQ ID NO: 44520 - DNA, 20 bp, Artificial Sequence
  chemically synthesized
gagaaggggtttcaccacgt

SEQ ID NO: 44521 - DNA, 20 bp, Artificial Sequence
  chemically synthesized
aggggtttcaccacgttggc

SEQ ID NO: 44522 - DNA, 20 bp, Artificial Sequence
  chemically synthesized
ggggtttcaccacgttggcc

SEQ ID NO: 44523 - DNA, 20 bp, Artificial Sequence
  chemically synthesized
tttcaccacgttggccaggc

SEQ ID NO: 44524 - DNA, 20 bp, Artificial Sequence
  chemically synthesized
tcgcaaactcctgacctcct

SEQ ID NO: 44525 - DNA, 20 bp, Artificial Sequence
  chemically synthesized
caaactcctgacctcctcag

SEQ ID NO: 44526 - DNA, 20 bp, Artificial Sequence
  chemically synthesized
ctgacctcctcagtggatcc

SEQ ID NO: 44527 - DNA, 20 bp, Artificial Sequence
  chemically synthesized
tgacctcctcagtggatccg

SEQ ID NO: 44528 - DNA, 20 bp, Artificial Sequence
  chemically synthesized
acctcctcagtggatccgag

SEQ ID NO: 44529 - DNA, 20 bp, Artificial Sequence
  chemically synthesized
cctcctcagtggatccgagg

SEQ ID NO: 44530 - DNA, 20 bp, Artificial Sequence
  chemically synthesized
aggaggtgatcctcccgcct

SEQ ID NO: 44531 - DNA, 20 bp, Artificial Sequence
  chemically synthesized
cctcccgcctcagcctccca

SEQ ID NO: 44532 - DNA, 20 bp, Artificial Sequence
  chemically synthesized
ctcccaaagtgctcgaatta

SEQ ID NO: 44533 - DNA, 20 bp, Artificial Sequence
  chemically synthesized
tcccaaagtgctcgaattac

SEQ ID NO: 44534 - DNA, 20 bp, Artificial Sequence
  chemically synthesized
agtgctcgaattacaggtgt

SEQ ID NO: 44535 - DNA, 20 bp, Artificial Sequence
  chemically synthesized
caggtgtgagccaccacgcc

SEQ ID NO: 44536 - DNA, 20 bp, Artificial Sequence
  chemically synthesized
gccaccacgcctggcctcca

SEQ ID NO: 44537 - DNA, 20 bp, Artificial Sequence
  chemically synthesized
taaaatgttacgaaaaccaa

SEQ ID NO: 44538 - DNA, 20 bp, Artificial Sequence
  chemically synthesized
tttttttgtgatttatttga

SEQ ID NO: 44539 - DNA, 20 bp, Artificial Sequence
  chemically synthesized
ttttgtgatttatttgatgg

SEQ ID NO: 44540 - DNA, 20 bp, Artificial Sequence
  chemically synthesized
cacctgacgtgaactgacat

SEQ ID NO: 44541 - DNA, 20 bp, Artificial Sequence
  chemically synthesized
acatgagattatttttaatt

SEQ ID NO: 44542 - DNA, 20 bp, Artificial Sequence
  chemically synthesized
tattcatatattttgctgca

SEQ ID NO: 44543 - DNA, 20 bp, Artificial Sequence
  chemically synthesized
atattttgctgcatagatta

SEQ ID NO: 44544 - DNA, 20 bp, Artificial Sequence
  chemically synthesized
gctgcatagattacagtatg

SEQ ID NO: 44545 - DNA, 20 bp, Artificial Sequence
  chemically synthesized
tagattacagtatgcagctc

SEQ ID NO: 44546 - DNA, 20 bp, Artificial Sequence
  chemically synthesized
atgcagctccagattcttcc

SEQ ID NO: 44547 - DNA, 20 bp, Artificial Sequence
  chemically synthesized
cagctccagattcttccaag

SEQ ID NO: 44548 - DNA, 20 bp, Artificial Sequence
  chemically synthesized
tgcctttctaaaatccaaac

SEQ ID NO: 44549 - DNA, 20 bp, Artificial Sequence
  chemically synthesized
ctaaaatccaaacaagttct

SEQ ID NO: 44550 - DNA, 20 bp, Artificial Sequence
  chemically synthesized
taaaatccaaacaagttctg

SEQ ID NO: 44551 - DNA, 20 bp, Artificial Sequence
  chemically synthesized
tctgaggttcaaaaccgttt

SEQ ID NO: 44552 - DNA, 20 bp, Artificial Sequence
  chemically synthesized
ttcaaaaccgttttggccct

SEQ ID NO: 44553 - DNA, 20 bp, Artificial Sequence
  chemically synthesized
tcaaaaccgttttggcccta

SEQ ID NO: 44554 - DNA, 20 bp, Artificial Sequence
  chemically synthesized
ccgttttggccctaaggctt

SEQ ID NO: 44555 - DNA, 20 bp, Artificial Sequence
  chemically synthesized
cgttttggccctaaggcttt

SEQ ID NO: 44556 - DNA, 20 bp, Artificial Sequence
  chemically synthesized
tggccctaaggctttgggta

SEQ ID NO: 44557 - DNA, 20 bp, Artificial Sequence
  chemically synthesized
ggccctaaggctttgggtaa

SEQ ID NO: 44558 - DNA, 20 bp, Artificial Sequence
  chemically synthesized
gccctaaggctttgggtaaa

SEQ ID NO: 44559 - DNA, 20 bp, Artificial Sequence
  chemically synthesized
ccctaaggctttgggtaaag

SEQ ID NO: 44560 - DNA, 20 bp, Artificial Sequence
  chemically synthesized
cctaaggctttgggtaaagg

SEQ ID NO: 44561 - DNA, 20 bp, Artificial Sequence
  chemically synthesized
aaggctttgggtaaaggggg

SEQ ID NO: 44562 - DNA, 20 bp, Artificial Sequence
  chemically synthesized
ggactctgttctactctgac

SEQ ID NO: 44563 - DNA, 20 bp, Artificial Sequence
  chemically synthesized
actctgttctactctgactg

SEQ ID NO: 44564 - DNA, 20 bp, Artificial Sequence
  chemically synthesized
ttctactctgactggagtcc

SEQ ID NO: 44565 - DNA, 20 bp, Artificial Sequence
  chemically synthesized
gagtccaagatgcatatata

SEQ ID NO: 44566 - DNA, 20 bp, Artificial Sequence
  chemically synthesized
gtccaagatgcatatataca

SEQ ID NO: 44567 - DNA, 20 bp, Artificial Sequence
  chemically synthesized
gatgcatatatacagagata

SEQ ID NO: 44568 - DNA, 20 bp, Artificial Sequence
  chemically synthesized
atgcatatatacagagatat

SEQ ID NO: 44569 - DNA, 20 bp, Artificial Sequence
  chemically synthesized
atatacagagatatgggtga

SEQ ID NO: 44570 - DNA, 20 bp, Artificial Sequence
  chemically synthesized
tatacagagatatgggtgat

SEQ ID NO: 44571 - DNA, 20 bp, Artificial Sequence
  chemically synthesized
atacagagatatgggtgatg

SEQ ID NO: 44572 - DNA, 20 bp, Artificial Sequence
  chemically synthesized
gatatgggtgatggggctgc

SEQ ID NO: 44573 - DNA, 20 bp, Artificial Sequence
  chemically synthesized
atatgggtgatggggctgca

SEQ ID NO: 44574 - DNA, 20 bp, Artificial Sequence
  chemically synthesized
tgggtgatggggctgcaagg

SEQ ID NO: 44575 - DNA, 20 bp, Artificial Sequence
  chemically synthesized
gggtgatggggctgcaaggt

SEQ ID NO: 44576 - DNA, 20 bp, Artificial Sequence
  chemically synthesized
atggggctgcaaggtaggtt

SEQ ID NO: 44577 - DNA, 20 bp, Artificial Sequence
  chemically synthesized
tggggctgcaaggtaggttg

SEQ ID NO: 44578 - DNA, 20 bp, Artificial Sequence
  chemically synthesized
ggctgcaaggtaggttgagg

SEQ ID NO: 44579 - DNA, 20 bp, Artificial Sequence
  chemically synthesized
gctgcaaggtaggttgaggt

SEQ ID NO: 44580 - DNA, 20 bp, Artificial Sequence
  chemically synthesized
ctgcaaggtaggttgaggta

SEQ ID NO: 44581 - DNA, 20 bp, Artificial Sequence
  chemically synthesized
tgcaaggtaggttgaggtag

SEQ ID NO: 44582 - DNA, 20 bp, Artificial Sequence
  chemically synthesized
ggtaggttgaggtaggggcc

SEQ ID NO: 44583 - DNA, 20 bp, Artificial Sequence
  chemically synthesized
gtaggttgaggtaggggcca

SEQ ID NO: 44584 - DNA, 20 bp, Artificial Sequence
  chemically synthesized
aggttgaggtaggggccaag

SEQ ID NO: 44585 - DNA, 20 bp, Artificial Sequence
  chemically synthesized
ggttgaggtaggggccaagg

SEQ ID NO: 44586 - DNA, 20 bp, Artificial Sequence
  chemically synthesized
ttgaggtaggggccaaggag

SEQ ID NO: 44587 - DNA, 20 bp, Artificial Sequence
  chemically synthesized
gtaggggccaaggaggagca

SEQ ID NO: 44588 - DNA, 20 bp, Artificial Sequence
  chemically synthesized
aggggccaaggaggagcatg

SEQ ID NO: 44589 - DNA, 20 bp, Artificial Sequence
  chemically synthesized
ccaaggaggagcatggagtt

SEQ ID NO: 44590 - DNA, 20 bp, Artificial Sequence
  chemically synthesized
ggagtttggacttgattcat

SEQ ID NO: 44591 - DNA, 20 bp, Artificial Sequence
  chemically synthesized
gagtttggacttgattcatg

SEQ ID NO: 44592 - DNA, 20 bp, Artificial Sequence
  chemically synthesized
ggacttgattcatgaggctg

SEQ ID NO: 44593 - DNA, 20 bp, Artificial Sequence
  chemically synthesized
gacttgattcatgaggctgt

SEQ ID NO: 44594 - DNA, 20 bp, Artificial Sequence
  chemically synthesized
acttgattcatgaggctgtg

SEQ ID NO: 44595 - DNA, 20 bp, Artificial Sequence
  chemically synthesized
ttgattcatgaggctgtggg

SEQ ID NO: 44596 - DNA, 20 bp, Artificial Sequence
  chemically synthesized
ttcatgaggctgtggggagc

SEQ ID NO: 44597 - DNA, 20 bp, Artificial Sequence
  chemically synthesized
gaggctgtggggagccagtg

SEQ ID NO: 44598 - DNA, 20 bp, Artificial Sequence
  chemically synthesized
aggctgtggggagccagtga

SEQ ID NO: 44599 - DNA, 20 bp, Artificial Sequence
  chemically synthesized
gggagccagtgaaggttctt

SEQ ID NO: 44600 - DNA, 20 bp, Artificial Sequence
  chemically synthesized
agccagtgaaggttcttaag

SEQ ID NO: 44601 - DNA, 20 bp, Artificial Sequence
  chemically synthesized
gccagtgaaggttcttaagc

SEQ ID NO: 44602 - DNA, 20 bp, Artificial Sequence
  chemically synthesized
ttaagcaggtatgtctgcct

SEQ ID NO: 44603 - DNA, 20 bp, Artificial Sequence
  chemically synthesized
aagcaggtatgtctgcctga

SEQ ID NO: 44604 - DNA, 20 bp, Artificial Sequence
  chemically synthesized
caggtatgtctgcctgagag

SEQ ID NO: 44605 - DNA, 20 bp, Artificial Sequence
  chemically synthesized
tatgtctgcctgagagcagt

SEQ ID NO: 44606 - DNA, 20 bp, Artificial Sequence
  chemically synthesized
tgtctgcctgagagcagttg

SEQ ID NO: 44607 - DNA, 20 bp, Artificial Sequence
  chemically synthesized
ctgcctgagagcagttggag

SEQ ID NO: 44608 - DNA, 20 bp, Artificial Sequence
  chemically synthesized
tgagagcagttggagcagac

SEQ ID NO: 44609 - DNA, 20 bp, Artificial Sequence
  chemically synthesized
agagcagttggagcagacaa

SEQ ID NO: 44610 - DNA, 20 bp, Artificial Sequence
  chemically synthesized
aaaaaccaaacaaatcacca

SEQ ID NO: 44611 - DNA, 20 bp, Artificial Sequence
  chemically synthesized
accaaacaaatcaccataga

SEQ ID NO: 44612 - DNA, 20 bp, Artificial Sequence
  chemically synthesized
aaacaaatcaccatagatag

SEQ ID NO: 44613 - DNA, 20 bp, Artificial Sequence
  chemically synthesized
tgtcccctccaaatctcatg

SEQ ID NO: 44614 - DNA, 20 bp, Artificial Sequence
  chemically synthesized
ccaaatctcatgtggaaatt

SEQ ID NO: 44615 - DNA, 20 bp, Artificial Sequence
  chemically synthesized
tcatgtggaaatttggtcct

SEQ ID NO: 44616 - DNA, 20 bp, Artificial Sequence
  chemically synthesized
ggaaatttggtcctcagtgt

SEQ ID NO: 44617 - DNA, 20 bp, Artificial Sequence
  chemically synthesized
aatttggtcctcagtgttgg

SEQ ID NO: 44618 - DNA, 20 bp, Artificial Sequence
  chemically synthesized
ttggtcctcagtgttggaag

SEQ ID NO: 44619 - DNA, 20 bp, Artificial Sequence
  chemically synthesized
tggtcctcagtgttggaagt

SEQ ID NO: 44620 - DNA, 20 bp, Artificial Sequence
  chemically synthesized
ggtcctcagtgttggaagtg

SEQ ID NO: 44621 - DNA, 20 bp, Artificial Sequence
  chemically synthesized
gtgttggaagtggggcctaa

SEQ ID NO: 44622 - DNA, 20 bp, Artificial Sequence
  chemically synthesized
tgttggaagtggggcctaat

SEQ ID NO: 44623 - DNA, 20 bp, Artificial Sequence
  chemically synthesized
ttggaagtggggcctaatgg

SEQ ID NO: 44624 - DNA, 20 bp, Artificial Sequence
  chemically synthesized
tggaagtggggcctaatggg

SEQ ID NO: 44625 - DNA, 20 bp, Artificial Sequence
  chemically synthesized
ggggcctaatgggaggtgtt

SEQ ID NO: 44626 - DNA, 20 bp, Artificial Sequence
  chemically synthesized
gggcctaatgggaggtgttt

SEQ ID NO: 44627 - DNA, 20 bp, Artificial Sequence
  chemically synthesized
aatgggaggtgtttgggtca

SEQ ID NO: 44628 - DNA, 20 bp, Artificial Sequence
  chemically synthesized
atgggaggtgtttgggtcat

SEQ ID NO: 44629 - DNA, 20 bp, Artificial Sequence
  chemically synthesized
tgggaggtgtttgggtcatg

SEQ ID NO: 44630 - DNA, 20 bp, Artificial Sequence
  chemically synthesized
gggaggtgtttgggtcatgg

SEQ ID NO: 44631 - DNA, 20 bp, Artificial Sequence
  chemically synthesized
gaggtgtttgggtcatgggg

SEQ ID NO: 44632 - DNA, 20 bp, Artificial Sequence
  chemically synthesized
aggtgtttgggtcatggggg

SEQ ID NO: 44633 - DNA, 20 bp, Artificial Sequence
  chemically synthesized
tgggggaggaacccctgtga

SEQ ID NO: 44634 - DNA, 20 bp, Artificial Sequence
  chemically synthesized
gggggaggaacccctgtgaa

SEQ ID NO: 44635 - DNA, 20 bp, Artificial Sequence
  chemically synthesized
aggaacccctgtgaaaggct

SEQ ID NO: 44636 - DNA, 20 bp, Artificial Sequence
  chemically synthesized
ggtgccgtccttgtgataat

SEQ ID NO: 44637 - DNA, 20 bp, Artificial Sequence
  chemically synthesized
ccgtccttgtgataatgagt

SEQ ID NO: 44638 - DNA, 20 bp, Artificial Sequence
  chemically synthesized
tcccgctatgatttcccttg

SEQ ID NO: 44639 - DNA, 20 bp, Artificial Sequence
  chemically synthesized
cccgctatgatttcccttga

SEQ ID NO: 44640 - DNA, 20 bp, Artificial Sequence
  chemically synthesized
cttgaaggctgattattaaa

SEQ ID NO: 44641 - DNA, 20 bp, Artificial Sequence
  chemically synthesized
tgaaggctgattattaaaaa

SEQ ID NO: 44642 - DNA, 20 bp, Artificial Sequence
  chemically synthesized
gctgattattaaaaagagct

SEQ ID NO: 44643 - DNA, 20 bp, Artificial Sequence
  chemically synthesized
gtgattgatctctgcacatg

SEQ ID NO: 44644 - DNA, 20 bp, Artificial Sequence
  chemically synthesized
tgattgatctctgcacatgt

SEQ ID NO: 44645 - DNA, 20 bp, Artificial Sequence
  chemically synthesized
tccccttcaccttctgccat

SEQ ID NO: 44646 - DNA, 20 bp, Artificial Sequence
  chemically synthesized
tcaccttctgccatcagtga

SEQ ID NO: 44647 - DNA, 20 bp, Artificial Sequence
  chemically synthesized
ccttctgccatcagtgaaag

SEQ ID NO: 44648 - DNA, 20 bp, Artificial Sequence
  chemically synthesized
gccatcagtgaaagcagctt

SEQ ID NO: 44649 - DNA, 20 bp, Artificial Sequence
  chemically synthesized
ccatcagtgaaagcagctta

SEQ ID NO: 44650 - DNA, 20 bp, Artificial Sequence
  chemically synthesized
aagcagcttaaggccctcac

SEQ ID NO: 44651 - DNA, 20 bp, Artificial Sequence
  chemically synthesized
cagcttaaggccctcaccag

SEQ ID NO: 44652 - DNA, 20 bp, Artificial Sequence
  chemically synthesized
cttaaggccctcaccagaag

SEQ ID NO: 44653 - DNA, 20 bp, Artificial Sequence
  chemically synthesized
ccctcaccagaagcagatgc

SEQ ID NO: 44654 - DNA, 20 bp, Artificial Sequence
  chemically synthesized
gatgctggtgccatgcttcc

SEQ ID NO: 44655 - DNA, 20 bp, Artificial Sequence
  chemically synthesized
tgctggtgccatgcttcctg

SEQ ID NO: 44656 - DNA, 20 bp, Artificial Sequence
  chemically synthesized
ctggtgccatgcttcctgga

SEQ ID NO: 44657 - DNA, 20 bp, Artificial Sequence
  chemically synthesized
catgcttcctggagagcttg

SEQ ID NO: 44658 - DNA, 20 bp, Artificial Sequence
  chemically synthesized
tggagagcttgcagaatcat

SEQ ID NO: 44659 - DNA, 20 bp, Artificial Sequence
  chemically synthesized
ccttgtaaattactcacctt

SEQ ID NO: 44660 - DNA, 20 bp, Artificial Sequence
  chemically synthesized
cttgtaaattactcaccttc

SEQ ID NO: 44661 - DNA, 20 bp, Artificial Sequence
  chemically synthesized
ccttcaggtattcctttata

SEQ ID NO: 44662 - DNA, 20 bp, Artificial Sequence
  chemically synthesized
tcctttatatagcaacacaa

SEQ ID NO: 44663 - DNA, 20 bp, Artificial Sequence
  chemically synthesized
cctttatatagcaacacaaa

SEQ ID NO: 44664 - DNA, 20 bp, Artificial Sequence
  chemically synthesized
tatagcaacacaaaaggact

SEQ ID NO: 44665 - DNA, 20 bp, Artificial Sequence
  chemically synthesized
gcaacacaaaaggactaaga

SEQ ID NO: 44666 - DNA, 20 bp, Artificial Sequence
  chemically synthesized
acacaaaaggactaagacag

SEQ ID NO: 44667 - DNA, 20 bp, Artificial Sequence
  chemically synthesized
cttgacttttctctctcttt

SEQ ID NO: 44668 - DNA, 20 bp, Artificial Sequence
  chemically synthesized
gacttttctctctctttaag

SEQ ID NO: 44669 - DNA, 20 bp, Artificial Sequence
  chemically synthesized
aagtgttgcctttgctcact

SEQ ID NO: 44670 - DNA, 20 bp, Artificial Sequence
  chemically synthesized
atcccttctgcctgcatttg

SEQ ID NO: 44671 - DNA, 20 bp, Artificial Sequence
  chemically synthesized
cccttctgcctgcatttgta

SEQ ID NO: 44672 - DNA, 20 bp, Artificial Sequence
  chemically synthesized
gcctgcatttgtagagcatc

SEQ ID NO: 44673 - DNA, 20 bp, Artificial Sequence
  chemically synthesized
gcatttgtagagcatctgga

SEQ ID NO: 44674 - DNA, 20 bp, Artificial Sequence
  chemically synthesized
catttgtagagcatctggat

SEQ ID NO: 44675 - DNA, 20 bp, Artificial Sequence
  chemically synthesized
tttgtagagcatctggatgg

SEQ ID NO: 44676 - DNA, 20 bp, Artificial Sequence
  chemically synthesized
accgtcactcttgactttcc

SEQ ID NO: 44677 - DNA, 20 bp, Artificial Sequence
  chemically synthesized
gtcactcttgactttcccag

SEQ ID NO: 44678 - DNA, 20 bp, Artificial Sequence
  chemically synthesized
tcactcttgactttcccagc

SEQ ID NO: 44679 - DNA, 20 bp, Artificial Sequence
  chemically synthesized
ttcccagcaggcctatgtca

SEQ ID NO: 44680 - DNA, 20 bp, Artificial Sequence
  chemically synthesized
tcccagcaggcctatgtcat

SEQ ID NO: 44681 - DNA, 20 bp, Artificial Sequence
  chemically synthesized
ggcctatgtcataggtactg

SEQ ID NO: 44682 - DNA, 20 bp, Artificial Sequence
  chemically synthesized
gtactgtggtctctacaata

SEQ ID NO: 44683 - DNA, 20 bp, Artificial Sequence
  chemically synthesized
ctgtggtctctacaatacag

SEQ ID NO: 44684 - DNA, 20 bp, Artificial Sequence
  chemically synthesized
gtggtctctacaatacagca

SEQ ID NO: 44685 - DNA, 20 bp, Artificial Sequence
  chemically synthesized
tggtctctacaatacagcag

SEQ ID NO: 44686 - DNA, 20 bp, Artificial Sequence
  chemically synthesized
acaatacagcagaggtatct

SEQ ID NO: 44687 - DNA, 20 bp, Artificial Sequence
  chemically synthesized
caatacagcagaggtatctg

SEQ ID NO: 44688 - DNA, 20 bp, Artificial Sequence
  chemically synthesized
gcagaggtatctgaggctcc

SEQ ID NO: 44689 - DNA, 20 bp, Artificial Sequence
  chemically synthesized
agaggtatctgaggctccga

SEQ ID NO: 44690 - DNA, 20 bp, Artificial Sequence
  chemically synthesized
gaggtatctgaggctccgag

SEQ ID NO: 44691 - DNA, 20 bp, Artificial Sequence
  chemically synthesized
atctgaggctccgagaggtt

SEQ ID NO: 44692 - DNA, 20 bp, Artificial Sequence
  chemically synthesized
gaggttgagtgacttgctca

SEQ ID NO: 44693 - DNA, 20 bp, Artificial Sequence
  chemically synthesized
cttgctcatggctgcacaac

SEQ ID NO: 44694 - DNA, 20 bp, Artificial Sequence
  chemically synthesized
gctgcacaaccagtaaatat

SEQ ID NO: 44695 - DNA, 20 bp, Artificial Sequence
  chemically synthesized
tgcacaaccagtaaatattg

SEQ ID NO: 44696 - DNA, 20 bp, Artificial Sequence
  chemically synthesized
caaccagtaaatattggagc

SEQ ID NO: 44697 - DNA, 20 bp, Artificial Sequence
  chemically synthesized
taaatattggagctggaatt

SEQ ID NO: 44698 - DNA, 20 bp, Artificial Sequence
  chemically synthesized
aaatattggagctggaattc

SEQ ID NO: 44699 - DNA, 20 bp, Artificial Sequence
  chemically synthesized
ggagctggaattcaggtcca

SEQ ID NO: 44700 - DNA, 20 bp, Artificial Sequence
  chemically synthesized
aattcaggtccacggtttcc

SEQ ID NO: 44701 - DNA, 20 bp, Artificial Sequence
  chemically synthesized
tccacggtttcctggctcca

SEQ ID NO: 44702 - DNA, 20 bp, Artificial Sequence
  chemically synthesized
ttccctcaatttattctgac

SEQ ID NO: 44703 - DNA, 20 bp, Artificial Sequence
  chemically synthesized
tccctcaatttattctgact

SEQ ID NO: 44704 - DNA, 20 bp, Artificial Sequence
  chemically synthesized
ccctcaatttattctgactg

SEQ ID NO: 44705 - DNA, 20 bp, Artificial Sequence
  chemically synthesized
aatttattctgactggggca

SEQ ID NO: 44706 - DNA, 20 bp, Artificial Sequence
  chemically synthesized
atttattctgactggggcat

SEQ ID NO: 44707 - DNA, 20 bp, Artificial Sequence
  chemically synthesized
tttattctgactggggcatg

SEQ ID NO: 44708 - DNA, 20 bp, Artificial Sequence
  chemically synthesized
ttattctgactggggcatgg

SEQ ID NO: 44709 - DNA, 20 bp, Artificial Sequence
  chemically synthesized
attctgactggggcatgggg

SEQ ID NO: 44710 - DNA, 20 bp, Artificial Sequence
  chemically synthesized
ttctgactggggcatggggg

SEQ ID NO: 44711 - DNA, 20 bp, Artificial Sequence
  chemically synthesized
tctgactggggcatggggga

SEQ ID NO: 44712 - DNA, 20 bp, Artificial Sequence
  chemically synthesized
ctgactggggcatgggggag

SEQ ID NO: 44713 - DNA, 20 bp, Artificial Sequence
  chemically synthesized
tgactggggcatgggggagg

SEQ ID NO: 44714 - DNA, 20 bp, Artificial Sequence
  chemically synthesized
ctggggcatgggggaggggg

SEQ ID NO: 44715 - DNA, 20 bp, Artificial Sequence
  chemically synthesized
atgggggagggggtggcctt

SEQ ID NO: 44716 - DNA, 20 bp, Artificial Sequence
  chemically synthesized
tgggggagggggtggccttt

SEQ ID NO: 44717 - DNA, 20 bp, Artificial Sequence
  chemically synthesized
gggagggggtggcctttggg

SEQ ID NO: 44718 - DNA, 20 bp, Artificial Sequence
  chemically synthesized
ggagggggtggcctttgggc

SEQ ID NO: 44719 - DNA, 20 bp, Artificial Sequence
  chemically synthesized
gagggggtggcctttgggca

SEQ ID NO: 44720 - DNA, 20 bp, Artificial Sequence
  chemically synthesized
tggcctttgggcagggccac

SEQ ID NO: 44721 - DNA, 20 bp, Artificial Sequence
  chemically synthesized
ggcctttgggcagggccacc

SEQ ID NO: 44722 - DNA, 20 bp, Artificial Sequence
  chemically synthesized
cctttgggcagggccaccag

SEQ ID NO: 44723 - DNA, 20 bp, Artificial Sequence
  chemically synthesized
gcagggccaccaggagcgac

SEQ ID NO: 44724 - DNA, 20 bp, Artificial Sequence
  chemically synthesized
cagggccaccaggagcgacc

SEQ ID NO: 44725 - DNA, 20 bp, Artificial Sequence
  chemically synthesized
accaggagcgaccaggcccg

SEQ ID NO: 44726 - DNA, 20 bp, Artificial Sequence
  chemically synthesized
caggagcgaccaggcccgta

SEQ ID NO: 44727 - DNA, 20 bp, Artificial Sequence
  chemically synthesized
ggagcgaccaggcccgtaga

SEQ ID NO: 44728 - DNA, 20 bp, Artificial Sequence
  chemically synthesized
cgaccaggcccgtagagagc

SEQ ID NO: 44729 - DNA, 20 bp, Artificial Sequence
  chemically synthesized
gaccaggcccgtagagagct

SEQ ID NO: 44730 - DNA, 20 bp, Artificial Sequence
  chemically synthesized
ggcccgtagagagctgggtg

SEQ ID NO: 44731 - DNA, 20 bp, Artificial Sequence
  chemically synthesized
gcccgtagagagctgggtgc

SEQ ID NO: 44732 - DNA, 20 bp, Artificial Sequence
  chemically synthesized
tagagagctgggtgcaggta

SEQ ID NO: 44733 - DNA, 20 bp, Artificial Sequence
  chemically synthesized
gagagctgggtgcaggtaca

SEQ ID NO: 44734 - DNA, 20 bp, Artificial Sequence
  chemically synthesized
agagctgggtgcaggtacag

SEQ ID NO: 44735 - DNA, 20 bp, Artificial Sequence
  chemically synthesized
acagaggaaaacctgttgtc

SEQ ID NO: 44736 - DNA, 20 bp, Artificial Sequence
  chemically synthesized
ggaaaacctgttgtcgagtg

SEQ ID NO: 44737 - DNA, 20 bp, Artificial Sequence
  chemically synthesized
ctgttgtcgagtgtggcccg

SEQ ID NO: 44738 - DNA, 20 bp, Artificial Sequence
  chemically synthesized
agttcccatttttgcctgaa

SEQ ID NO: 44739 - DNA, 20 bp, Artificial Sequence
  chemically synthesized
tgcctgaatggcacatttga

SEQ ID NO: 44740 - DNA, 20 bp, Artificial Sequence
  chemically synthesized
tataaccatgtgaataataa

SEQ ID NO: 44741 - DNA, 20 bp, Artificial Sequence
  chemically synthesized
accatgtgaataataatagt

SEQ ID NO: 44742 - DNA, 20 bp, Artificial Sequence
  chemically synthesized
taataatagttggcctatat

SEQ ID NO: 44743 - DNA, 20 bp, Artificial Sequence
  chemically synthesized
gagttctttaatttgctttt

SEQ ID NO: 44744 - DNA, 20 bp, Artificial Sequence
  chemically synthesized
tttgctttttggtccgcatt

SEQ ID NO: 44745 - DNA, 20 bp, Artificial Sequence
  chemically synthesized
tctcttttgttgtaatttgt

SEQ ID NO: 44746 - DNA, 20 bp, Artificial Sequence
  chemically synthesized
cttttgttgtaatttgtaag

SEQ ID NO: 44747 - DNA, 20 bp, Artificial Sequence
  chemically synthesized
ttttgttgtaatttgtaagt

SEQ ID NO: 44748 - DNA, 20 bp, Artificial Sequence
  chemically synthesized
tttgttgtaatttgtaagta

SEQ ID NO: 44749 - DNA, 20 bp, Artificial Sequence
  chemically synthesized
ttgttgtaatttgtaagtag

SEQ ID NO: 44750 - DNA, 20 bp, Artificial Sequence
  chemically synthesized
tgtaatttgtaagtaggggt

SEQ ID NO: 44751 - DNA, 20 bp, Artificial Sequence
  chemically synthesized
ttgtaagtaggggtgagata

SEQ ID NO: 44752 - DNA, 20 bp, Artificial Sequence
  chemically synthesized
ggggtgagataaagtacacc

SEQ ID NO: 44753 - DNA, 20 bp, Artificial Sequence
  chemically synthesized
gggtgagataaagtacacct

SEQ ID NO: 44754 - DNA, 20 bp, Artificial Sequence
  chemically synthesized
ggtgagataaagtacaccta

SEQ ID NO: 44755 - DNA, 20 bp, Artificial Sequence
  chemically synthesized
aaagtacacctagggtttgc

SEQ ID NO: 44756 - DNA, 20 bp, Artificial Sequence
  chemically synthesized
aagtacacctagggtttgct

SEQ ID NO: 44757 - DNA, 20 bp, Artificial Sequence
  chemically synthesized
tcatcatgttcctccttgca

SEQ ID NO: 44758 - DNA, 20 bp, Artificial Sequence
  chemically synthesized
catcatgttcctccttgcat

SEQ ID NO: 44759 - DNA, 20 bp, Artificial Sequence
  chemically synthesized
atcatgttcctccttgcatg

SEQ ID NO: 44760 - DNA, 20 bp, Artificial Sequence
  chemically synthesized
tgttcctccttgcatggggc

SEQ ID NO: 44761 - DNA, 20 bp, Artificial Sequence
  chemically synthesized
gttcctccttgcatggggcc

SEQ ID NO: 44762 - DNA, 20 bp, Artificial Sequence
  chemically synthesized
ttgcatggggccaggatccg

SEQ ID NO: 44763 - DNA, 20 bp, Artificial Sequence
  chemically synthesized
gcatggggccaggatccgtg

SEQ ID NO: 44764 - DNA, 20 bp, Artificial Sequence
  chemically synthesized
catggggccaggatccgtgg

SEQ ID NO: 44765 - DNA, 20 bp, Artificial Sequence
  chemically synthesized
caggatccgtggaggttgcc

SEQ ID NO: 44766 - DNA, 20 bp, Artificial Sequence
  chemically synthesized
gaggttgcctggcacctacg

SEQ ID NO: 44767 - DNA, 20 bp, Artificial Sequence
  chemically synthesized
gttgcctggcacctacgtgg

SEQ ID NO: 44768 - DNA, 20 bp, Artificial Sequence
  chemically synthesized
gcacctacgtggtggtgctg

SEQ ID NO: 44769 - DNA, 20 bp, Artificial Sequence
  chemically synthesized
cacctacgtggtggtgctga

SEQ ID NO: 44770 - DNA, 20 bp, Artificial Sequence
  chemically synthesized
cctacgtggtggtgctgaag

SEQ ID NO: 44771 - DNA, 20 bp, Artificial Sequence
  chemically synthesized
ctacgtggtggtgctgaagg

SEQ ID NO: 44772 - DNA, 20 bp, Artificial Sequence
  chemically synthesized
acgtggtggtgctgaaggag

SEQ ID NO: 44773 - DNA, 20 bp, Artificial Sequence
  chemically synthesized
aggaggagacccacctctcg

SEQ ID NO: 44774 - DNA, 20 bp, Artificial Sequence
  chemically synthesized
ggagacccacctctcgcagt

SEQ ID NO: 44775 - DNA, 20 bp, Artificial Sequence
  chemically synthesized
agacccacctctcgcagtca

SEQ ID NO: 44776 - DNA, 20 bp, Artificial Sequence
  chemically synthesized
agcgcactgcccgccgcctg

SEQ ID NO: 44777 - DNA, 20 bp, Artificial Sequence
  chemically synthesized
gcgcactgcccgccgcctgc

SEQ ID NO: 44778 - DNA, 20 bp, Artificial Sequence
  chemically synthesized
ctgcccgccgcctgcaggcc

SEQ ID NO: 44779 - DNA, 20 bp, Artificial Sequence
  chemically synthesized
tgcccgccgcctgcaggccc

SEQ ID NO: 44780 - DNA, 20 bp, Artificial Sequence
  chemically synthesized
tgcaggcccaggctgcccgc

SEQ ID NO: 44781 - DNA, 20 bp, Artificial Sequence
  chemically synthesized
gcaggcccaggctgcccgcc

SEQ ID NO: 44782 - DNA, 20 bp, Artificial Sequence
  chemically synthesized
caggcccaggctgcccgccg

SEQ ID NO: 44783 - DNA, 20 bp, Artificial Sequence
  chemically synthesized
cccgccggggatacctcacc

SEQ ID NO: 44784 - DNA, 20 bp, Artificial Sequence
  chemically synthesized
aagatcctgcatgtcttcca

SEQ ID NO: 44785 - DNA, 20 bp, Artificial Sequence
  chemically synthesized
gtcttccatggccttcttcc

SEQ ID NO: 44786 - DNA, 20 bp, Artificial Sequence
  chemically synthesized
tggccttcttcctggcttcc

SEQ ID NO: 44787 - DNA, 20 bp, Artificial Sequence
  chemically synthesized
ttcttcctggcttcctggtg

SEQ ID NO: 44788 - DNA, 20 bp, Artificial Sequence
  chemically synthesized
cctggcttcctggtgaagat

SEQ ID NO: 44789 - DNA, 20 bp, Artificial Sequence
  chemically synthesized
ggcttcctggtgaagatgag

SEQ ID NO: 44790 - DNA, 20 bp, Artificial Sequence
  chemically synthesized
gaagatgagtggcgacctgc

SEQ ID NO: 44791 - DNA, 20 bp, Artificial Sequence
  chemically synthesized
agatgagtggcgacctgctg

SEQ ID NO: 44792 - DNA, 20 bp, Artificial Sequence
  chemically synthesized
gagtggcgacctgctggagc

SEQ ID NO: 44793 - DNA, 20 bp, Artificial Sequence
  chemically synthesized
ggcgacctgctggagctggt

SEQ ID NO: 44794 - DNA, 20 bp, Artificial Sequence
  chemically synthesized
agctggtgagccaccctttt

SEQ ID NO: 44795 - DNA, 20 bp, Artificial Sequence
  chemically synthesized
gctggtgagccacccttttt

SEQ ID NO: 44796 - DNA, 20 bp, Artificial Sequence
  chemically synthesized
tgagccaccctttttgggaa

SEQ ID NO: 44797 - DNA, 20 bp, Artificial Sequence
  chemically synthesized
ttgggaatggcacttcctga

SEQ ID NO: 44798 - DNA, 20 bp, Artificial Sequence
  chemically synthesized
tgggaatggcacttcctgat

SEQ ID NO: 44799 - DNA, 20 bp, Artificial Sequence
  chemically synthesized
gggaatggcacttcctgata

SEQ ID NO: 44800 - DNA, 20 bp, Artificial Sequence
  chemically synthesized
atggcacttcctgatagggc

SEQ ID NO: 44801 - DNA, 20 bp, Artificial Sequence
  chemically synthesized
tggcacttcctgatagggct

SEQ ID NO: 44802 - DNA, 20 bp, Artificial Sequence
  chemically synthesized
ctgggccactgcatatacac

SEQ ID NO: 44803 - DNA, 20 bp, Artificial Sequence
  chemically synthesized
tgggccactgcatatacact

SEQ ID NO: 44804 - DNA, 20 bp, Artificial Sequence
  chemically synthesized
gggccactgcatatacactg

SEQ ID NO: 44805 - DNA, 20 bp, Artificial Sequence
  chemically synthesized
tatacactggggactgtgct

SEQ ID NO: 44806 - DNA, 20 bp, Artificial Sequence
  chemically synthesized
acactggggactgtgcttag

SEQ ID NO: 44807 - DNA, 20 bp, Artificial Sequence
  chemically synthesized
cactggggactgtgcttagt

SEQ ID NO: 44808 - DNA, 20 bp, Artificial Sequence
  chemically synthesized
gtaggcccattgctgaaaat

SEQ ID NO: 44809 - DNA, 20 bp, Artificial Sequence
  chemically synthesized
ggcccattgctgaaaatcag

SEQ ID NO: 44810 - DNA, 20 bp, Artificial Sequence
  chemically synthesized
gcccattgctgaaaatcaga

SEQ ID NO: 44811 - DNA, 20 bp, Artificial Sequence
  chemically synthesized
cccattgctgaaaatcagaa

SEQ ID NO: 44812 - DNA, 20 bp, Artificial Sequence
  chemically synthesized
ccattgctgaaaatcagaag

SEQ ID NO: 44813 - DNA, 20 bp, Artificial Sequence
  chemically synthesized
tgctgaaaatcagaagggga

SEQ ID NO: 44814 - DNA, 20 bp, Artificial Sequence
  chemically synthesized
gaaaatcagaaggggacagc

SEQ ID NO: 44815 - DNA, 20 bp, Artificial Sequence
  chemically synthesized
ggggacagcaagtatgtatt

SEQ ID NO: 44816 - DNA, 20 bp, Artificial Sequence
  chemically synthesized
agtatgtattgagcacttat

SEQ ID NO: 44817 - DNA, 20 bp, Artificial Sequence
  chemically synthesized
gtatgtattgagcacttatc

SEQ ID NO: 44818 - DNA, 20 bp, Artificial Sequence
  chemically synthesized
ttgagcacttatcgggtacc

SEQ ID NO: 44819 - DNA, 20 bp, Artificial Sequence
  chemically synthesized
cacttatcgggtaccaagca

SEQ ID NO: 44820 - DNA, 20 bp, Artificial Sequence
  chemically synthesized
gtaccaagcacagtaactac

SEQ ID NO: 44821 - DNA, 20 bp, Artificial Sequence
  chemically synthesized
gtaactactggctttctgta

SEQ ID NO: 44822 - DNA, 20 bp, Artificial Sequence
  chemically synthesized
ttctgtatagaattcccttt

SEQ ID NO: 44823 - DNA, 20 bp, Artificial Sequence
  chemically synthesized
tatagaattccctttaagcc

SEQ ID NO: 44824 - DNA, 20 bp, Artificial Sequence
  chemically synthesized
ctttaagcctggccatgccc

SEQ ID NO: 44825 - DNA, 20 bp, Artificial Sequence
  chemically synthesized
taagcctggccatgccccag

SEQ ID NO: 44826 - DNA, 20 bp, Artificial Sequence
  chemically synthesized
gtacgtctatcttcatttga

SEQ ID NO: 44827 - DNA, 20 bp, Artificial Sequence
  chemically synthesized
tctatcttcatttgaaagac

SEQ ID NO: 44828 - DNA, 20 bp, Artificial Sequence
  chemically synthesized
ctatcttcatttgaaagacg

SEQ ID NO: 44829 - DNA, 20 bp, Artificial Sequence
  chemically synthesized
atcttcatttgaaagacgag

SEQ ID NO: 44830 - DNA, 20 bp, Artificial Sequence
  chemically synthesized
tttgaaagacgaggagactg

SEQ ID NO: 44831 - DNA, 20 bp, Artificial Sequence
  chemically synthesized
aagacgaggagactgaagtt

SEQ ID NO: 44832 - DNA, 20 bp, Artificial Sequence
  chemically synthesized
gacgaggagactgaagttca

SEQ ID NO: 44833 - DNA, 20 bp, Artificial Sequence
  chemically synthesized
acgaggagactgaagttcag

SEQ ID NO: 44834 - DNA, 20 bp, Artificial Sequence
  chemically synthesized
cgaggagactgaagttcaga

SEQ ID NO: 44835 - DNA, 20 bp, Artificial Sequence
  chemically synthesized
gaggagactgaagttcagag

SEQ ID NO: 44836 - DNA, 20 bp, Artificial Sequence
  chemically synthesized
gaagttcagaggggaccaca

SEQ ID NO: 44837 - DNA, 20 bp, Artificial Sequence
  chemically synthesized
ttcagaggggaccacacaga

SEQ ID NO: 44838 - DNA, 20 bp, Artificial Sequence
  chemically synthesized
gaggggaccacacagacagc

SEQ ID NO: 44839 - DNA, 20 bp, Artificial Sequence
  chemically synthesized
aggggaccacacagacagct

SEQ ID NO: 44840 - DNA, 20 bp, Artificial Sequence
  chemically synthesized
ggggaccacacagacagcta

SEQ ID NO: 44841 - DNA, 20 bp, Artificial Sequence
  chemically synthesized
gggaccacacagacagctag

SEQ ID NO: 44842 - DNA, 20 bp, Artificial Sequence
  chemically synthesized
accacacagacagctagggg

SEQ ID NO: 44843 - DNA, 20 bp, Artificial Sequence
  chemically synthesized
cacacagacagctaggggta

SEQ ID NO: 44844 - DNA, 20 bp, Artificial Sequence
  chemically synthesized
agacagctaggggtagagcc

SEQ ID NO: 44845 - DNA, 20 bp, Artificial Sequence
  chemically synthesized
agagcctggatcaaacccat

SEQ ID NO: 44846 - DNA, 20 bp, Artificial Sequence
  chemically synthesized
aaacccattggtctgcctgc

SEQ ID NO: 44847 - DNA, 20 bp, Artificial Sequence
  chemically synthesized
gccaatgcatctgctgccta

SEQ ID NO: 44848 - DNA, 20 bp, Artificial Sequence
  chemically synthesized
ctgctgcctacggaaacctg

SEQ ID NO: 44849 - DNA, 20 bp, Artificial Sequence
  chemically synthesized
tgctgcctacggaaacctgt

SEQ ID NO: 44850 - DNA, 20 bp, Artificial Sequence
  chemically synthesized
gctgcctacggaaacctgta

SEQ ID NO: 44851 - DNA, 20 bp, Artificial Sequence
  chemically synthesized
ctacggaaacctgtagggac

SEQ ID NO: 44852 - DNA, 20 bp, Artificial Sequence
  chemically synthesized
tacggaaacctgtagggaca

SEQ ID NO: 44853 - DNA, 20 bp, Artificial Sequence
  chemically synthesized
aacctgtagggacaaggccc

SEQ ID NO: 44854 - DNA, 20 bp, Artificial Sequence
  chemically synthesized
acctgtagggacaaggccct

SEQ ID NO: 44855 - DNA, 20 bp, Artificial Sequence
  chemically synthesized
ggacaaggccctgggatgtt

SEQ ID NO: 44856 - DNA, 20 bp, Artificial Sequence
  chemically synthesized
caaggccctgggatgttcag

SEQ ID NO: 44857 - DNA, 20 bp, Artificial Sequence
  chemically synthesized
aggccctgggatgttcagtg

SEQ ID NO: 44858 - DNA, 20 bp, Artificial Sequence
  chemically synthesized
tgggatgttcagtggagcct

SEQ ID NO: 44859 - DNA, 20 bp, Artificial Sequence
  chemically synthesized
gcctgagtcattttataaaa

SEQ ID NO: 44860 - DNA, 20 bp, Artificial Sequence
  chemically synthesized
tttataaaaaagcatgactc

SEQ ID NO: 44861 - DNA, 20 bp, Artificial Sequence
  chemically synthesized
ttataaaaaagcatgactct

SEQ ID NO: 44862 - DNA, 20 bp, Artificial Sequence
  chemically synthesized
tataaaaaagcatgactcta

SEQ ID NO: 44863 - DNA, 20 bp, Artificial Sequence
  chemically synthesized
tagggtccaaaattcctttg

SEQ ID NO: 44864 - DNA, 20 bp, Artificial Sequence
  chemically synthesized
cctttgaagctgttgctatc

SEQ ID NO: 44865 - DNA, 20 bp, Artificial Sequence
  chemically synthesized
tttgaagctgttgctatcca

SEQ ID NO: 44866 - DNA, 20 bp, Artificial Sequence
  chemically synthesized
agctgttgctatccagagtg

SEQ ID NO: 44867 - DNA, 20 bp, Artificial Sequence
  chemically synthesized
ccagagtgaagtcccttctt

SEQ ID NO: 44868 - DNA, 20 bp, Artificial Sequence
  chemically synthesized
cagagtgaagtcccttcttt

SEQ ID NO: 44869 - DNA, 20 bp, Artificial Sequence
  chemically synthesized
gtgaagtcccttctttagga

SEQ ID NO: 44870 - DNA, 20 bp, Artificial Sequence
  chemically synthesized
tgaagtcccttctttaggac

SEQ ID NO: 44871 - DNA, 20 bp, Artificial Sequence
  chemically synthesized
gaagtcccttctttaggaca

SEQ ID NO: 44872 - DNA, 20 bp, Artificial Sequence
  chemically synthesized
gtcccttctttaggacaggg

SEQ ID NO: 44873 - DNA, 20 bp, Artificial Sequence
  chemically synthesized
agggtggccctcctccctcc

SEQ ID NO: 44874 - DNA, 20 bp, Artificial Sequence
  chemically synthesized
cctcctggatgtcacatctt

SEQ ID NO: 44875 - DNA, 20 bp, Artificial Sequence
  chemically synthesized
cctggatgtcacatcttcgg

SEQ ID NO: 44876 - DNA, 20 bp, Artificial Sequence
  chemically synthesized
tggatgtcacatcttcggtg

SEQ ID NO: 44877 - DNA, 20 bp, Artificial Sequence
  chemically synthesized
ggatgtcacatcttcggtgg

SEQ ID NO: 44878 - DNA, 20 bp, Artificial Sequence
  chemically synthesized
gatgtcacatcttcggtgga

SEQ ID NO: 44879 - DNA, 20 bp, Artificial Sequence
  chemically synthesized
atgtcacatcttcggtggag

SEQ ID NO: 44880 - DNA, 20 bp, Artificial Sequence
  chemically synthesized
tcacatcttcggtggagggg

SEQ ID NO: 44881 - DNA, 20 bp, Artificial Sequence
  chemically synthesized
atcttcggtggaggggcaga

SEQ ID NO: 44882 - DNA, 20 bp, Artificial Sequence
  chemically synthesized
tcttcggtggaggggcagaa

SEQ ID NO: 44883 - DNA, 20 bp, Artificial Sequence
  chemically synthesized
cttcggtggaggggcagaaa

SEQ ID NO: 44884 - DNA, 20 bp, Artificial Sequence
  chemically synthesized
ttcggtggaggggcagaaag

SEQ ID NO: 44885 - DNA, 20 bp, Artificial Sequence
  chemically synthesized
tggaggggcagaaaggggac

SEQ ID NO: 44886 - DNA, 20 bp, Artificial Sequence
  chemically synthesized
ggaggggcagaaaggggact

SEQ ID NO: 44887 - DNA, 20 bp, Artificial Sequence
  chemically synthesized
actgggtattctcctcaccc

SEQ ID NO: 44888 - DNA, 20 bp, Artificial Sequence
  chemically synthesized
tattctcctcaccctggccc

SEQ ID NO: 44889 - DNA, 20 bp, Artificial Sequence
  chemically synthesized
tgtgcttctgcaccaccttc

SEQ ID NO: 44890 - DNA, 20 bp, Artificial Sequence
  chemically synthesized
acaaataaaaacgttttttt

SEQ ID NO: 44891 - DNA, 20 bp, Artificial Sequence
  chemically synthesized
aaacgtttttttaagatttg

SEQ ID NO: 44892 - DNA, 20 bp, Artificial Sequence
  chemically synthesized
ttttttaagatttgaagcac

SEQ ID NO: 44893 - DNA, 20 bp, Artificial Sequence
  chemically synthesized
tttttaagatttgaagcact

SEQ ID NO: 44894 - DNA, 20 bp, Artificial Sequence
  chemically synthesized
ttttaagatttgaagcacta

SEQ ID NO: 44895 - DNA, 20 bp, Artificial Sequence
  chemically synthesized
aagatttgaagcactagggc

SEQ ID NO: 44896 - DNA, 20 bp, Artificial Sequence
  chemically synthesized
agatttgaagcactagggcc

SEQ ID NO: 44897 - DNA, 20 bp, Artificial Sequence
  chemically synthesized
gatttgaagcactagggcca

SEQ ID NO: 44898 - DNA, 20 bp, Artificial Sequence
  chemically synthesized
tgaagcactagggccagggt

SEQ ID NO: 44899 - DNA, 20 bp, Artificial Sequence
  chemically synthesized
gaagcactagggccagggtg

SEQ ID NO: 44900 - DNA, 20 bp, Artificial Sequence
  chemically synthesized
agcactagggccagggtgag

SEQ ID NO: 44901 - DNA, 20 bp, Artificial Sequence
  chemically synthesized
gccagggtgaggagaatacc

SEQ ID NO: 44902 - DNA, 20 bp, Artificial Sequence
  chemically synthesized
ccctttctgcccctccaccg

SEQ ID NO: 44903 - DNA, 20 bp, Artificial Sequence
  chemically synthesized
tccaccgaagatgtgacatc

SEQ ID NO: 44904 - DNA, 20 bp, Artificial Sequence
  chemically synthesized
ccaccgaagatgtgacatcc

SEQ ID NO: 44905 - DNA, 20 bp, Artificial Sequence
  chemically synthesized
accgaagatgtgacatccag

SEQ ID NO: 44906 - DNA, 20 bp, Artificial Sequence
  chemically synthesized
ccgaagatgtgacatccagg

SEQ ID NO: 44907 - DNA, 20 bp, Artificial Sequence
  chemically synthesized
cgaagatgtgacatccagga

SEQ ID NO: 44908 - DNA, 20 bp, Artificial Sequence
  chemically synthesized
aagatgtgacatccaggagg

SEQ ID NO: 44909 - DNA, 20 bp, Artificial Sequence
  chemically synthesized
agatgtgacatccaggaggg

SEQ ID NO: 44910 - DNA, 20 bp, Artificial Sequence
  chemically synthesized
atgtgacatccaggagggag

SEQ ID NO: 44911 - DNA, 20 bp, Artificial Sequence
  chemically synthesized
tgtgacatccaggagggagg

SEQ ID NO: 44912 - DNA, 20 bp, Artificial Sequence
  chemically synthesized
gtgacatccaggagggagga

SEQ ID NO: 44913 - DNA, 20 bp, Artificial Sequence
  chemically synthesized
aggagggccaccctgtccta

SEQ ID NO: 44914 - DNA, 20 bp, Artificial Sequence
  chemically synthesized
agggccaccctgtcctaaag

SEQ ID NO: 44915 - DNA, 20 bp, Artificial Sequence
  chemically synthesized
gggccaccctgtcctaaaga

SEQ ID NO: 44916 - DNA, 20 bp, Artificial Sequence
  chemically synthesized
ggccaccctgtcctaaagaa

SEQ ID NO: 44917 - DNA, 20 bp, Artificial Sequence
  chemically synthesized
ctaaagaagggacttcactc

SEQ ID NO: 44918 - DNA, 20 bp, Artificial Sequence
  chemically synthesized
agaagggacttcactctgga

SEQ ID NO: 44919 - DNA, 20 bp, Artificial Sequence
  chemically synthesized
gacttcactctggatagcaa

SEQ ID NO: 44920 - DNA, 20 bp, Artificial Sequence
  chemically synthesized
tctggatagcaacagcttca

SEQ ID NO: 44921 - DNA, 20 bp, Artificial Sequence
  chemically synthesized
ctggatagcaacagcttcaa

SEQ ID NO: 44922 - DNA, 20 bp, Artificial Sequence
  chemically synthesized
caacagcttcaaaggaattt

SEQ ID NO: 44923 - DNA, 20 bp, Artificial Sequence
  chemically synthesized
ttcaaaggaattttggaccc

SEQ ID NO: 44924 - DNA, 20 bp, Artificial Sequence
  chemically synthesized
caaaggaattttggacccta

SEQ ID NO: 44925 - DNA, 20 bp, Artificial Sequence
  chemically synthesized
tgcttttttataaaatgact

SEQ ID NO: 44926 - DNA, 20 bp, Artificial Sequence
  chemically synthesized
gcttttttataaaatgactc

SEQ ID NO: 44927 - DNA, 20 bp, Artificial Sequence
  chemically synthesized
tcaggctccactgaacatcc

SEQ ID NO: 44928 - DNA, 20 bp, Artificial Sequence
  chemically synthesized
caggctccactgaacatccc

SEQ ID NO: 44929 - DNA, 20 bp, Artificial Sequence
  chemically synthesized
aggctccactgaacatccca

SEQ ID NO: 44930 - DNA, 20 bp, Artificial Sequence
  chemically synthesized
atcccagggccttgtcccta

SEQ ID NO: 44931 - DNA, 20 bp, Artificial Sequence
  chemically synthesized
tcccagggccttgtccctac

SEQ ID NO: 44932 - DNA, 20 bp, Artificial Sequence
  chemically synthesized
cttgtccctacaggtttccg

SEQ ID NO: 44933 - DNA, 20 bp, Artificial Sequence
  chemically synthesized
ttgtccctacaggtttccgt

SEQ ID NO: 44934 - DNA, 20 bp, Artificial Sequence
  chemically synthesized
tccctacaggtttccgtagg

SEQ ID NO: 44935 - DNA, 20 bp, Artificial Sequence
  chemically synthesized
ctacaggtttccgtaggcag

SEQ ID NO: 44936 - DNA, 20 bp, Artificial Sequence
  chemically synthesized
tccgtaggcagcagatgcat

SEQ ID NO: 44937 - DNA, 20 bp, Artificial Sequence
  chemically synthesized
ggcagcagatgcattggcac

SEQ ID NO: 44938 - DNA, 20 bp, Artificial Sequence
  chemically synthesized
cagatgcattggcacaagaa

SEQ ID NO: 44939 - DNA, 20 bp, Artificial Sequence
  chemically synthesized
tgcattggcacaagaatggc

SEQ ID NO: 44940 - DNA, 20 bp, Artificial Sequence
  chemically synthesized
attggcacaagaatggctgg

SEQ ID NO: 44941 - DNA, 20 bp, Artificial Sequence
  chemically synthesized
ttggcacaagaatggctggc

SEQ ID NO: 44942 - DNA, 20 bp, Artificial Sequence
  chemically synthesized
gcacaagaatggctggcagg

SEQ ID NO: 44943 - DNA, 20 bp, Artificial Sequence
  chemically synthesized
atggctggcaggcagaccaa

SEQ ID NO: 44944 - DNA, 20 bp, Artificial Sequence
  chemically synthesized
tggctggcaggcagaccaat

SEQ ID NO: 44945 - DNA, 20 bp, Artificial Sequence
  chemically synthesized
gcagaccaatgggtttgatc

SEQ ID NO: 44946 - DNA, 20 bp, Artificial Sequence
  chemically synthesized
cagaccaatgggtttgatcc

SEQ ID NO: 44947 - DNA, 20 bp, Artificial Sequence
  chemically synthesized
tttgatccaggctctacccc

SEQ ID NO: 44948 - DNA, 20 bp, Artificial Sequence
  chemically synthesized
tctacccctagctgtctgtg

SEQ ID NO: 44949 - DNA, 20 bp, Artificial Sequence
  chemically synthesized
gtgtggtcccctctgaactt

SEQ ID NO: 44950 - DNA, 20 bp, Artificial Sequence
  chemically synthesized
gtctcctcgtctttcaaatg

SEQ ID NO: 44951 - DNA, 20 bp, Artificial Sequence
  chemically synthesized
cctcgtctttcaaatgaaga

SEQ ID NO: 44952 - DNA, 20 bp, Artificial Sequence
  chemically synthesized
aatgaagatagacgtaccac

SEQ ID NO: 44953 - DNA, 20 bp, Artificial Sequence
  chemically synthesized
atgaagatagacgtaccact

SEQ ID NO: 44954 - DNA, 20 bp, Artificial Sequence
  chemically synthesized
tgaagatagacgtaccactg

SEQ ID NO: 44955 - DNA, 20 bp, Artificial Sequence
  chemically synthesized
atagacgtaccactggggca

SEQ ID NO: 44956 - DNA, 20 bp, Artificial Sequence
  chemically synthesized
acgtaccactggggcatggc

SEQ ID NO: 44957 - DNA, 20 bp, Artificial Sequence
  chemically synthesized
cgtaccactggggcatggcc

SEQ ID NO: 44958 - DNA, 20 bp, Artificial Sequence
  chemically synthesized
ctggggcatggccaggctta

SEQ ID NO: 44959 - DNA, 20 bp, Artificial Sequence
  chemically synthesized
tggggcatggccaggcttaa

SEQ ID NO: 44960 - DNA, 20 bp, Artificial Sequence
  chemically synthesized
ggggcatggccaggcttaaa

SEQ ID NO: 44961 - DNA, 20 bp, Artificial Sequence
  chemically synthesized
ggcttaaagggaattctata

SEQ ID NO: 44962 - DNA, 20 bp, Artificial Sequence
  chemically synthesized
taaagggaattctatacaga

SEQ ID NO: 44963 - DNA, 20 bp, Artificial Sequence
  chemically synthesized
gggaattctatacagaaagc

SEQ ID NO: 44964 - DNA, 20 bp, Artificial Sequence
  chemically synthesized
aattctatacagaaagccag

SEQ ID NO: 44965 - DNA, 20 bp, Artificial Sequence
  chemically synthesized
aagccagtagttactgtgct

SEQ ID NO: 44966 - DNA, 20 bp, Artificial Sequence
  chemically synthesized
tactgtgcttggtacccgat

SEQ ID NO: 44967 - DNA, 20 bp, Artificial Sequence
  chemically synthesized
tgctgtccccttctgatttt

SEQ ID NO: 44968 - DNA, 20 bp, Artificial Sequence
  chemically synthesized
ccccttctgattttcagcaa

SEQ ID NO: 44969 - DNA, 20 bp, Artificial Sequence
  chemically synthesized
cccttctgattttcagcaat

SEQ ID NO: 44970 - DNA, 20 bp, Artificial Sequence
  chemically synthesized
ttttcagcaatgggcctact

SEQ ID NO: 44971 - DNA, 20 bp, Artificial Sequence
  chemically synthesized
agcaatgggcctactaagca

SEQ ID NO: 44972 - DNA, 20 bp, Artificial Sequence
  chemically synthesized
ggcctactaagcacagtccc

SEQ ID NO: 44973 - DNA, 20 bp, Artificial Sequence
  chemically synthesized
cacagtccccagtgtatatg

SEQ ID NO: 44974 - DNA, 20 bp, Artificial Sequence
  chemically synthesized
agtccccagtgtatatgcag

SEQ ID NO: 44975 - DNA, 20 bp, Artificial Sequence
  chemically synthesized
ccagtgtatatgcagtggcc

SEQ ID NO: 44976 - DNA, 20 bp, Artificial Sequence
  chemically synthesized
atgcagtggcccagccctat

SEQ ID NO: 44977 - DNA, 20 bp, Artificial Sequence
  chemically synthesized
tgcagtggcccagccctatc

SEQ ID NO: 44978 - DNA, 20 bp, Artificial Sequence
  chemically synthesized
agtggcccagccctatcagg

SEQ ID NO: 44979 - DNA, 20 bp, Artificial Sequence
  chemically synthesized
caggaagtgccattcccaaa

SEQ ID NO: 44980 - DNA, 20 bp, Artificial Sequence
  chemically synthesized
aggaagtgccattcccaaaa

SEQ ID NO: 44981 - DNA, 20 bp, Artificial Sequence
  chemically synthesized
ggaagtgccattcccaaaaa

SEQ ID NO: 44982 - DNA, 20 bp, Artificial Sequence
  chemically synthesized
agtgccattcccaaaaaggg

SEQ ID NO: 44983 - DNA, 20 bp, Artificial Sequence
  chemically synthesized
tcccaaaaagggtggctcac

SEQ ID NO: 44984 - DNA, 20 bp, Artificial Sequence
  chemically synthesized
aaagggtggctcaccagctc

SEQ ID NO: 44985 - DNA, 20 bp, Artificial Sequence
  chemically synthesized
gggtggctcaccagctccag

SEQ ID NO: 44986 - DNA, 20 bp, Artificial Sequence
  chemically synthesized
ggtggctcaccagctccagc

SEQ ID NO: 44987 - DNA, 20 bp, Artificial Sequence
  chemically synthesized
aggtcgccactcatcttcac

SEQ ID NO: 44988 - DNA, 20 bp, Artificial Sequence
  chemically synthesized
ggtcgccactcatcttcacc

SEQ ID NO: 44989 - DNA, 20 bp, Artificial Sequence
  chemically synthesized
cgccactcatcttcaccagg

SEQ ID NO: 44990 - DNA, 20 bp, Artificial Sequence
  chemically synthesized
actcatcttcaccaggaagc

SEQ ID NO: 44991 - DNA, 20 bp, Artificial Sequence
  chemically synthesized
ctcatcttcaccaggaagcc

SEQ ID NO: 44992 - DNA, 20 bp, Artificial Sequence
  chemically synthesized
atcttcaccaggaagccagg

SEQ ID NO: 44993 - DNA, 20 bp, Artificial Sequence
  chemically synthesized
ttcaccaggaagccaggaag

SEQ ID NO: 44994 - DNA, 20 bp, Artificial Sequence
  chemically synthesized
tcaccaggaagccaggaaga

SEQ ID NO: 44995 - DNA, 20 bp, Artificial Sequence
  chemically synthesized
ggaagccaggaagaaggcca

SEQ ID NO: 44996 - DNA, 20 bp, Artificial Sequence
  chemically synthesized
agccaggaagaaggccatgg

SEQ ID NO: 44997 - DNA, 20 bp, Artificial Sequence
  chemically synthesized
agaaggccatggaagacatg

SEQ ID NO: 44998 - DNA, 20 bp, Artificial Sequence
  chemically synthesized
gaaggccatggaagacatgc

SEQ ID NO: 44999 - DNA, 20 bp, Artificial Sequence
  chemically synthesized
atggaagacatgcaggatct

SEQ ID NO: 45000 - DNA, 20 bp, Artificial Sequence
  chemically synthesized
aagacatgcaggatcttggt

SEQ ID NO: 45001 - DNA, 20 bp, Artificial Sequence
  chemically synthesized
agacatgcaggatcttggtg

SEQ ID NO: 45002 - DNA, 20 bp, Artificial Sequence
  chemically synthesized
ggatcttggtgaggtatccc

SEQ ID NO: 45003 - DNA, 20 bp, Artificial Sequence
  chemically synthesized
tcttggtgaggtatccccgg

SEQ ID NO: 45004 - DNA, 20 bp, Artificial Sequence
  chemically synthesized
cttggtgaggtatccccggc

SEQ ID NO: 45005 - DNA, 20 bp, Artificial Sequence
  chemically synthesized
ggtgaggtatccccggcggg

SEQ ID NO: 45006 - DNA, 20 bp, Artificial Sequence
  chemically synthesized
ggtatccccggcgggcagcc

SEQ ID NO: 45007 - DNA, 20 bp, Artificial Sequence
  chemically synthesized
gtatccccggcgggcagcct

SEQ ID NO: 45008 - DNA, 20 bp, Artificial Sequence
  chemically synthesized
cggcgggcagcctgggcctg

SEQ ID NO: 45009 - DNA, 20 bp, Artificial Sequence
  chemically synthesized
ggcgggcagcctgggcctgc

SEQ ID NO: 45010 - DNA, 20 bp, Artificial Sequence
  chemically synthesized
gggcagcctgggcctgcagg

SEQ ID NO: 45011 - DNA, 20 bp, Artificial Sequence
  chemically synthesized
cagcctgggcctgcaggcgg

SEQ ID NO: 45012 - DNA, 20 bp, Artificial Sequence
  chemically synthesized
agcctgggcctgcaggcggc

SEQ ID NO: 45013 - DNA, 20 bp, Artificial Sequence
  chemically synthesized
ctgggcctgcaggcggcggg

SEQ ID NO: 45014 - DNA, 20 bp, Artificial Sequence
  chemically synthesized
gggcagtgcgctctgactgc

SEQ ID NO: 45015 - DNA, 20 bp, Artificial Sequence
  chemically synthesized
gcagtgcgctctgactgcga

SEQ ID NO: 45016 - DNA, 20 bp, Artificial Sequence
  chemically synthesized
cagtgcgctctgactgcgag

SEQ ID NO: 45017 - DNA, 20 bp, Artificial Sequence
  chemically synthesized
tgcgctctgactgcgagagg

SEQ ID NO: 45018 - DNA, 20 bp, Artificial Sequence
  chemically synthesized
gcgctctgactgcgagaggt

SEQ ID NO: 45019 - DNA, 20 bp, Artificial Sequence
  chemically synthesized
gagaggtgggtctcctcctt

SEQ ID NO: 45020 - DNA, 20 bp, Artificial Sequence
  chemically synthesized
cctccttcagcaccaccacg

SEQ ID NO: 45021 - DNA, 20 bp, Artificial Sequence
  chemically synthesized
ctccttcagcaccaccacgt

SEQ ID NO: 45022 - DNA, 20 bp, Artificial Sequence
  chemically synthesized
cagcaccaccacgtaggtgc

SEQ ID NO: 45023 - DNA, 20 bp, Artificial Sequence
  chemically synthesized
agcaccaccacgtaggtgcc

SEQ ID NO: 45024 - DNA, 20 bp, Artificial Sequence
  chemically synthesized
taggtgccaggcaacctcca

SEQ ID NO: 45025 - DNA, 20 bp, Artificial Sequence
  chemically synthesized
caggcaacctccacggatcc

SEQ ID NO: 45026 - DNA, 20 bp, Artificial Sequence
  chemically synthesized
cacggatcctggccccatgc

SEQ ID NO: 45027 - DNA, 20 bp, Artificial Sequence
  chemically synthesized
acggatcctggccccatgca

SEQ ID NO: 45028 - DNA, 20 bp, Artificial Sequence
  chemically synthesized
ggatcctggccccatgcaag

SEQ ID NO: 45029 - DNA, 20 bp, Artificial Sequence
  chemically synthesized
gatcctggccccatgcaagg

SEQ ID NO: 45030 - DNA, 20 bp, Artificial Sequence
  chemically synthesized
caaggaggaacatgatgaca

SEQ ID NO: 45031 - DNA, 20 bp, Artificial Sequence
  chemically synthesized
ggaggaacatgatgacatgg

SEQ ID NO: 45032 - DNA, 20 bp, Artificial Sequence
  chemically synthesized
atgatgacatggaagaaacc

SEQ ID NO: 45033 - DNA, 20 bp, Artificial Sequence
  chemically synthesized
ggaagaaacccagcaaaccc

SEQ ID NO: 45034 - DNA, 20 bp, Artificial Sequence
  chemically synthesized
gaagaaacccagcaaaccct

SEQ ID NO: 45035 - DNA, 20 bp, Artificial Sequence
  chemically synthesized
ctacttacaaattacaacaa

SEQ ID NO: 45036 - DNA, 20 bp, Artificial Sequence
  chemically synthesized
acttacaaattacaacaaaa

SEQ ID NO: 45037 - DNA, 20 bp, Artificial Sequence
  chemically synthesized
ttacaacaaaagagacacaa

SEQ ID NO: 45038 - DNA, 20 bp, Artificial Sequence
  chemically synthesized
acaacaaaagagacacaaca

SEQ ID NO: 45039 - DNA, 20 bp, Artificial Sequence
  chemically synthesized
aaaagagacacaacagagta

SEQ ID NO: 45040 - DNA, 20 bp, Artificial Sequence
  chemically synthesized
agagacacaacagagtatag

SEQ ID NO: 45041 - DNA, 20 bp, Artificial Sequence
  chemically synthesized
acagagtatagtagatgata

SEQ ID NO: 45042 - DNA, 20 bp, Artificial Sequence
  chemically synthesized
gagtatagtagatgataaag

SEQ ID NO: 45043 - DNA, 20 bp, Artificial Sequence
  chemically synthesized
gataaagaagttaccaaatg

SEQ ID NO: 45044 - DNA, 20 bp, Artificial Sequence
  chemically synthesized
gttaccaaatgcggaccaaa

SEQ ID NO: 45045 - DNA, 20 bp, Artificial Sequence
  chemically synthesized
gcggaccaaaaagcaaatta

SEQ ID NO: 45046 - DNA, 20 bp, Artificial Sequence
  chemically synthesized
agcaaattaaagaactcata

SEQ ID NO: 45047 - DNA, 20 bp, Artificial Sequence
  chemically synthesized
gcaaattaaagaactcatat

SEQ ID NO: 45048 - DNA, 20 bp, Artificial Sequence
  chemically synthesized
gccaactattattattcaca

SEQ ID NO: 45049 - DNA, 20 bp, Artificial Sequence
  chemically synthesized
acactttcaaatgtgccatt

SEQ ID NO: 45050 - DNA, 20 bp, Artificial Sequence
  chemically synthesized
cactttcaaatgtgccattc

SEQ ID NO: 45051 - DNA, 20 bp, Artificial Sequence
  chemically synthesized
atgtgccattcaggcaaaaa

SEQ ID NO: 45052 - DNA, 20 bp, Artificial Sequence
  chemically synthesized
tgtgccattcaggcaaaaat

SEQ ID NO: 45053 - DNA, 20 bp, Artificial Sequence
  chemically synthesized
tcaggcaaaaatgggaacta

SEQ ID NO: 45054 - DNA, 20 bp, Artificial Sequence
  chemically synthesized
caggcaaaaatgggaactac

SEQ ID NO: 45055 - DNA, 20 bp, Artificial Sequence
  chemically synthesized
ctacgggccacactcgacaa

SEQ ID NO: 45056 - DNA, 20 bp, Artificial Sequence
  chemically synthesized
tacgggccacactcgacaac

SEQ ID NO: 45057 - DNA, 20 bp, Artificial Sequence
  chemically synthesized
ttttcctctgtacctgcacc

SEQ ID NO: 45058 - DNA, 20 bp, Artificial Sequence
  chemically synthesized
tacctgcacccagctctcta

SEQ ID NO: 45059 - DNA, 20 bp, Artificial Sequence
  chemically synthesized
acctgcacccagctctctac

SEQ ID NO: 45060 - DNA, 20 bp, Artificial Sequence
  chemically synthesized
cacccagctctctacgggcc

SEQ ID NO: 45061 - DNA, 20 bp, Artificial Sequence
  chemically synthesized
tctacgggcctggtcgctcc

SEQ ID NO: 45062 - DNA, 20 bp, Artificial Sequence
  chemically synthesized
acgggcctggtcgctcctgg

SEQ ID NO: 45063 - DNA, 20 bp, Artificial Sequence
  chemically synthesized
gctcctggtggccctgccca

SEQ ID NO: 45064 - DNA, 20 bp, Artificial Sequence
  chemically synthesized
ctcctggtggccctgcccaa

SEQ ID NO: 45065 - DNA, 20 bp, Artificial Sequence
  chemically synthesized
ccaccccctcccccatgccc

SEQ ID NO: 45066 - DNA, 20 bp, Artificial Sequence
  chemically synthesized
cccctcccccatgccccagt

SEQ ID NO: 45067 - DNA, 20 bp, Artificial Sequence
  chemically synthesized
tgccccagtcagaataaatt

SEQ ID NO: 45068 - DNA, 20 bp, Artificial Sequence
  chemically synthesized
gccccagtcagaataaattg

SEQ ID NO: 45069 - DNA, 20 bp, Artificial Sequence
  chemically synthesized
ccccagtcagaataaattga

SEQ ID NO: 45070 - DNA, 20 bp, Artificial Sequence
  chemically synthesized
taaattgagggaaaaaatca

SEQ ID NO: 45071 - DNA, 20 bp, Artificial Sequence
  chemically synthesized
aaattgagggaaaaaatcat

SEQ ID NO: 45072 - DNA, 20 bp, Artificial Sequence
  chemically synthesized
agggaaaaaatcatgggctt

SEQ ID NO: 45073 - DNA, 20 bp, Artificial Sequence
  chemically synthesized
ggaaaaaatcatgggctttg

SEQ ID NO: 45074 - DNA, 20 bp, Artificial Sequence
  chemically synthesized
aaaatcatgggctttggagc

SEQ ID NO: 45075 - DNA, 20 bp, Artificial Sequence
  chemically synthesized
aaatcatgggctttggagcc

SEQ ID NO: 45076 - DNA, 20 bp, Artificial Sequence
  chemically synthesized
gctttggagccaggaaaccg

SEQ ID NO: 45077 - DNA, 20 bp, Artificial Sequence
  chemically synthesized
gaaaccgtggacctgaattc

SEQ ID NO: 45078 - DNA, 20 bp, Artificial Sequence
  chemically synthesized
attccagctccaatatttac

SEQ ID NO: 45079 - DNA, 20 bp, Artificial Sequence
  chemically synthesized
tccaatatttactggttgtg

SEQ ID NO: 45080 - DNA, 20 bp, Artificial Sequence
  chemically synthesized
tttactggttgtgcagccat

SEQ ID NO: 45081 - DNA, 20 bp, Artificial Sequence
  chemically synthesized
ctggttgtgcagccatgagc

SEQ ID NO: 45082 - DNA, 20 bp, Artificial Sequence
  chemically synthesized
gagcaagtcactcaacctct

SEQ ID NO: 45083 - DNA, 20 bp, Artificial Sequence
  chemically synthesized
gcaagtcactcaacctctcg

SEQ ID NO: 45084 - DNA, 20 bp, Artificial Sequence
  chemically synthesized
cactcaacctctcggagcct

SEQ ID NO: 45085 - DNA, 20 bp, Artificial Sequence
  chemically synthesized
cagatacctctgctgtattg

SEQ ID NO: 45086 - DNA, 20 bp, Artificial Sequence
  chemically synthesized
gatacctctgctgtattgta

SEQ ID NO: 45087 - DNA, 20 bp, Artificial Sequence
  chemically synthesized
ctgctgtattgtagagacca

SEQ ID NO: 45088 - DNA, 20 bp, Artificial Sequence
  chemically synthesized
agaccacagtacctatgaca

SEQ ID NO: 45089 - DNA, 20 bp, Artificial Sequence
  chemically synthesized
gaccacagtacctatgacat

SEQ ID NO: 45090 - DNA, 20 bp, Artificial Sequence
  chemically synthesized
tacctatgacataggcctgc

SEQ ID NO: 45091 - DNA, 20 bp, Artificial Sequence
  chemically synthesized
acctatgacataggcctgct

SEQ ID NO: 45092 - DNA, 20 bp, Artificial Sequence
  chemically synthesized
atgacataggcctgctggga

SEQ ID NO: 45093 - DNA, 20 bp, Artificial Sequence
  chemically synthesized
ataggcctgctgggaaagtc

SEQ ID NO: 45094 - DNA, 20 bp, Artificial Sequence
  chemically synthesized
aggcctgctgggaaagtcaa

SEQ ID NO: 45095 - DNA, 20 bp, Artificial Sequence
  chemically synthesized
gctgggaaagtcaagagtga

SEQ ID NO: 45096 - DNA, 20 bp, Artificial Sequence
  chemically synthesized
ggttatataaatctcccatc

SEQ ID NO: 45097 - DNA, 20 bp, Artificial Sequence
  chemically synthesized
atccagatgctctacaaatg

SEQ ID NO: 45098 - DNA, 20 bp, Artificial Sequence
  chemically synthesized
tccagatgctctacaaatgc

SEQ ID NO: 45099 - DNA, 20 bp, Artificial Sequence
  chemically synthesized
agatgctctacaaatgcagg

SEQ ID NO: 45100 - DNA, 20 bp, Artificial Sequence
  chemically synthesized
tgctctacaaatgcaggcag

SEQ ID NO: 45101 - DNA, 20 bp, Artificial Sequence
  chemically synthesized
gctctacaaatgcaggcaga

SEQ ID NO: 45102 - DNA, 20 bp, Artificial Sequence
  chemically synthesized
ctctacaaatgcaggcagaa

SEQ ID NO: 45103 - DNA, 20 bp, Artificial Sequence
  chemically synthesized
tgcaggcagaagggatgact

SEQ ID NO: 45104 - DNA, 20 bp, Artificial Sequence
  chemically synthesized
ggcagaagggatgactaagt

SEQ ID NO: 45105 - DNA, 20 bp, Artificial Sequence
  chemically synthesized
aagggatgactaagtgagca

SEQ ID NO: 45106 - DNA, 20 bp, Artificial Sequence
  chemically synthesized
agggatgactaagtgagcaa

SEQ ID NO: 45107 - DNA, 20 bp, Artificial Sequence
  chemically synthesized
agcaaaggcaacacttctta

SEQ ID NO: 45108 - DNA, 20 bp, Artificial Sequence
  chemically synthesized
caaaggcaacacttcttaaa

SEQ ID NO: 45109 - DNA, 20 bp, Artificial Sequence
  chemically synthesized
aaggcaacacttcttaaaga

SEQ ID NO: 45110 - DNA, 20 bp, Artificial Sequence
  chemically synthesized
ggcaacacttcttaaagaga

SEQ ID NO: 45111 - DNA, 20 bp, Artificial Sequence
  chemically synthesized
cacttcttaaagagagagaa

SEQ ID NO: 45112 - DNA, 20 bp, Artificial Sequence
  chemically synthesized
cttaaagagagagaaaagtc

SEQ ID NO: 45113 - DNA, 20 bp, Artificial Sequence
  chemically synthesized
ttaaagagagagaaaagtca

SEQ ID NO: 45114 - DNA, 20 bp, Artificial Sequence
  chemically synthesized
aaaagtcaaggccactgtct

SEQ ID NO: 45115 - DNA, 20 bp, Artificial Sequence
  chemically synthesized
tccttttgtgttgctatata

SEQ ID NO: 45116 - DNA, 20 bp, Artificial Sequence
  chemically synthesized
ccttttgtgttgctatataa

SEQ ID NO: 45117 - DNA, 20 bp, Artificial Sequence
  chemically synthesized
gctatataaaggaatacctg

SEQ ID NO: 45118 - DNA, 20 bp, Artificial Sequence
  chemically synthesized
ctatataaaggaatacctga

SEQ ID NO: 45119 - DNA, 20 bp, Artificial Sequence
  chemically synthesized
ataaaggaatacctgaaggt

SEQ ID NO: 45120 - DNA, 20 bp, Artificial Sequence
  chemically synthesized
cctgaaggtgagtaatttac

SEQ ID NO: 45121 - DNA, 20 bp, Artificial Sequence
  chemically synthesized
ctgaaggtgagtaatttaca

SEQ ID NO: 45122 - DNA, 20 bp, Artificial Sequence
  chemically synthesized
ggtgagtaatttacaaggaa

SEQ ID NO: 45123 - DNA, 20 bp, Artificial Sequence
  chemically synthesized
gtgagtaatttacaaggaaa

SEQ ID NO: 45124 - DNA, 20 bp, Artificial Sequence
  chemically synthesized
tgagtaatttacaaggaaaa

SEQ ID NO: 45125 - DNA, 20 bp, Artificial Sequence
  chemically synthesized
acaaggaaaagggatttatt

SEQ ID NO: 45126 - DNA, 20 bp, Artificial Sequence
  chemically synthesized
tattcagctcatgattctgc

SEQ ID NO: 45127 - DNA, 20 bp, Artificial Sequence
  chemically synthesized
tcatgattctgcaagctctc

SEQ ID NO: 45128 - DNA, 20 bp, Artificial Sequence
  chemically synthesized
catgattctgcaagctctcc

SEQ ID NO: 45129 - DNA, 20 bp, Artificial Sequence
  chemically synthesized
gattctgcaagctctccagg

SEQ ID NO: 45130 - DNA, 20 bp, Artificial Sequence
  chemically synthesized
tgcaagctctccaggaagca

SEQ ID NO: 45131 - DNA, 20 bp, Artificial Sequence
  chemically synthesized
ctctccaggaagcatggcac

SEQ ID NO: 45132 - DNA, 20 bp, Artificial Sequence
  chemically synthesized
atggcaccagcatctgcttc

SEQ ID NO: 45133 - DNA, 20 bp, Artificial Sequence
  chemically synthesized
caccagcatctgcttctggt

SEQ ID NO: 45134 - DNA, 20 bp, Artificial Sequence
  chemically synthesized
accagcatctgcttctggtg

SEQ ID NO: 45135 - DNA, 20 bp, Artificial Sequence
  chemically synthesized
ccagcatctgcttctggtga

SEQ ID NO: 45136 - DNA, 20 bp, Artificial Sequence
  chemically synthesized
ctgcttctggtgagggcctt

SEQ ID NO: 45137 - DNA, 20 bp, Artificial Sequence
  chemically synthesized
ccttaagctgctttcactga

SEQ ID NO: 45138 - DNA, 20 bp, Artificial Sequence
  chemically synthesized
taagctgctttcactgatgg

SEQ ID NO: 45139 - DNA, 20 bp, Artificial Sequence
  chemically synthesized
gctgctttcactgatggcag

SEQ ID NO: 45140 - DNA, 20 bp, Artificial Sequence
  chemically synthesized
ctgctttcactgatggcaga

SEQ ID NO: 45141 - DNA, 20 bp, Artificial Sequence
  chemically synthesized
ttcactgatggcagaaggtg

SEQ ID NO: 45142 - DNA, 20 bp, Artificial Sequence
  chemically synthesized
tcactgatggcagaaggtga

SEQ ID NO: 45143 - DNA, 20 bp, Artificial Sequence
  chemically synthesized
cactgatggcagaaggtgaa

SEQ ID NO: 45144 - DNA, 20 bp, Artificial Sequence
  chemically synthesized
actgatggcagaaggtgaag

SEQ ID NO: 45145 - DNA, 20 bp, Artificial Sequence
  chemically synthesized
tgatggcagaaggtgaaggg

SEQ ID NO: 45146 - DNA, 20 bp, Artificial Sequence
  chemically synthesized
tgaaggggagcctacatgtg

SEQ ID NO: 45147 - DNA, 20 bp, Artificial Sequence
  chemically synthesized
aaggggagcctacatgtgca

SEQ ID NO: 45148 - DNA, 20 bp, Artificial Sequence
  chemically synthesized
atgtgcagagatcaatcaca

SEQ ID NO: 45149 - DNA, 20 bp, Artificial Sequence
  chemically synthesized
gcagagatcaatcacatggc

SEQ ID NO: 45150 - DNA, 20 bp, Artificial Sequence
  chemically synthesized
agagatcaatcacatggcaa

SEQ ID NO: 45151 - DNA, 20 bp, Artificial Sequence
  chemically synthesized
gatcaatcacatggcaagag

SEQ ID NO: 45152 - DNA, 20 bp, Artificial Sequence
  chemically synthesized
caatcacatggcaagagaag

SEQ ID NO: 45153 - DNA, 20 bp, Artificial Sequence
  chemically synthesized
cacatggcaagagaagaagc

SEQ ID NO: 45154 - DNA, 20 bp, Artificial Sequence
  chemically synthesized
catggcaagagaagaagcaa

SEQ ID NO: 45155 - DNA, 20 bp, Artificial Sequence
  chemically synthesized
tggcaagagaagaagcaaga

SEQ ID NO: 45156 - DNA, 20 bp, Artificial Sequence
  chemically synthesized
caagagaagaagcaagagag

SEQ ID NO: 45157 - DNA, 20 bp, Artificial Sequence
  chemically synthesized
agagaagaagcaagagagaa

SEQ ID NO: 45158 - DNA, 20 bp, Artificial Sequence
  chemically synthesized
agaagaagcaagagagaaga

SEQ ID NO: 45159 - DNA, 20 bp, Artificial Sequence
  chemically synthesized
gaagaagcaagagagaagag

SEQ ID NO: 45160 - DNA, 20 bp, Artificial Sequence
  chemically synthesized
aagaagcaagagagaagaga

SEQ ID NO: 45161 - DNA, 20 bp, Artificial Sequence
  chemically synthesized
gaagcaagagagaagagagg

SEQ ID NO: 45162 - DNA, 20 bp, Artificial Sequence
  chemically synthesized
aagcaagagagaagagaggg

SEQ ID NO: 45163 - DNA, 20 bp, Artificial Sequence
  chemically synthesized
agagaagagagggaggtgcc

SEQ ID NO: 45164 - DNA, 20 bp, Artificial Sequence
  chemically synthesized
gccaagctctttttaataat

SEQ ID NO: 45165 - DNA, 20 bp, Artificial Sequence
  chemically synthesized
ctttttaataatcagccttc

SEQ ID NO: 45166 - DNA, 20 bp, Artificial Sequence
  chemically synthesized
tttttaataatcagccttca

SEQ ID NO: 45167 - DNA, 20 bp, Artificial Sequence
  chemically synthesized
ttttaataatcagccttcaa

SEQ ID NO: 45168 - DNA, 20 bp, Artificial Sequence
  chemically synthesized
tcagccttcaagggaaatca

SEQ ID NO: 45169 - DNA, 20 bp, Artificial Sequence
  chemically synthesized
gccttcaagggaaatcatag

SEQ ID NO: 45170 - DNA, 20 bp, Artificial Sequence
  chemically synthesized
ccttcaagggaaatcatagc

SEQ ID NO: 45171 - DNA, 20 bp, Artificial Sequence
  chemically synthesized
ttcaagggaaatcatagcgg

SEQ ID NO: 45172 - DNA, 20 bp, Artificial Sequence
  chemically synthesized
gagaacttactcattatcac

SEQ ID NO: 45173 - DNA, 20 bp, Artificial Sequence
  chemically synthesized
agaacttactcattatcaca

SEQ ID NO: 45174 - DNA, 20 bp, Artificial Sequence
  chemically synthesized
cttactcattatcacaagga

SEQ ID NO: 45175 - DNA, 20 bp, Artificial Sequence
  chemically synthesized
attatcacaaggacggcacc

SEQ ID NO: 45176 - DNA, 20 bp, Artificial Sequence
  chemically synthesized
ggacggcaccaagcctttca

SEQ ID NO: 45177 - DNA, 20 bp, Artificial Sequence
  chemically synthesized
gacggcaccaagcctttcac

SEQ ID NO: 45178 - DNA, 20 bp, Artificial Sequence
  chemically synthesized
acggcaccaagcctttcaca

SEQ ID NO: 45179 - DNA, 20 bp, Artificial Sequence
  chemically synthesized
cggcaccaagcctttcacag

SEQ ID NO: 45180 - DNA, 20 bp, Artificial Sequence
  chemically synthesized
atgacccaaacacctcccat

SEQ ID NO: 45181 - DNA, 20 bp, Artificial Sequence
  chemically synthesized
tgacccaaacacctcccatt

SEQ ID NO: 45182 - DNA, 20 bp, Artificial Sequence
  chemically synthesized
taggccccacttccaacact

SEQ ID NO: 45183 - DNA, 20 bp, Artificial Sequence
  chemically synthesized
aggccccacttccaacactg

SEQ ID NO: 45184 - DNA, 20 bp, Artificial Sequence
  chemically synthesized
tgaggaccaaatttccacat

SEQ ID NO: 45185 - DNA, 20 bp, Artificial Sequence
  chemically synthesized
ccaaatttccacatgagatt

SEQ ID NO: 45186 - DNA, 20 bp, Artificial Sequence
  chemically synthesized
aaatttccacatgagatttg

SEQ ID NO: 45187 - DNA, 20 bp, Artificial Sequence
  chemically synthesized
aatttccacatgagatttgg

SEQ ID NO: 45188 - DNA, 20 bp, Artificial Sequence
  chemically synthesized
atttccacatgagatttgga

SEQ ID NO: 45189 - DNA, 20 bp, Artificial Sequence
  chemically synthesized
tttccacatgagatttggag

SEQ ID NO: 45190 - DNA, 20 bp, Artificial Sequence
  chemically synthesized
tggaggggacaaacaaatta

SEQ ID NO: 45191 - DNA, 20 bp, Artificial Sequence
  chemically synthesized
aggggacaaacaaattatag

SEQ ID NO: 45192 - DNA, 20 bp, Artificial Sequence
  chemically synthesized
attatagcagccactatcta

SEQ ID NO: 45193 - DNA, 20 bp, Artificial Sequence
  chemically synthesized
actatctatggtgatttgtt

SEQ ID NO: 45194 - DNA, 20 bp, Artificial Sequence
  chemically synthesized
atggtgatttgtttggtttt

SEQ ID NO: 45195 - DNA, 20 bp, Artificial Sequence
  chemically synthesized
ttgtctgctccaactgctct

SEQ ID NO: 45196 - DNA, 20 bp, Artificial Sequence
  chemically synthesized
tgtctgctccaactgctctc

SEQ ID NO: 45197 - DNA, 20 bp, Artificial Sequence
  chemically synthesized
ctgctccaactgctctcagg

SEQ ID NO: 45198 - DNA, 20 bp, Artificial Sequence
  chemically synthesized
tcaggcagacatacctgctt

SEQ ID NO: 45199 - DNA, 20 bp, Artificial Sequence
  chemically synthesized
acctgcttaagaaccttcac

SEQ ID NO: 45200 - DNA, 20 bp, Artificial Sequence
  chemically synthesized
gaaccttcactggctcccca

SEQ ID NO: 45201 - DNA, 20 bp, Artificial Sequence
  chemically synthesized
tccccacagcctcatgaatc

SEQ ID NO: 45202 - DNA, 20 bp, Artificial Sequence
  chemically synthesized
ccaaactccatgctcctcct

SEQ ID NO: 45203 - DNA, 20 bp, Artificial Sequence
  chemically synthesized
ccctacctcaacctaccttg

SEQ ID NO: 45204 - DNA, 20 bp, Artificial Sequence
  chemically synthesized
atctctgtatatatgcatct

SEQ ID NO: 45205 - DNA, 20 bp, Artificial Sequence
  chemically synthesized
tatatatgcatcttggactc

SEQ ID NO: 45206 - DNA, 20 bp, Artificial Sequence
  chemically synthesized
tatgcatcttggactccagt

SEQ ID NO: 45207 - DNA, 20 bp, Artificial Sequence
  chemically synthesized
tgcatcttggactccagtca

SEQ ID NO: 45208 - DNA, 20 bp, Artificial Sequence
  chemically synthesized
atcttggactccagtcagag

SEQ ID NO: 45209 - DNA, 20 bp, Artificial Sequence
  chemically synthesized
ggactccagtcagagtagaa

SEQ ID NO: 45210 - DNA, 20 bp, Artificial Sequence
  chemically synthesized
actccagtcagagtagaaca

SEQ ID NO: 45211 - DNA, 20 bp, Artificial Sequence
  chemically synthesized
gagtccaccccctttaccca

SEQ ID NO: 45212 - DNA, 20 bp, Artificial Sequence
  chemically synthesized
accccctttacccaaagcct

SEQ ID NO: 45213 - DNA, 20 bp, Artificial Sequence
  chemically synthesized
ccccctttacccaaagcctt

SEQ ID NO: 45214 - DNA, 20 bp, Artificial Sequence
  chemically synthesized
cccctttacccaaagcctta

SEQ ID NO: 45215 - DNA, 20 bp, Artificial Sequence
  chemically synthesized
ccaaagccttagggccaaaa

SEQ ID NO: 45216 - DNA, 20 bp, Artificial Sequence
  chemically synthesized
gccaaaacggttttgaacct

SEQ ID NO: 45217 - DNA, 20 bp, Artificial Sequence
  chemically synthesized
tttgaacctcagaacttgtt

SEQ ID NO: 45218 - DNA, 20 bp, Artificial Sequence
  chemically synthesized
ctcagaacttgtttggattt

SEQ ID NO: 45219 - DNA, 20 bp, Artificial Sequence
  chemically synthesized
gaacttgtttggattttaga

SEQ ID NO: 45220 - DNA, 20 bp, Artificial Sequence
  chemically synthesized
aacttgtttggattttagaa

SEQ ID NO: 45221 - DNA, 20 bp, Artificial Sequence
  chemically synthesized
ttgtttggattttagaaagg

SEQ ID NO: 45222 - DNA, 20 bp, Artificial Sequence
  chemically synthesized
ggattttagaaaggcagtaa

SEQ ID NO: 45223 - DNA, 20 bp, Artificial Sequence
  chemically synthesized
gattttagaaaggcagtaat

SEQ ID NO: 45224 - DNA, 20 bp, Artificial Sequence
  chemically synthesized
gaaaggcagtaatgggcaat

SEQ ID NO: 45225 - DNA, 20 bp, Artificial Sequence
  chemically synthesized
aaggcagtaatgggcaatca

SEQ ID NO: 45226 - DNA, 20 bp, Artificial Sequence
  chemically synthesized
atgggcaatcagagtctgct

SEQ ID NO: 45227 - DNA, 20 bp, Artificial Sequence
  chemically synthesized
ggcaatcagagtctgcttgg

SEQ ID NO: 45228 - DNA, 20 bp, Artificial Sequence
  chemically synthesized
agagtctgcttggaagaatc

SEQ ID NO: 45229 - DNA, 20 bp, Artificial Sequence
  chemically synthesized
agtctgcttggaagaatctg

SEQ ID NO: 45230 - DNA, 20 bp, Artificial Sequence
  chemically synthesized
gctgcatactgtaatctatg

SEQ ID NO: 45231 - DNA, 20 bp, Artificial Sequence
  chemically synthesized
aattaaaaataatctcatgt

SEQ ID NO: 45232 - DNA, 20 bp, Artificial Sequence
  chemically synthesized
aatctcatgtcagttcacgt

SEQ ID NO: 45233 - DNA, 20 bp, Artificial Sequence
  chemically synthesized
atctcatgtcagttcacgtc

SEQ ID NO: 45234 - DNA, 20 bp, Artificial Sequence
  chemically synthesized
taaatcacaaaaaaaacttt

SEQ ID NO: 45235 - DNA, 20 bp, Artificial Sequence
  chemically synthesized
tttcgtaacattttacattt

SEQ ID NO: 45236 - DNA, 20 bp, Artificial Sequence
  chemically synthesized
gtaacattttacatttcaga

SEQ ID NO: 45237 - DNA, 20 bp, Artificial Sequence
  chemically synthesized
acattttacatttcagacgg

SEQ ID NO: 45238 - DNA, 20 bp, Artificial Sequence
  chemically synthesized
tacatttcagacggtggata

SEQ ID NO: 45239 - DNA, 20 bp, Artificial Sequence
  chemically synthesized
agacggtggataaagaactg

SEQ ID NO: 45240 - DNA, 20 bp, Artificial Sequence
  chemically synthesized
acggtggataaagaactgtg

SEQ ID NO: 45241 - DNA, 20 bp, Artificial Sequence
  chemically synthesized
cggtggataaagaactgtgg

SEQ ID NO: 45242 - DNA, 20 bp, Artificial Sequence
  chemically synthesized
ggataaagaactgtggaggc

SEQ ID NO: 45243 - DNA, 20 bp, Artificial Sequence
  chemically synthesized
gataaagaactgtggaggcc

SEQ ID NO: 45244 - DNA, 20 bp, Artificial Sequence
  chemically synthesized
agaactgtggaggccaggcg

SEQ ID NO: 45245 - DNA, 20 bp, Artificial Sequence
  chemically synthesized
actgtggaggccaggcgtgg

SEQ ID NO: 45246 - DNA, 20 bp, Artificial Sequence
  chemically synthesized
gtggctcacacctgtaattc

SEQ ID NO: 45247 - DNA, 20 bp, Artificial Sequence
  chemically synthesized
cacctgtaattcgagcactt

SEQ ID NO: 45248 - DNA, 20 bp, Artificial Sequence
  chemically synthesized
acctgtaattcgagcacttt

SEQ ID NO: 45249 - DNA, 20 bp, Artificial Sequence
  chemically synthesized
ctgtaattcgagcactttgg

SEQ ID NO: 45250 - DNA, 20 bp, Artificial Sequence
  chemically synthesized
tgtaattcgagcactttggg

SEQ ID NO: 45251 - DNA, 20 bp, Artificial Sequence
  chemically synthesized
ttcgagcactttgggaggct

SEQ ID NO: 45252 - DNA, 20 bp, Artificial Sequence
  chemically synthesized
tcgagcactttgggaggctg

SEQ ID NO: 45253 - DNA, 20 bp, Artificial Sequence
  chemically synthesized
agcactttgggaggctgagg

SEQ ID NO: 45254 - DNA, 20 bp, Artificial Sequence
  chemically synthesized
gcactttgggaggctgaggc

SEQ ID NO: 45255 - DNA, 20 bp, Artificial Sequence
  chemically synthesized
actttgggaggctgaggcgg

SEQ ID NO: 45256 - DNA, 20 bp, Artificial Sequence
  chemically synthesized
ctttgggaggctgaggcggg

SEQ ID NO: 45257 - DNA, 20 bp, Artificial Sequence
  chemically synthesized
aggcgggaggatcacctcct

SEQ ID NO: 45258 - DNA, 20 bp, Artificial Sequence
  chemically synthesized
atcacctcctcggatccact

SEQ ID NO: 45259 - DNA, 20 bp, Artificial Sequence
  chemically synthesized
tcacctcctcggatccactg

SEQ ID NO: 45260 - DNA, 20 bp, Artificial Sequence
  chemically synthesized
acctcctcggatccactgag

SEQ ID NO: 45261 - DNA, 20 bp, Artificial Sequence
  chemically synthesized
cctcctcggatccactgagg

SEQ ID NO: 45262 - DNA, 20 bp, Artificial Sequence
  chemically synthesized
ctcggatccactgaggaggt

SEQ ID NO: 45263 - DNA, 20 bp, Artificial Sequence
  chemically synthesized
tcggatccactgaggaggtc

SEQ ID NO: 45264 - DNA, 20 bp, Artificial Sequence
  chemically synthesized
ggatccactgaggaggtcag

SEQ ID NO: 45265 - DNA, 20 bp, Artificial Sequence
  chemically synthesized
ggaggtcaggagtttgcgac

SEQ ID NO: 45266 - DNA, 20 bp, Artificial Sequence
  chemically synthesized
tcaggagtttgcgactagcc

SEQ ID NO: 45267 - DNA, 20 bp, Artificial Sequence
  chemically synthesized
tgcgactagcctggccaacg

SEQ ID NO: 45268 - DNA, 20 bp, Artificial Sequence
  chemically synthesized
tctactaaaaatacaaaaat

SEQ ID NO: 45269 - DNA, 20 bp, Artificial Sequence
  chemically synthesized
ctaaaaatacaaaaattagc

SEQ ID NO: 45270 - DNA, 20 bp, Artificial Sequence
  chemically synthesized
taaaaatacaaaaattagcc

SEQ ID NO: 45271 - DNA, 20 bp, Artificial Sequence
  chemically synthesized
atacaaaaattagccgggcg

SEQ ID NO: 45272 - DNA, 20 bp, Artificial Sequence
  chemically synthesized
caaaaattagccgggcgtgg

SEQ ID NO: 45273 - DNA, 20 bp, Artificial Sequence
  chemically synthesized
aaattagccgggcgtggtgg

SEQ ID NO: 45274 - DNA, 20 bp, Artificial Sequence
  chemically synthesized
aattagccgggcgtggtggc

SEQ ID NO: 45275 - DNA, 20 bp, Artificial Sequence
  chemically synthesized
gtggcaggtacctgtaatcc

SEQ ID NO: 45276 - DNA, 20 bp, Artificial Sequence
  chemically synthesized
tacctgtaatcccagcttct

SEQ ID NO: 45277 - DNA, 20 bp, Artificial Sequence
  chemically synthesized
acctgtaatcccagcttctt

SEQ ID NO: 45278 - DNA, 20 bp, Artificial Sequence
  chemically synthesized
ctgtaatcccagcttcttgg

SEQ ID NO: 45279 - DNA, 20 bp, Artificial Sequence
  chemically synthesized
tgtaatcccagcttcttggg

SEQ ID NO: 45280 - DNA, 20 bp, Artificial Sequence
  chemically synthesized
tcccagcttcttgggaggct

SEQ ID NO: 45281 - DNA, 20 bp, Artificial Sequence
  chemically synthesized
cccagcttcttgggaggctg

SEQ ID NO: 45282 - DNA, 20 bp, Artificial Sequence
  chemically synthesized
agcttcttgggaggctgagg

SEQ ID NO: 45283 - DNA, 20 bp, Artificial Sequence
  chemically synthesized
gcttcttgggaggctgaggc

SEQ ID NO: 45284 - DNA, 20 bp, Artificial Sequence
  chemically synthesized
ttcttgggaggctgaggcag

SEQ ID NO: 45285 - DNA, 20 bp, Artificial Sequence
  chemically synthesized
gcaggagaaccacttgaacc

SEQ ID NO: 45286 - DNA, 20 bp, Artificial Sequence
  chemically synthesized
caggagaaccacttgaaccc

SEQ ID NO: 45287 - DNA, 20 bp, Artificial Sequence
  chemically synthesized
ggagaaccacttgaacccgg

SEQ ID NO: 45288 - DNA, 20 bp, Artificial Sequence
  chemically synthesized
aaccacttgaacccgggaga

SEQ ID NO: 45289 - DNA, 20 bp, Artificial Sequence
  chemically synthesized
aacccgggagacagatgttg

SEQ ID NO: 45290 - DNA, 20 bp, Artificial Sequence
  chemically synthesized
cgggagacagatgttgcagt

SEQ ID NO: 45291 - DNA, 20 bp, Artificial Sequence
  chemically synthesized
gacagatgttgcagtgagct

SEQ ID NO: 45292 - DNA, 20 bp, Artificial Sequence
  chemically synthesized
gagactgcaccattgcactc

SEQ ID NO: 45293 - DNA, 20 bp, Artificial Sequence
  chemically synthesized
tgcaccattgcactccagcc

SEQ ID NO: 45294 - DNA, 20 bp, Artificial Sequence
  chemically synthesized
gcaccattgcactccagcct

SEQ ID NO: 45295 - DNA, 20 bp, Artificial Sequence
  chemically synthesized
tgcactccagcctgggcaac

SEQ ID NO: 45296 - DNA, 20 bp, Artificial Sequence
  chemically synthesized
cactccagcctgggcaacaa

SEQ ID NO: 45297 - DNA, 20 bp, Artificial Sequence
  chemically synthesized
aaactccatctcaaaaaaaa

SEQ ID NO: 45298 - DNA, 20 bp, Artificial Sequence
  chemically synthesized
catctcaaaaaaaaaagaaa

SEQ ID NO: 45299 - DNA, 20 bp, Artificial Sequence
  chemically synthesized
aaaaaaaagaaaaagaactg

SEQ ID NO: 45300 - DNA, 20 bp, Artificial Sequence
  chemically synthesized
tgctccttatcttccacctc

SEQ ID NO: 45301 - DNA, 20 bp, Artificial Sequence
  chemically synthesized
tcttccacctctggttttcc

SEQ ID NO: 45302 - DNA, 20 bp, Artificial Sequence
  chemically synthesized
cagctctgtatctttgttca

SEQ ID NO: 45303 - DNA, 20 bp, Artificial Sequence
  chemically synthesized
ttcatggtacctcctaatcc

SEQ ID NO: 45304 - DNA, 20 bp, Artificial Sequence
  chemically synthesized
gaactcctactaatgcttca

SEQ ID NO: 45305 - DNA, 20 bp, Artificial Sequence
  chemically synthesized
taaataaaaattgaatgaat

SEQ ID NO: 45306 - DNA, 20 bp, Artificial Sequence
  chemically synthesized
aaataaaaattgaatgaatt

SEQ ID NO: 45307 - DNA, 20 bp, Artificial Sequence
  chemically synthesized
ataaaaattgaatgaattgg

SEQ ID NO: 45308 - DNA, 20 bp, Artificial Sequence
  chemically synthesized
aaaaattgaatgaattggga

SEQ ID NO: 45309 - DNA, 20 bp, Artificial Sequence
  chemically synthesized
aattgggagagtactctgtg

SEQ ID NO: 45310 - DNA, 20 bp, Artificial Sequence
  chemically synthesized
tgggagagtactctgtgcag

SEQ ID NO: 45311 - DNA, 20 bp, Artificial Sequence
  chemically synthesized
ggagagtactctgtgcagtg

SEQ ID NO: 45312 - DNA, 20 bp, Artificial Sequence
  chemically synthesized
tactctgtgcagtggagtgt

SEQ ID NO: 45313 - DNA, 20 bp, Artificial Sequence
  chemically synthesized
gtgcagtggagtgtcagttc

SEQ ID NO: 45314 - DNA, 20 bp, Artificial Sequence
  chemically synthesized
gagtgtcagttctggaaacc

SEQ ID NO: 45315 - DNA, 20 bp, Artificial Sequence
  chemically synthesized
aaacccagttctaatgcacc

SEQ ID NO: 45316 - DNA, 20 bp, Artificial Sequence
  chemically synthesized
aacccagttctaatgcacct

SEQ ID NO: 45317 - DNA, 20 bp, Artificial Sequence
  chemically synthesized
acccagttctaatgcacctg

SEQ ID NO: 45318 - DNA, 20 bp, Artificial Sequence
  chemically synthesized
ctggggtgacctcctctctc

SEQ ID NO: 45319 - DNA, 20 bp, Artificial Sequence
  chemically synthesized
tggggtgacctcctctctct

SEQ ID NO: 45320 - DNA, 20 bp, Artificial Sequence
  chemically synthesized
gacctcctctctctgggcct

SEQ ID NO: 45321 - DNA, 20 bp, Artificial Sequence
  chemically synthesized
cctcagtttctcatgactaa

SEQ ID NO: 45322 - DNA, 20 bp, Artificial Sequence
  chemically synthesized
gtttctcatgactaaaagaa

SEQ ID NO: 45323 - DNA, 20 bp, Artificial Sequence
  chemically synthesized
tttctcatgactaaaagaaa

SEQ ID NO: 45324 - DNA, 20 bp, Artificial Sequence
  chemically synthesized
catgactaaaagaaaaggat

SEQ ID NO: 45325 - DNA, 20 bp, Artificial Sequence
  chemically synthesized
atgaatgaataaatgaactt

SEQ ID NO: 45326 - DNA, 20 bp, Artificial Sequence
  chemically synthesized
tgaatgaataaatgaacttg

SEQ ID NO: 45327 - DNA, 20 bp, Artificial Sequence
  chemically synthesized
aatgaataaatgaacttgag

SEQ ID NO: 45328 - DNA, 20 bp, Artificial Sequence
  chemically synthesized
atgaataaatgaacttgagg

SEQ ID NO: 45329 - DNA, 20 bp, Artificial Sequence
  chemically synthesized
ctcctgttccaaacttccac

SEQ ID NO: 45330 - DNA, 20 bp, Artificial Sequence
  chemically synthesized
cctgttccaaacttccacca

SEQ ID NO: 45331 - DNA, 20 bp, Artificial Sequence
  chemically synthesized
gttccaaacttccaccagag

SEQ ID NO: 45332 - DNA, 20 bp, Artificial Sequence
  chemically synthesized
accagagaagaaacatcctc

SEQ ID NO: 45333 - DNA, 20 bp, Artificial Sequence
  chemically synthesized
ccagagaagaaacatcctca

SEQ ID NO: 45334 - DNA, 20 bp, Artificial Sequence
  chemically synthesized
cagagaagaaacatcctcaa

SEQ ID NO: 45335 - DNA, 20 bp, Artificial Sequence
  chemically synthesized
aagaaacatcctcaagggct

SEQ ID NO: 45336 - DNA, 20 bp, Artificial Sequence
  chemically synthesized
acatcctcaagggcttggtt

SEQ ID NO: 45337 - DNA, 20 bp, Artificial Sequence
  chemically synthesized
catcctcaagggcttggttc

SEQ ID NO: 45338 - DNA, 20 bp, Artificial Sequence
  chemically synthesized
cctcaagggcttggttcagg

SEQ ID NO: 45339 - DNA, 20 bp, Artificial Sequence
  chemically synthesized
gcttggttcaggtggtcata

SEQ ID NO: 45340 - DNA, 20 bp, Artificial Sequence
  chemically synthesized
gcctctgcttactcacctct

SEQ ID NO: 45341 - DNA, 20 bp, Artificial Sequence
  chemically synthesized
cctctgcttactcacctctc

SEQ ID NO: 45342 - DNA, 20 bp, Artificial Sequence
  chemically synthesized
tgcttactcacctctcagga

SEQ ID NO: 45343 - DNA, 20 bp, Artificial Sequence
  chemically synthesized
gcttactcacctctcaggat

SEQ ID NO: 45344 - DNA, 20 bp, Artificial Sequence
  chemically synthesized
cttactcacctctcaggatg

SEQ ID NO: 45345 - DNA, 20 bp, Artificial Sequence
  chemically synthesized
gatggggtactcactatttc

SEQ ID NO: 45346 - DNA, 20 bp, Artificial Sequence
  chemically synthesized
ggtactcactatttccagaa

SEQ ID NO: 45347 - DNA, 20 bp, Artificial Sequence
  chemically synthesized
tatttccagaacagttgttt

SEQ ID NO: 45348 - DNA, 20 bp, Artificial Sequence
  chemically synthesized
tttccagaacagttgttttg

SEQ ID NO: 45349 - DNA, 20 bp, Artificial Sequence
  chemically synthesized
ccagaacagttgttttggag

SEQ ID NO: 45350 - DNA, 20 bp, Artificial Sequence
  chemically synthesized
gaacagttgttttggagcag

SEQ ID NO: 45351 - DNA, 20 bp, Artificial Sequence
  chemically synthesized
tgaaatgccctttcttatcc

SEQ ID NO: 45352 - DNA, 20 bp, Artificial Sequence
  chemically synthesized
acaaccccacaacatccctc

SEQ ID NO: 45353 - DNA, 20 bp, Artificial Sequence
  chemically synthesized
ccccacaacatccctcgaga

SEQ ID NO: 45354 - DNA, 20 bp, Artificial Sequence
  chemically synthesized
aacatccctcgagaaagtca

SEQ ID NO: 45355 - DNA, 20 bp, Artificial Sequence
  chemically synthesized
acatccctcgagaaagtcaa

SEQ ID NO: 45356 - DNA, 20 bp, Artificial Sequence
  chemically synthesized
cctcgagaaagtcaaaggct

SEQ ID NO: 45357 - DNA, 20 bp, Artificial Sequence
  chemically synthesized
ctcgagaaagtcaaaggctc

SEQ ID NO: 45358 - DNA, 20 bp, Artificial Sequence
  chemically synthesized
tcgagaaagtcaaaggctca

SEQ ID NO: 45359 - DNA, 20 bp, Artificial Sequence
  chemically synthesized
aagtcaaaggctcagggaac

SEQ ID NO: 45360 - DNA, 20 bp, Artificial Sequence
  chemically synthesized
agtcaaaggctcagggaaca

SEQ ID NO: 45361 - DNA, 20 bp, Artificial Sequence
  chemically synthesized
caaaggctcagggaacaagg

SEQ ID NO: 45362 - DNA, 20 bp, Artificial Sequence
  chemically synthesized
aaggctcagggaacaaggaa

SEQ ID NO: 45363 - DNA, 20 bp, Artificial Sequence
  chemically synthesized
aggctcagggaacaaggaag

SEQ ID NO: 45364 - DNA, 20 bp, Artificial Sequence
  chemically synthesized
ggctcagggaacaaggaaga

SEQ ID NO: 45365 - DNA, 20 bp, Artificial Sequence
  chemically synthesized
acaaggaagagggctatact

SEQ ID NO: 45366 - DNA, 20 bp, Artificial Sequence
  chemically synthesized
gaagagggctatactgagct

SEQ ID NO: 45367 - DNA, 20 bp, Artificial Sequence
  chemically synthesized
agggctatactgagctgagt

SEQ ID NO: 45368 - DNA, 20 bp, Artificial Sequence
  chemically synthesized
gggctatactgagctgagta

SEQ ID NO: 45369 - DNA, 20 bp, Artificial Sequence
  chemically synthesized
ggacttgccatcctgccacc

SEQ ID NO: 45370 - DNA, 20 bp, Artificial Sequence
  chemically synthesized
atcctgccacccagcacact

SEQ ID NO: 45371 - DNA, 20 bp, Artificial Sequence
  chemically synthesized
tgccacccagcacactcaga

SEQ ID NO: 45372 - DNA, 20 bp, Artificial Sequence
  chemically synthesized
cacccagcacactcagacag

SEQ ID NO: 45373 - DNA, 20 bp, Artificial Sequence
  chemically synthesized
agcacactcagacagaagcg

SEQ ID NO: 45374 - DNA, 20 bp, Artificial Sequence
  chemically synthesized
gcacactcagacagaagcgt

SEQ ID NO: 45375 - DNA, 20 bp, Artificial Sequence
  chemically synthesized
cactcagacagaagcgtggg

SEQ ID NO: 45376 - DNA, 20 bp, Artificial Sequence
  chemically synthesized
actcagacagaagcgtgggc

SEQ ID NO: 45377 - DNA, 20 bp, Artificial Sequence
  chemically synthesized
cagacagaagcgtgggcagg

SEQ ID NO: 45378 - DNA, 20 bp, Artificial Sequence
  chemically synthesized
aagcgtgggcaggcagctgt

SEQ ID NO: 45379 - DNA, 20 bp, Artificial Sequence
  chemically synthesized
cgtgggcaggcagctgtgag

SEQ ID NO: 45380 - DNA, 20 bp, Artificial Sequence
  chemically synthesized
gggcaggcagctgtgagtgg

SEQ ID NO: 45381 - DNA, 20 bp, Artificial Sequence
  chemically synthesized
cagaattttcccctctgccc

SEQ ID NO: 45382 - DNA, 20 bp, Artificial Sequence
  chemically synthesized
agaattttcccctctgcccc

SEQ ID NO: 45383 - DNA, 20 bp, Artificial Sequence
  chemically synthesized
aattttcccctctgccccag

SEQ ID NO: 45384 - DNA, 20 bp, Artificial Sequence
  chemically synthesized
cccctctgccccaggagctg

SEQ ID NO: 45385 - DNA, 20 bp, Artificial Sequence
  chemically synthesized
ctgccccaggagctgtggtt

SEQ ID NO: 45386 - DNA, 20 bp, Artificial Sequence
  chemically synthesized
gccccaggagctgtggtttg

SEQ ID NO: 45387 - DNA, 20 bp, Artificial Sequence
  chemically synthesized
aggagctgtggtttggagca

SEQ ID NO: 45388 - DNA, 20 bp, Artificial Sequence
  chemically synthesized
agcaaagacaatgtcaccaa

SEQ ID NO: 45389 - DNA, 20 bp, Artificial Sequence
  chemically synthesized
gcaaagacaatgtcaccaac

SEQ ID NO: 45390 - DNA, 20 bp, Artificial Sequence
  chemically synthesized
gtcaccaacaggtcacactg

SEQ ID NO: 45391 - DNA, 20 bp, Artificial Sequence
  chemically synthesized
ccaacaggtcacactgcaga

SEQ ID NO: 45392 - DNA, 20 bp, Artificial Sequence
  chemically synthesized
caacaggtcacactgcagac

SEQ ID NO: 45393 - DNA, 20 bp, Artificial Sequence
  chemically synthesized
aacaggtcacactgcagaca

SEQ ID NO: 45394 - DNA, 20 bp, Artificial Sequence
  chemically synthesized
gcagacagggacaaaactgc

SEQ ID NO: 45395 - DNA, 20 bp, Artificial Sequence
  chemically synthesized
aaaactgcaagtgatccccc

SEQ ID NO: 45396 - DNA, 20 bp, Artificial Sequence
  chemically synthesized
aaactgcaagtgatcccccc

SEQ ID NO: 45397 - DNA, 20 bp, Artificial Sequence
  chemically synthesized
aactgcaagtgatccccccg

SEQ ID NO: 45398 - DNA, 20 bp, Artificial Sequence
  chemically synthesized
ccccccggggcttgcattgt

SEQ ID NO: 45399 - DNA, 20 bp, Artificial Sequence
  chemically synthesized
ttgcattgtaagttcactca

SEQ ID NO: 45400 - DNA, 20 bp, Artificial Sequence
  chemically synthesized
gtaagttcactcatggtcaa

SEQ ID NO: 45401 - DNA, 20 bp, Artificial Sequence
  chemically synthesized
tctccccatctgctgccact

SEQ ID NO: 45402 - DNA, 20 bp, Artificial Sequence
  chemically synthesized
catctgctgccactgagccg

SEQ ID NO: 45403 - DNA, 20 bp, Artificial Sequence
  chemically synthesized
atctgctgccactgagccgt

SEQ ID NO: 45404 - DNA, 20 bp, Artificial Sequence
  chemically synthesized
tctgctgccactgagccgta

SEQ ID NO: 45405 - DNA, 20 bp, Artificial Sequence
  chemically synthesized
cgattgtcacctccctttta

SEQ ID NO: 45406 - DNA, 20 bp, Artificial Sequence
  chemically synthesized
gtcacctcccttttaaagat

SEQ ID NO: 45407 - DNA, 20 bp, Artificial Sequence
  chemically synthesized
tcacctcccttttaaagatt

SEQ ID NO: 45408 - DNA, 20 bp, Artificial Sequence
  chemically synthesized
cccttttaaagattaggcaa

SEQ ID NO: 45409 - DNA, 20 bp, Artificial Sequence
  chemically synthesized
cttttaaagattaggcaatg

SEQ ID NO: 45410 - DNA, 20 bp, Artificial Sequence
  chemically synthesized
ttttaaagattaggcaatgg

SEQ ID NO: 45411 - DNA, 20 bp, Artificial Sequence
  chemically synthesized
agattaggcaatggaggctc

SEQ ID NO: 45412 - DNA, 20 bp, Artificial Sequence
  chemically synthesized
gattaggcaatggaggctca

SEQ ID NO: 45413 - DNA, 20 bp, Artificial Sequence
  chemically synthesized
ggcaatggaggctcaaggat

SEQ ID NO: 45414 - DNA, 20 bp, Artificial Sequence
  chemically synthesized
tcaaggataagtgacttgtc

SEQ ID NO: 45415 - DNA, 20 bp, Artificial Sequence
  chemically synthesized
aagtgacttgtcaagcacca

SEQ ID NO: 45416 - DNA, 20 bp, Artificial Sequence
  chemically synthesized
gacttgtcaagcaccacagc

SEQ ID NO: 45417 - DNA, 20 bp, Artificial Sequence
  chemically synthesized
tgtcaagcaccacagctagt

SEQ ID NO: 45418 - DNA, 20 bp, Artificial Sequence
  chemically synthesized
tcaagcaccacagctagtga

SEQ ID NO: 45419 - DNA, 20 bp, Artificial Sequence
  chemically synthesized
caagcaccacagctagtgag

SEQ ID NO: 45420 - DNA, 20 bp, Artificial Sequence
  chemically synthesized
gcaccacagctagtgagagg

SEQ ID NO: 45421 - DNA, 20 bp, Artificial Sequence
  chemically synthesized
acagctagtgagaggaagcc

SEQ ID NO: 45422 - DNA, 20 bp, Artificial Sequence
  chemically synthesized
tcaaccccacatctgactcc

SEQ ID NO: 45423 - DNA, 20 bp, Artificial Sequence
  chemically synthesized
ccccacatctgactccaagc

SEQ ID NO: 45424 - DNA, 20 bp, Artificial Sequence
  chemically synthesized
cccacatctgactccaagct

SEQ ID NO: 45425 - DNA, 20 bp, Artificial Sequence
  chemically synthesized
ccacatctgactccaagctg

SEQ ID NO: 45426 - DNA, 20 bp, Artificial Sequence
  chemically synthesized
cacatctgactccaagctgg

SEQ ID NO: 45427 - DNA, 20 bp, Artificial Sequence
  chemically synthesized
tgactccaagctgggggaca

SEQ ID NO: 45428 - DNA, 20 bp, Artificial Sequence
  chemically synthesized
agctgggggacacagaacct

SEQ ID NO: 45429 - DNA, 20 bp, Artificial Sequence
  chemically synthesized
ggggacacagaacctcagcc

SEQ ID NO: 45430 - DNA, 20 bp, Artificial Sequence
  chemically synthesized
acagaacctcagccaagtcc

SEQ ID NO: 45431 - DNA, 20 bp, Artificial Sequence
  chemically synthesized
cagaacctcagccaagtcct

SEQ ID NO: 45432 - DNA, 20 bp, Artificial Sequence
  chemically synthesized
acctcagccaagtcctgggc

SEQ ID NO: 45433 - DNA, 20 bp, Artificial Sequence
  chemically synthesized
agtcctgggctggtaatact

SEQ ID NO: 45434 - DNA, 20 bp, Artificial Sequence
  chemically synthesized
gggctggtaatacttagaaa

SEQ ID NO: 45435 - DNA, 20 bp, Artificial Sequence
  chemically synthesized
tggtaatacttagaaaaagc

SEQ ID NO: 45436 - DNA, 20 bp, Artificial Sequence
  chemically synthesized
taatacttagaaaaagctag

SEQ ID NO: 45437 - DNA, 20 bp, Artificial Sequence
  chemically synthesized
aaaagctagtggtctcgccc

SEQ ID NO: 45438 - DNA, 20 bp, Artificial Sequence
  chemically synthesized
aaagctagtggtctcgcccc

SEQ ID NO: 45439 - DNA, 20 bp, Artificial Sequence
  chemically synthesized
gctagtggtctcgccccggg

SEQ ID NO: 45440 - DNA, 20 bp, Artificial Sequence
  chemically synthesized
agtggtctcgccccgggaag

SEQ ID NO: 45441 - DNA, 20 bp, Artificial Sequence
  chemically synthesized
ccccgggaagaagcttccca

SEQ ID NO: 45442 - DNA, 20 bp, Artificial Sequence
  chemically synthesized
gaagaagcttcccacagcct

SEQ ID NO: 45443 - DNA, 20 bp, Artificial Sequence
  chemically synthesized
aagaagcttcccacagcctg

SEQ ID NO: 45444 - DNA, 20 bp, Artificial Sequence
  chemically synthesized
agaagcttcccacagcctga

SEQ ID NO: 45445 - DNA, 20 bp, Artificial Sequence
  chemically synthesized
gcttcccacagcctgagggc

SEQ ID NO: 45446 - DNA, 20 bp, Artificial Sequence
  chemically synthesized
tcccacagcctgagggccag

SEQ ID NO: 45447 - DNA, 20 bp, Artificial Sequence
  chemically synthesized
acagcctgagggccagaagc

SEQ ID NO: 45448 - DNA, 20 bp, Artificial Sequence
  chemically synthesized
gcctgagggccagaagctgg

SEQ ID NO: 45449 - DNA, 20 bp, Artificial Sequence
  chemically synthesized
ctgagggccagaagctggca

SEQ ID NO: 45450 - DNA, 20 bp, Artificial Sequence
  chemically synthesized
cagaagctggcagagttgtt

SEQ ID NO: 45451 - DNA, 20 bp, Artificial Sequence
  chemically synthesized
gagcaaactcgccccgcaca

SEQ ID NO: 45452 - DNA, 20 bp, Artificial Sequence
  chemically synthesized
aaactcgccccgcacacggt

SEQ ID NO: 45453 - DNA, 20 bp, Artificial Sequence
  chemically synthesized
ctcgccccgcacacggtcgg

SEQ ID NO: 45454 - DNA, 20 bp, Artificial Sequence
  chemically synthesized
ccccgcacacggtcggcaga

SEQ ID NO: 45455 - DNA, 20 bp, Artificial Sequence
  chemically synthesized
gcacacggtcggcagacagc

SEQ ID NO: 45456 - DNA, 20 bp, Artificial Sequence
  chemically synthesized
cacacggtcggcagacagcc

SEQ ID NO: 45457 - DNA, 20 bp, Artificial Sequence
  chemically synthesized
acggtcggcagacagccagg

SEQ ID NO: 45458 - DNA, 20 bp, Artificial Sequence
  chemically synthesized
cggtcggcagacagccaggt

SEQ ID NO: 45459 - DNA, 20 bp, Artificial Sequence
  chemically synthesized
ggcagacagccaggtgggct

SEQ ID NO: 45460 - DNA, 20 bp, Artificial Sequence
  chemically synthesized
gcagacagccaggtgggctg

SEQ ID NO: 45461 - DNA, 20 bp, Artificial Sequence
  chemically synthesized
agccaggtgggctgaggcgc

SEQ ID NO: 45462 - DNA, 20 bp, Artificial Sequence
  chemically synthesized
gccaggtgggctgaggcgcc

SEQ ID NO: 45463 - DNA, 20 bp, Artificial Sequence
  chemically synthesized
gtgggctgaggcgccgggct

SEQ ID NO: 45464 - DNA, 20 bp, Artificial Sequence
  chemically synthesized
tgaggcgccgggctcagctc

SEQ ID NO: 45465 - DNA, 20 bp, Artificial Sequence
  chemically synthesized
gaggcgccgggctcagctcc

SEQ ID NO: 45466 - DNA, 20 bp, Artificial Sequence
  chemically synthesized
aggcgccgggctcagctccg

SEQ ID NO: 45467 - DNA, 20 bp, Artificial Sequence
  chemically synthesized
cgggctcagctccggggtcc

SEQ ID NO: 45468 - DNA, 20 bp, Artificial Sequence
  chemically synthesized
cagctccggggtcccagtac

SEQ ID NO: 45469 - DNA, 20 bp, Artificial Sequence
  chemically synthesized
agctccggggtcccagtacc

SEQ ID NO: 45470 - DNA, 20 bp, Artificial Sequence
  chemically synthesized
agtaccaggcgcaccacctc

SEQ ID NO: 45471 - DNA, 20 bp, Artificial Sequence
  chemically synthesized
aggcgcaccacctccggctc

SEQ ID NO: 45472 - DNA, 20 bp, Artificial Sequence
  chemically synthesized
gcgcaccacctccggctcca

SEQ ID NO: 45473 - DNA, 20 bp, Artificial Sequence
  chemically synthesized
acctccggctccagagcacc

SEQ ID NO: 45474 - DNA, 20 bp, Artificial Sequence
  chemically synthesized
cctccggctccagagcacca

SEQ ID NO: 45475 - DNA, 20 bp, Artificial Sequence
  chemically synthesized
ctccggctccagagcaccaa

SEQ ID NO: 45476 - DNA, 20 bp, Artificial Sequence
  chemically synthesized
ccaagggcccttccctgcct

SEQ ID NO: 45477 - DNA, 20 bp, Artificial Sequence
  chemically synthesized
ccttccctgcctgagtccta

SEQ ID NO: 45478 - DNA, 20 bp, Artificial Sequence
  chemically synthesized
cttccctgcctgagtcctaa

SEQ ID NO: 45479 - DNA, 20 bp, Artificial Sequence
  chemically synthesized
tgagtcctaaaggacgccaa

SEQ ID NO: 45480 - DNA, 20 bp, Artificial Sequence
  chemically synthesized
gagtcctaaaggacgccaat

SEQ ID NO: 45481 - DNA, 20 bp, Artificial Sequence
  chemically synthesized
aaaggacgccaatgggcctc

SEQ ID NO: 45482 - DNA, 20 bp, Artificial Sequence
  chemically synthesized
ccccttctcccctgcccctt

SEQ ID NO: 45483 - DNA, 20 bp, Artificial Sequence
  chemically synthesized
ttctcccctgccccttcagc

SEQ ID NO: 45484 - DNA, 20 bp, Artificial Sequence
  chemically synthesized
cttcagctggttcttttctt

SEQ ID NO: 45485 - DNA, 20 bp, Artificial Sequence
  chemically synthesized
gttcttttcttcggctgaaa

SEQ ID NO: 45486 - DNA, 20 bp, Artificial Sequence
  chemically synthesized
ttttcttcggctgaaacaga

SEQ ID NO: 45487 - DNA, 20 bp, Artificial Sequence
  chemically synthesized
ggctgaaacagatggaatac

SEQ ID NO: 45488 - DNA, 20 bp, Artificial Sequence
  chemically synthesized
ctgaaacagatggaatacta

SEQ ID NO: 45489 - DNA, 20 bp, Artificial Sequence
  chemically synthesized
cagatggaatactagagcat

SEQ ID NO: 45490 - DNA, 20 bp, Artificial Sequence
  chemically synthesized
agcatgagttctgtgtcata

SEQ ID NO: 45491 - DNA, 20 bp, Artificial Sequence
  chemically synthesized
aagaaattgcctcgtgctcc

SEQ ID NO: 45492 - DNA, 20 bp, Artificial Sequence
  chemically synthesized
ttcccaccccgcccctgtct

SEQ ID NO: 45493 - DNA, 20 bp, Artificial Sequence
  chemically synthesized
tcccaccccgcccctgtctc

SEQ ID NO: 45494 - DNA, 20 bp, Artificial Sequence
  chemically synthesized
caccccgcccctgtctcggg

SEQ ID NO: 45495 - DNA, 20 bp, Artificial Sequence
  chemically synthesized
accccgcccctgtctcgggt

SEQ ID NO: 45496 - DNA, 20 bp, Artificial Sequence
  chemically synthesized
ccccgcccctgtctcgggta

SEQ ID NO: 45497 - DNA, 20 bp, Artificial Sequence
  chemically synthesized
ctcgggtagggccttctctc

SEQ ID NO: 45498 - DNA, 20 bp, Artificial Sequence
  chemically synthesized
tcgggtagggccttctctcc

SEQ ID NO: 45499 - DNA, 20 bp, Artificial Sequence
  chemically synthesized
ccatgttttccaaaccaaat

SEQ ID NO: 45500 - DNA, 20 bp, Artificial Sequence
  chemically synthesized
caaatcggaacccactataa

SEQ ID NO: 45501 - DNA, 20 bp, Artificial Sequence
  chemically synthesized
tcggaacccactataatggc

SEQ ID NO: 45502 - DNA, 20 bp, Artificial Sequence
  chemically synthesized
aagcccgctttctctgtgcc

SEQ ID NO: 45503 - DNA, 20 bp, Artificial Sequence
  chemically synthesized
cgctttctctgtgcctggtg

SEQ ID NO: 45504 - DNA, 20 bp, Artificial Sequence
  chemically synthesized
tctgtgcctggtgcagttcc

SEQ ID NO: 45505 - DNA, 20 bp, Artificial Sequence
  chemically synthesized
gtgcagttcccagtacgttc

SEQ ID NO: 45506 - DNA, 20 bp, Artificial Sequence
  chemically synthesized
tgcagttcccagtacgttcc

SEQ ID NO: 45507 - DNA, 20 bp, Artificial Sequence
  chemically synthesized
tccttcacccacctgtgccg

SEQ ID NO: 45508 - DNA, 20 bp, Artificial Sequence
  chemically synthesized
tcacccacctgtgccgcggc

SEQ ID NO: 45509 - DNA, 20 bp, Artificial Sequence
  chemically synthesized
cacccacctgtgccgcggcg

SEQ ID NO: 45510 - DNA, 20 bp, Artificial Sequence
  chemically synthesized
ccacctgtgccgcggcgagg

SEQ ID NO: 45511 - DNA, 20 bp, Artificial Sequence
  chemically synthesized
tgccgcggcgaggcagaaac

SEQ ID NO: 45512 - DNA, 20 bp, Artificial Sequence
  chemically synthesized
gccgcggcgaggcagaaact

SEQ ID NO: 45513 - DNA, 20 bp, Artificial Sequence
  chemically synthesized
gaggcagaaactgggaaatc

SEQ ID NO: 45514 - DNA, 20 bp, Artificial Sequence
  chemically synthesized
aggcagaaactgggaaatct

SEQ ID NO: 45515 - DNA, 20 bp, Artificial Sequence
  chemically synthesized
cagaaactgggaaatctggg

SEQ ID NO: 45516 - DNA, 20 bp, Artificial Sequence
  chemically synthesized
agaaactgggaaatctgggc

SEQ ID NO: 45517 - DNA, 20 bp, Artificial Sequence
  chemically synthesized
gaaatctgggcaggatatcc

SEQ ID NO: 45518 - DNA, 20 bp, Artificial Sequence
  chemically synthesized
atctgggcaggatatcctgg

SEQ ID NO: 45519 - DNA, 20 bp, Artificial Sequence
  chemically synthesized
gtgctctgctcgcccttcct

SEQ ID NO: 45520 - DNA, 20 bp, Artificial Sequence
  chemically synthesized
gctcgcccttcctcggcctc

SEQ ID NO: 45521 - DNA, 20 bp, Artificial Sequence
  chemically synthesized
ctcgcccttcctcggcctcc

SEQ ID NO: 45522 - DNA, 20 bp, Artificial Sequence
  chemically synthesized
ccgcgaaccttcccactgaa

SEQ ID NO: 45523 - DNA, 20 bp, Artificial Sequence
  chemically synthesized
aaccttcccactgaatagcg

SEQ ID NO: 45524 - DNA, 20 bp, Artificial Sequence
  chemically synthesized
aatagcgcagccgcacgccc

SEQ ID NO: 45525 - DNA, 20 bp, Artificial Sequence
  chemically synthesized
gcgcagccgcacgccccagc

SEQ ID NO: 45526 - DNA, 20 bp, Artificial Sequence
  chemically synthesized
cacgccccagcaagtcccca

SEQ ID NO: 45527 - DNA, 20 bp, Artificial Sequence
  chemically synthesized
cgccccagcaagtccccaaa

SEQ ID NO: 45528 - DNA, 20 bp, Artificial Sequence
  chemically synthesized
ccagcaagtccccaaagagc

SEQ ID NO: 45529 - DNA, 20 bp, Artificial Sequence
  chemically synthesized
ctcccccgccgccttgcctg

SEQ ID NO: 45530 - DNA, 20 bp, Artificial Sequence
  chemically synthesized
ccgccttgcctgcagtcccc

SEQ ID NO: 45531 - DNA, 20 bp, Artificial Sequence
  chemically synthesized
gcagtccccaagatcgtgcc

SEQ ID NO: 45532 - DNA, 20 bp, Artificial Sequence
  chemically synthesized
ccccaagatcgtgccaagcg

SEQ ID NO: 45533 - DNA, 20 bp, Artificial Sequence
  chemically synthesized
ccaagatcgtgccaagcgaa

SEQ ID NO: 45534 - DNA, 20 bp, Artificial Sequence
  chemically synthesized
cgtgccaagcgaagagccct

SEQ ID NO: 45535 - DNA, 20 bp, Artificial Sequence
  chemically synthesized
actccacttcctctcttaca

SEQ ID NO: 45536 - DNA, 20 bp, Artificial Sequence
  chemically synthesized
ctccacttcctctcttacat

SEQ ID NO: 45537 - DNA, 20 bp, Artificial Sequence
  chemically synthesized
tccacttcctctcttacatg

SEQ ID NO: 45538 - DNA, 20 bp, Artificial Sequence
  chemically synthesized
ccacttcctctcttacatgg

SEQ ID NO: 45539 - DNA, 20 bp, Artificial Sequence
  chemically synthesized
cacttcctctcttacatggg

SEQ ID NO: 45540 - DNA, 20 bp, Artificial Sequence
  chemically synthesized
ctcttacatggggggaaact

SEQ ID NO: 45541 - DNA, 20 bp, Artificial Sequence
  chemically synthesized
tcttacatggggggaaactg

SEQ ID NO: 45542 - DNA, 20 bp, Artificial Sequence
  chemically synthesized
atggggggaaactgaggccc

SEQ ID NO: 45543 - DNA, 20 bp, Artificial Sequence
  chemically synthesized
ggggggaaactgaggcccga

SEQ ID NO: 45544 - DNA, 20 bp, Artificial Sequence
  chemically synthesized
gggggaaactgaggcccgag

SEQ ID NO: 45545 - DNA, 20 bp, Artificial Sequence
  chemically synthesized
aactgaggcccgagaggaaa

SEQ ID NO: 45546 - DNA, 20 bp, Artificial Sequence
  chemically synthesized
gaaacagcaccgcaccgtcc

SEQ ID NO: 45547 - DNA, 20 bp, Artificial Sequence
  chemically synthesized
gcaccgcaccgtcccggctg

SEQ ID NO: 45548 - DNA, 20 bp, Artificial Sequence
  chemically synthesized
caccgcaccgtcccggctgc

SEQ ID NO: 45549 - DNA, 20 bp, Artificial Sequence
  chemically synthesized
tcccggctgcgggttcgccc

SEQ ID NO: 45550 - DNA, 20 bp, Artificial Sequence
  chemically synthesized
ccatccctacacccgcacct

SEQ ID NO: 45551 - DNA, 20 bp, Artificial Sequence
  chemically synthesized
cctacacccgcaccttggcg

SEQ ID NO: 45552 - DNA, 20 bp, Artificial Sequence
  chemically synthesized
acacccgcaccttggcgcag

SEQ ID NO: 45553 - DNA, 20 bp, Artificial Sequence
  chemically synthesized
cccgcaccttggcgcagcgg

SEQ ID NO: 45554 - DNA, 20 bp, Artificial Sequence
  chemically synthesized
gcaccttggcgcagcggtgg

SEQ ID NO: 45555 - DNA, 20 bp, Artificial Sequence
  chemically synthesized
caccttggcgcagcggtgga

SEQ ID NO: 45556 - DNA, 20 bp, Artificial Sequence
  chemically synthesized
cttggcgcagcggtggaagg

SEQ ID NO: 45557 - DNA, 20 bp, Artificial Sequence
  chemically synthesized
gcagcggtggaaggtggctg

SEQ ID NO: 45558 - DNA, 20 bp, Artificial Sequence
  chemically synthesized
ggtggctgtggttccgtgct

SEQ ID NO: 45559 - DNA, 20 bp, Artificial Sequence
  chemically synthesized
gtggctgtggttccgtgctc

SEQ ID NO: 45560 - DNA, 20 bp, Artificial Sequence
  chemically synthesized
ggttccgtgctcgggtgctt

SEQ ID NO: 45561 - DNA, 20 bp, Artificial Sequence
  chemically synthesized
ccgtgctcgggtgcttcggc

SEQ ID NO: 45562 - DNA, 20 bp, Artificial Sequence
  chemically synthesized
cgtgctcgggtgcttcggcc

SEQ ID NO: 45563 - DNA, 20 bp, Artificial Sequence
  chemically synthesized
ttcggccaggccgtcctcct

SEQ ID NO: 45564 - DNA, 20 bp, Artificial Sequence
  chemically synthesized
ggccgtcctcctcggaacgc

SEQ ID NO: 45565 - DNA, 20 bp, Artificial Sequence
  chemically synthesized
gccgtcctcctcggaacgca

SEQ ID NO: 45566 - DNA, 20 bp, Artificial Sequence
  chemically synthesized
tcctcctcggaacgcaaggc

SEQ ID NO: 45567 - DNA, 20 bp, Artificial Sequence
  chemically synthesized
tcggaacgcaaggctagcac

SEQ ID NO: 45568 - DNA, 20 bp, Artificial Sequence
  chemically synthesized
aggctagcaccagctcctcg

SEQ ID NO: 45569 - DNA, 20 bp, Artificial Sequence
  chemically synthesized
cgtcctcgtcctcctgcgca

SEQ ID NO: 45570 - DNA, 20 bp, Artificial Sequence
  chemically synthesized
gtcctcgtcctcctgcgcac

SEQ ID NO: 45571 - DNA, 20 bp, Artificial Sequence
  chemically synthesized
ctcctgcgcacgggcgcccg

SEQ ID NO: 45572 - DNA, 20 bp, Artificial Sequence
  chemically synthesized
tcctgcgcacgggcgcccgc

SEQ ID NO: 45573 - DNA, 20 bp, Artificial Sequence
  chemically synthesized
gcacgggcgcccgcgggacc

SEQ ID NO: 45574 - DNA, 20 bp, Artificial Sequence
  chemically synthesized
cacgggcgcccgcgggaccc

SEQ ID NO: 45575 - DNA, 20 bp, Artificial Sequence
  chemically synthesized
cgggcgcccgcgggacccag

SEQ ID NO: 45576 - DNA, 20 bp, Artificial Sequence
  chemically synthesized
gcgcccgcgggacccaggag

SEQ ID NO: 45577 - DNA, 20 bp, Artificial Sequence
  chemically synthesized
cccgcgggacccaggagcag

SEQ ID NO: 45578 - DNA, 20 bp, Artificial Sequence
  chemically synthesized
gcgggacccaggagcagcag

SEQ ID NO: 45579 - DNA, 20 bp, Artificial Sequence
  chemically synthesized
ggacccaggagcagcagcag

SEQ ID NO: 45580 - DNA, 20 bp, Artificial Sequence
  chemically synthesized
cccaggagcagcagcagcag

SEQ ID NO: 45581 - DNA, 20 bp, Artificial Sequence
  chemically synthesized
aggagcagcagcagcagcag

SEQ ID NO: 45582 - DNA, 20 bp, Artificial Sequence
  chemically synthesized
agcagcagcagcagcagcag

SEQ ID NO: 45583 - DNA, 20 bp, Artificial Sequence
  chemically synthesized
agcagcagcagcagcagcag

SEQ ID NO: 45584 - DNA, 20 bp, Artificial Sequence
  chemically synthesized
agcagcagcagcagcagtgg

SEQ ID NO: 45585 - DNA, 20 bp, Artificial Sequence
  chemically synthesized
agcagcagcagcagtggcag

SEQ ID NO: 45586 - DNA, 20 bp, Artificial Sequence
  chemically synthesized
gcagcagtggcagcggccac

SEQ ID NO: 45587 - DNA, 20 bp, Artificial Sequence
  chemically synthesized
cagcagtggcagcggccacc

SEQ ID NO: 45588 - DNA, 20 bp, Artificial Sequence
  chemically synthesized
cagcggccaccaggaccgcc

SEQ ID NO: 45589 - DNA, 20 bp, Artificial Sequence
  chemically synthesized
gcggccaccaggaccgcctg

SEQ ID NO: 45590 - DNA, 20 bp, Artificial Sequence
  chemically synthesized
ccaggaccgcctggagctga

SEQ ID NO: 45591 - DNA, 20 bp, Artificial Sequence
  chemically synthesized
ctggagctgacggtgcccat

SEQ ID NO: 45592 - DNA, 20 bp, Artificial Sequence
  chemically synthesized
tggagctgacggtgcccatg

SEQ ID NO: 45593 - DNA, 20 bp, Artificial Sequence
  chemically synthesized
ggagctgacggtgcccatga

SEQ ID NO: 45594 - DNA, 20 bp, Artificial Sequence
  chemically synthesized
ctgacggtgcccatgagggc

SEQ ID NO: 45595 - DNA, 20 bp, Artificial Sequence
  chemically synthesized
tgacggtgcccatgagggcc

SEQ ID NO: 45596 - DNA, 20 bp, Artificial Sequence
  chemically synthesized
gacggtgcccatgagggcca

SEQ ID NO: 45597 - DNA, 20 bp, Artificial Sequence
  chemically synthesized
acggtgcccatgagggccag

SEQ ID NO: 45598 - DNA, 20 bp, Artificial Sequence
  chemically synthesized
ggtgcccatgagggccaggg

SEQ ID NO: 45599 - DNA, 20 bp, Artificial Sequence
  chemically synthesized
tgcccatgagggccagggga

SEQ ID NO: 45600 - DNA, 20 bp, Artificial Sequence
  chemically synthesized
gcccatgagggccaggggag

SEQ ID NO: 45601 - DNA, 20 bp, Artificial Sequence
  chemically synthesized
caggggagaggttgctgtcc

SEQ ID NO: 45602 - DNA, 20 bp, Artificial Sequence
  chemically synthesized
ggagaggttgctgtcctggc

SEQ ID NO: 45603 - DNA, 20 bp, Artificial Sequence
  chemically synthesized
gagaggttgctgtcctggcg

SEQ ID NO: 45604 - DNA, 20 bp, Artificial Sequence
  chemically synthesized
gaggttgctgtcctggcgag

SEQ ID NO: 45605 - DNA, 20 bp, Artificial Sequence
  chemically synthesized
gctgtcctggcgaggagacc

SEQ ID NO: 45606 - DNA, 20 bp, Artificial Sequence
  chemically synthesized
tgtcctggcgaggagaccta

SEQ ID NO: 45607 - DNA, 20 bp, Artificial Sequence
  chemically synthesized
gtcctggcgaggagacctag

SEQ ID NO: 45608 - DNA, 20 bp, Artificial Sequence
  chemically synthesized
ggagacctagaggccgtgcg

SEQ ID NO: 45609 - DNA, 20 bp, Artificial Sequence
  chemically synthesized
aggccgtgcgcggtccacgc

SEQ ID NO: 45610 - DNA, 20 bp, Artificial Sequence
  chemically synthesized
ccgtgcgcggtccacgccgg

SEQ ID NO: 45611 - DNA, 20 bp, Artificial Sequence
  chemically synthesized
gtccacgccggcggcgcctt

SEQ ID NO: 45612 - DNA, 20 bp, Artificial Sequence
  chemically synthesized
cggcggcgccttgagccttg

SEQ ID NO: 45613 - DNA, 20 bp, Artificial Sequence
  chemically synthesized
cggcgccttgagccttgcgg

SEQ ID NO: 45614 - DNA, 20 bp, Artificial Sequence
  chemically synthesized
ggcgccttgagccttgcggt

SEQ ID NO: 45615 - DNA, 20 bp, Artificial Sequence
  chemically synthesized
gcgccttgagccttgcggtg

SEQ ID NO: 45616 - DNA, 20 bp, Artificial Sequence
  chemically synthesized
gccttgagccttgcggtggg

SEQ ID NO: 45617 - DNA, 20 bp, Artificial Sequence
  chemically synthesized
ccttgagccttgcggtgggg

SEQ ID NO: 45618 - DNA, 20 bp, Artificial Sequence
  chemically synthesized
ttgcggtggggaggactgtg

SEQ ID NO: 45619 - DNA, 20 bp, Artificial Sequence
  chemically synthesized
tgcggtggggaggactgtgc

SEQ ID NO: 45620 - DNA, 20 bp, Artificial Sequence
  chemically synthesized
cggtggggaggactgtgcag

SEQ ID NO: 45621 - DNA, 20 bp, Artificial Sequence
  chemically synthesized
ggaggactgtgcaggagctg

SEQ ID NO: 45622 - DNA, 20 bp, Artificial Sequence
  chemically synthesized
actgtgcaggagctgaagtt

SEQ ID NO: 45623 - DNA, 20 bp, Artificial Sequence
  chemically synthesized
ctgtgcaggagctgaagttc

SEQ ID NO: 45624 - DNA, 20 bp, Artificial Sequence
  chemically synthesized
gtgcaggagctgaagttcag

SEQ ID NO: 45625 - DNA, 20 bp, Artificial Sequence
  chemically synthesized
caggagctgaagttcaggag

SEQ ID NO: 45626 - DNA, 20 bp, Artificial Sequence
  chemically synthesized
aggagctgaagttcaggagc

SEQ ID NO: 45627 - DNA, 20 bp, Artificial Sequence
  chemically synthesized
ggagctgaagttcaggagca

SEQ ID NO: 45628 - DNA, 20 bp, Artificial Sequence
  chemically synthesized
gttcaggagcagggcgcgtg

SEQ ID NO: 45629 - DNA, 20 bp, Artificial Sequence
  chemically synthesized
ttcaggagcagggcgcgtga

SEQ ID NO: 45630 - DNA, 20 bp, Artificial Sequence
  chemically synthesized
tcaggagcagggcgcgtgaa

SEQ ID NO: 45631 - DNA, 20 bp, Artificial Sequence
  chemically synthesized
caggagcagggcgcgtgaag

SEQ ID NO: 45632 - DNA, 20 bp, Artificial Sequence
  chemically synthesized
agggcgcgtgaaggggcgcg

SEQ ID NO: 45633 - DNA, 20 bp, Artificial Sequence
  chemically synthesized
tgaaggggcgcgcggaatcc

SEQ ID NO: 45634 - DNA, 20 bp, Artificial Sequence
  chemically synthesized
ggggcgcgcggaatcctggc

SEQ ID NO: 45635 - DNA, 20 bp, Artificial Sequence
  chemically synthesized
gggcgcgcggaatcctggct

SEQ ID NO: 45636 - DNA, 20 bp, Artificial Sequence
  chemically synthesized
gcgcgcggaatcctggctgg

SEQ ID NO: 45637 - DNA, 20 bp, Artificial Sequence
  chemically synthesized
gcggaatcctggctgggagc

SEQ ID NO: 45638 - DNA, 20 bp, Artificial Sequence
  chemically synthesized
cggaatcctggctgggagct

SEQ ID NO: 45639 - DNA, 20 bp, Artificial Sequence
  chemically synthesized
gaatcctggctgggagctgg

SEQ ID NO: 45640 - DNA, 20 bp, Artificial Sequence
  chemically synthesized
gctgctgcaacgacgcgtcc

SEQ ID NO: 45641 - DNA, 20 bp, Artificial Sequence
  chemically synthesized
cgacgcgtcccggcccgccc

SEQ ID NO: 45642 - DNA, 20 bp, Artificial Sequence
  chemically synthesized
gcgtcccggcccgcccgagc

SEQ ID NO: 45643 - DNA, 20 bp, Artificial Sequence
  chemically synthesized
cccgagccagtctcactgcc

SEQ ID NO: 45644 - DNA, 20 bp, Artificial Sequence
  chemically synthesized
cactgcctggctcactcctc

SEQ ID NO: 45645 - DNA, 20 bp, Artificial Sequence
  chemically synthesized
actgcctggctcactcctcc

SEQ ID NO: 45646 - DNA, 20 bp, Artificial Sequence
  chemically synthesized
ctggctcactcctccaggct

SEQ ID NO: 45647 - DNA, 20 bp, Artificial Sequence
  chemically synthesized
ggctcagaccctgaactgaa

SEQ ID NO: 45648 - DNA, 20 bp, Artificial Sequence
  chemically synthesized
tcagaccctgaactgaacgg

SEQ ID NO: 45649 - DNA, 20 bp, Artificial Sequence
  chemically synthesized
cggcgcccgcctgcaaccat

SEQ ID NO: 45650 - DNA, 20 bp, Artificial Sequence
  chemically synthesized
tgagcgcctcgacgtcgctg

SEQ ID NO: 45651 - DNA, 20 bp, Artificial Sequence
  chemically synthesized
acgtcgctgcggaaaccttc

SEQ ID NO: 45652 - DNA, 20 bp, Artificial Sequence
  chemically synthesized
cgtcgctgcggaaaccttct

SEQ ID NO: 45653 - DNA, 20 bp, Artificial Sequence
  chemically synthesized
gtcgctgcggaaaccttcta

SEQ ID NO: 45654 - DNA, 20 bp, Artificial Sequence
  chemically synthesized
tgcggaaaccttctagggtg

SEQ ID NO: 45655 - DNA, 20 bp, Artificial Sequence
  chemically synthesized
gcggaaaccttctagggtgt

SEQ ID NO: 45656 - DNA, 20 bp, Artificial Sequence
  chemically synthesized
gggtgtgggtgcttgacgcc

SEQ ID NO: 45657 - DNA, 20 bp, Artificial Sequence
  chemically synthesized
ggtgtgggtgcttgacgcct

SEQ ID NO: 45658 - DNA, 20 bp, Artificial Sequence
  chemically synthesized
gtgtgggtgcttgacgcctg

SEQ ID NO: 45659 - DNA, 20 bp, Artificial Sequence
  chemically synthesized
tgcttgacgcctggggcgcg

SEQ ID NO: 45660 - DNA, 20 bp, Artificial Sequence
  chemically synthesized
gggcgcgcagatcacgccac

SEQ ID NO: 45661 - DNA, 20 bp, Artificial Sequence
  chemically synthesized
gcgcgcagatcacgccacca

SEQ ID NO: 45662 - DNA, 20 bp, Artificial Sequence
  chemically synthesized
tcacgccaccagagccccat

SEQ ID NO: 45663 - DNA, 20 bp, Artificial Sequence
  chemically synthesized
cctatctgattaaacattaa

SEQ ID NO: 45664 - DNA, 20 bp, Artificial Sequence
  chemically synthesized
ttaaacattaacggaacccc

SEQ ID NO: 45665 - DNA, 20 bp, Artificial Sequence
  chemically synthesized
cattaacggaacccccggac

SEQ ID NO: 45666 - DNA, 20 bp, Artificial Sequence
  chemically synthesized
ttaacggaacccccggactg

SEQ ID NO: 45667 - DNA, 20 bp, Artificial Sequence
  chemically synthesized
taacggaacccccggactgg

SEQ ID NO: 45668 - DNA, 20 bp, Artificial Sequence
  chemically synthesized
gaacccccggactggaggat

SEQ ID NO: 45669 - DNA, 20 bp, Artificial Sequence
  chemically synthesized
aacccccggactggaggatc

SEQ ID NO: 45670 - DNA, 20 bp, Artificial Sequence
  chemically synthesized
cggactggaggatcaggttt

SEQ ID NO: 45671 - DNA, 20 bp, Artificial Sequence
  chemically synthesized
tcggcctcgccctccccaaa

SEQ ID NO: 45672 - DNA, 20 bp, Artificial Sequence
  chemically synthesized
tcgccctccccaaacagcgt

SEQ ID NO: 45673 - DNA, 20 bp, Artificial Sequence
  chemically synthesized
aaacagcgtcagattacgcg

SEQ ID NO: 45674 - DNA, 20 bp, Artificial Sequence
  chemically synthesized
acagcgtcagattacgcgca

SEQ ID NO: 45675 - DNA, 20 bp, Artificial Sequence
  chemically synthesized
cagcgtcagattacgcgcag

SEQ ID NO: 45676 - DNA, 20 bp, Artificial Sequence
  chemically synthesized
agcgtcagattacgcgcaga

SEQ ID NO: 45677 - DNA, 20 bp, Artificial Sequence
  chemically synthesized
gtcagattacgcgcagaggg

SEQ ID NO: 45678 - DNA, 20 bp, Artificial Sequence
  chemically synthesized
aaaaactcccaaatcctaac

SEQ ID NO: 45679 - DNA, 20 bp, Artificial Sequence
  chemically synthesized
aaaactcccaaatcctaact

SEQ ID NO: 45680 - DNA, 20 bp, Artificial Sequence
  chemically synthesized
ctcccaaatcctaactgggc

SEQ ID NO: 45681 - DNA, 20 bp, Artificial Sequence
  chemically synthesized
ccaaatcctaactgggctgg

SEQ ID NO: 45682 - DNA, 20 bp, Artificial Sequence
  chemically synthesized
caaatcctaactgggctgga

SEQ ID NO: 45683 - DNA, 20 bp, Artificial Sequence
  chemically synthesized
atcctaactgggctggaagg

SEQ ID NO: 45684 - DNA, 20 bp, Artificial Sequence
  chemically synthesized
tcctaactgggctggaaggc

SEQ ID NO: 45685 - DNA, 20 bp, Artificial Sequence
  chemically synthesized
aactgggctggaaggcaggc

SEQ ID NO: 45686 - DNA, 20 bp, Artificial Sequence
  chemically synthesized
tggaaggcaggccggcgccc

SEQ ID NO: 45687 - DNA, 20 bp, Artificial Sequence
  chemically synthesized
ggaaggcaggccggcgccct

SEQ ID NO: 45688 - DNA, 20 bp, Artificial Sequence
  chemically synthesized
gaaggcaggccggcgcccta

SEQ ID NO: 45689 - DNA, 20 bp, Artificial Sequence
  chemically synthesized
aaggcaggccggcgccctag

SEQ ID NO: 45690 - DNA, 20 bp, Artificial Sequence
  chemically synthesized
ctcccgcctctcaccctgcg

SEQ ID NO: 45691 - DNA, 20 bp, Artificial Sequence
  chemically synthesized
tcccgcctctcaccctgcgt

SEQ ID NO: 45692 - DNA, 20 bp, Artificial Sequence
  chemically synthesized
tctcaccctgcgtgggatgc

SEQ ID NO: 45693 - DNA, 20 bp, Artificial Sequence
  chemically synthesized
tgcgtgggatgccagactcc

SEQ ID NO: 45694 - DNA, 20 bp, Artificial Sequence
  chemically synthesized
tgccagactccaagttctgc

SEQ ID NO: 45695 - DNA, 20 bp, Artificial Sequence
  chemically synthesized
gccagactccaagttctgcc

SEQ ID NO: 45696 - DNA, 20 bp, Artificial Sequence
  chemically synthesized
ttctgccgggcccacctttt

SEQ ID NO: 45697 - DNA, 20 bp, Artificial Sequence
  chemically synthesized
cccaccttttcagtgtttcc

SEQ ID NO: 45698 - DNA, 20 bp, Artificial Sequence
  chemically synthesized
ccaccttttcagtgtttcct

SEQ ID NO: 45699 - DNA, 20 bp, Artificial Sequence
  chemically synthesized
ccaccttgtctcctgctgac

SEQ ID NO: 45700 - DNA, 20 bp, Artificial Sequence
  chemically synthesized
cttgtctcctgctgaccagt

SEQ ID NO: 45701 - DNA, 20 bp, Artificial Sequence
  chemically synthesized
cttctgaatcaatcctactg

SEQ ID NO: 45702 - DNA, 20 bp, Artificial Sequence
  chemically synthesized
gcccaccgaattctttccac

SEQ ID NO: 45703 - DNA, 20 bp, Artificial Sequence
  chemically synthesized
tctttccactggccttaacc

SEQ ID NO: 45704 - DNA, 20 bp, Artificial Sequence
  chemically synthesized
ttccactggccttaacctgg

SEQ ID NO: 45705 - DNA, 20 bp, Artificial Sequence
  chemically synthesized
acctggcagccttctaaact

SEQ ID NO: 45706 - DNA, 20 bp, Artificial Sequence
  chemically synthesized
gcagccttctaaacttagcc

SEQ ID NO: 45707 - DNA, 20 bp, Artificial Sequence
  chemically synthesized
aacttagcctggaccccctc

SEQ ID NO: 45708 - DNA, 20 bp, Artificial Sequence
  chemically synthesized
tgcacactgaccttaccaac

SEQ ID NO: 45709 - DNA, 20 bp, Artificial Sequence
  chemically synthesized
taccaactagctgctccttg

SEQ ID NO: 45710 - DNA, 20 bp, Artificial Sequence
  chemically synthesized
ccaactagctgctccttgaa

SEQ ID NO: 45711 - DNA, 20 bp, Artificial Sequence
  chemically synthesized
gattgcttgcttttgatgtc

SEQ ID NO: 45712 - DNA, 20 bp, Artificial Sequence
  chemically synthesized
gtccagcctacatgcatttc

SEQ ID NO: 45713 - DNA, 20 bp, Artificial Sequence
  chemically synthesized
tccagcctacatgcatttca

SEQ ID NO: 45714 - DNA, 20 bp, Artificial Sequence
  chemically synthesized
ccagcctacatgcatttcaa

SEQ ID NO: 45715 - DNA, 20 bp, Artificial Sequence
  chemically synthesized
ttcaagggatttatactaca

SEQ ID NO: 45716 - DNA, 20 bp, Artificial Sequence
  chemically synthesized
ggatttatactacaaagatt

SEQ ID NO: 45717 - DNA, 20 bp, Artificial Sequence
  chemically synthesized
gatttatactacaaagattc

SEQ ID NO: 45718 - DNA, 20 bp, Artificial Sequence
  chemically synthesized
actacaaagattcaggtttt

SEQ ID NO: 45719 - DNA, 20 bp, Artificial Sequence
  chemically synthesized
attcaggttttaagtttgca

SEQ ID NO: 45720 - DNA, 20 bp, Artificial Sequence
  chemically synthesized
aagtttgcaaagacgtcata

SEQ ID NO: 45721 - DNA, 20 bp, Artificial Sequence
  chemically synthesized
agtttgcaaagacgtcatat

SEQ ID NO: 45722 - DNA, 20 bp, Artificial Sequence
  chemically synthesized
agacgtcatataggtacatt

SEQ ID NO: 45723 - DNA, 20 bp, Artificial Sequence
  chemically synthesized
taggtacattcagaattcta

SEQ ID NO: 45724 - DNA, 20 bp, Artificial Sequence
  chemically synthesized
gtacattcagaattctatgg

SEQ ID NO: 45725 - DNA, 20 bp, Artificial Sequence
  chemically synthesized
tacattcagaattctatggt

SEQ ID NO: 45726 - DNA, 20 bp, Artificial Sequence
  chemically synthesized
cagaattctatggtaggcac

SEQ ID NO: 45727 - DNA, 20 bp, Artificial Sequence
  chemically synthesized
ttctatggtaggcacaagct

SEQ ID NO: 45728 - DNA, 20 bp, Artificial Sequence
  chemically synthesized
taggcacaagctcagctttc

SEQ ID NO: 45729 - DNA, 20 bp, Artificial Sequence
  chemically synthesized
gcacaagctcagctttccag

SEQ ID NO: 45730 - DNA, 20 bp, Artificial Sequence
  chemically synthesized
tccagaagattcaatttgca

SEQ ID NO: 45731 - DNA, 20 bp, Artificial Sequence
  chemically synthesized
tccttttacacaccatgttc

SEQ ID NO: 45732 - DNA, 20 bp, Artificial Sequence
  chemically synthesized
accatgttcaagaaatcaac

SEQ ID NO: 45733 - DNA, 20 bp, Artificial Sequence
  chemically synthesized
gttcaagaaatcaactggac

SEQ ID NO: 45734 - DNA, 20 bp, Artificial Sequence
  chemically synthesized
aaatcaactggacaagcatc

SEQ ID NO: 45735 - DNA, 20 bp, Artificial Sequence
  chemically synthesized
agtaaacacctattgtgtac

SEQ ID NO: 45736 - DNA, 20 bp, Artificial Sequence
  chemically synthesized
gtaaacacctattgtgtacc

SEQ ID NO: 45737 - DNA, 20 bp, Artificial Sequence
  chemically synthesized
aacacctattgtgtaccagg

SEQ ID NO: 45738 - DNA, 20 bp, Artificial Sequence
  chemically synthesized
acacctattgtgtaccaggc

SEQ ID NO: 45739 - DNA, 20 bp, Artificial Sequence
  chemically synthesized
acctattgtgtaccaggcag

SEQ ID NO: 45740 - DNA, 20 bp, Artificial Sequence
  chemically synthesized
cctattgtgtaccaggcagg

SEQ ID NO: 45741 - DNA, 20 bp, Artificial Sequence
  chemically synthesized
gtaccaggcaggaggatgaa

SEQ ID NO: 45742 - DNA, 20 bp, Artificial Sequence
  chemically synthesized
taccaggcaggaggatgaaa

SEQ ID NO: 45743 - DNA, 20 bp, Artificial Sequence
  chemically synthesized
accaggcaggaggatgaaaa

SEQ ID NO: 45744 - DNA, 20 bp, Artificial Sequence
  chemically synthesized
ccaggcaggaggatgaaaag

SEQ ID NO: 45745 - DNA, 20 bp, Artificial Sequence
  chemically synthesized
gcaggaggatgaaaagggga

SEQ ID NO: 45746 - DNA, 20 bp, Artificial Sequence
  chemically synthesized
aggaggatgaaaaggggaaa

SEQ ID NO: 45747 - DNA, 20 bp, Artificial Sequence
  chemically synthesized
gaggatgaaaaggggaaaga

SEQ ID NO: 45748 - DNA, 20 bp, Artificial Sequence
  chemically synthesized
aaaaggggaaagagagctcc

SEQ ID NO: 45749 - DNA, 20 bp, Artificial Sequence
  chemically synthesized
ggaaagagagctcctggcct

SEQ ID NO: 45750 - DNA, 20 bp, Artificial Sequence
  chemically synthesized
ctggcctcagattgtacatg

SEQ ID NO: 45751 - DNA, 20 bp, Artificial Sequence
  chemically synthesized
ttgtacatgtggcatgacat

SEQ ID NO: 45752 - DNA, 20 bp, Artificial Sequence
  chemically synthesized
tgtacatgtggcatgacatg

SEQ ID NO: 45753 - DNA, 20 bp, Artificial Sequence
  chemically synthesized
gacatgaggcttgctctttc

SEQ ID NO: 45754 - DNA, 20 bp, Artificial Sequence
  chemically synthesized
atgaggcttgctctttctgg

SEQ ID NO: 45755 - DNA, 20 bp, Artificial Sequence
  chemically synthesized
tgaggcttgctctttctgga

SEQ ID NO: 45756 - DNA, 20 bp, Artificial Sequence
  chemically synthesized
gaggcttgctctttctggaa

SEQ ID NO: 45757 - DNA, 20 bp, Artificial Sequence
  chemically synthesized
tctggaagggctgtcgatac

SEQ ID NO: 45758 - DNA, 20 bp, Artificial Sequence
  chemically synthesized
ctggaagggctgtcgatact

SEQ ID NO: 45759 - DNA, 20 bp, Artificial Sequence
  chemically synthesized
gaagggctgtcgatactggg

SEQ ID NO: 45760 - DNA, 20 bp, Artificial Sequence
  chemically synthesized
gtcgatactgggaagaaaca

SEQ ID NO: 45761 - DNA, 20 bp, Artificial Sequence
  chemically synthesized
tcgatactgggaagaaacaa

SEQ ID NO: 45762 - DNA, 20 bp, Artificial Sequence
  chemically synthesized
gaatttatgatcctcccttg

SEQ ID NO: 45763 - DNA, 20 bp, Artificial Sequence
  chemically synthesized
gatcctcccttgcagatgca

SEQ ID NO: 45764 - DNA, 20 bp, Artificial Sequence
  chemically synthesized
cctcccttgcagatgcacag

SEQ ID NO: 45765 - DNA, 20 bp, Artificial Sequence
  chemically synthesized
gcagatgcacagcagattcc

SEQ ID NO: 45766 - DNA, 20 bp, Artificial Sequence
  chemically synthesized
acagcagattccgagtgaaa

SEQ ID NO: 45767 - DNA, 20 bp, Artificial Sequence
  chemically synthesized
gaaatggcctgctctgaatc

SEQ ID NO: 45768 - DNA, 20 bp, Artificial Sequence
  chemically synthesized
aaatggcctgctctgaatct

SEQ ID NO: 45769 - DNA, 20 bp, Artificial Sequence
  chemically synthesized
cctgctctgaatctaggtgc

SEQ ID NO: 45770 - DNA, 20 bp, Artificial Sequence
  chemically synthesized
tgctctgaatctaggtgctg

SEQ ID NO: 45771 - DNA, 20 bp, Artificial Sequence
  chemically synthesized
aatctaggtgctggagtcca

SEQ ID NO: 45772 - DNA, 20 bp, Artificial Sequence
  chemically synthesized
ctctttccactttgtttgca

SEQ ID NO: 45773 - DNA, 20 bp, Artificial Sequence
  chemically synthesized
tgtttgcaaagacctcactc

SEQ ID NO: 45774 - DNA, 20 bp, Artificial Sequence
  chemically synthesized
tttgcaaagacctcactcca

SEQ ID NO: 45775 - DNA, 20 bp, Artificial Sequence
  chemically synthesized
tgcaaagacctcactccaga

SEQ ID NO: 45776 - DNA, 20 bp, Artificial Sequence
  chemically synthesized
aagacctcactccagagagc

SEQ ID NO: 45777 - DNA, 20 bp, Artificial Sequence
  chemically synthesized
ctccagagagccagtgcaca

SEQ ID NO: 45778 - DNA, 20 bp, Artificial Sequence
  chemically synthesized
agagagccagtgcacaaaga

SEQ ID NO: 45779 - DNA, 20 bp, Artificial Sequence
  chemically synthesized
gtgcacaaagacagtgcaac

SEQ ID NO: 45780 - DNA, 20 bp, Artificial Sequence
  chemically synthesized
cacaaagacagtgcaaccag

SEQ ID NO: 45781 - DNA, 20 bp, Artificial Sequence
  chemically synthesized
acaaagacagtgcaaccagt

SEQ ID NO: 45782 - DNA, 20 bp, Artificial Sequence
  chemically synthesized
cagtgcaaccagtgggttga

SEQ ID NO: 45783 - DNA, 20 bp, Artificial Sequence
  chemically synthesized
tgggttgacagtgactccat

SEQ ID NO: 45784 - DNA, 20 bp, Artificial Sequence
  chemically synthesized
gggttgacagtgactccatg

SEQ ID NO: 45785 - DNA, 20 bp, Artificial Sequence
  chemically synthesized
tgacagtgactccatgaggt

SEQ ID NO: 45786 - DNA, 20 bp, Artificial Sequence
  chemically synthesized
gacagtgactccatgaggta

SEQ ID NO: 45787 - DNA, 20 bp, Artificial Sequence
  chemically synthesized
gtgactccatgaggtaaggt

SEQ ID NO: 45788 - DNA, 20 bp, Artificial Sequence
  chemically synthesized
gactccatgaggtaaggtca

SEQ ID NO: 45789 - DNA, 20 bp, Artificial Sequence
  chemically synthesized
aggtcagagttatccccatc

SEQ ID NO: 45790 - DNA, 20 bp, Artificial Sequence
  chemically synthesized
ccccatcgagcccgccatcg

SEQ ID NO: 45791 - DNA, 20 bp, Artificial Sequence
  chemically synthesized
tcgagcccgccatcgcagca

SEQ ID NO: 45792 - DNA, 20 bp, Artificial Sequence
  chemically synthesized
gagcccgccatcgcagcaca

SEQ ID NO: 45793 - DNA, 20 bp, Artificial Sequence
  chemically synthesized
cccgccatcgcagcacagag

SEQ ID NO: 45794 - DNA, 20 bp, Artificial Sequence
  chemically synthesized
ccgccatcgcagcacagagt

SEQ ID NO: 45795 - DNA, 20 bp, Artificial Sequence
  chemically synthesized
gccatcgcagcacagagtag

SEQ ID NO: 45796 - DNA, 20 bp, Artificial Sequence
  chemically synthesized
cagcacagagtaggagctca

SEQ ID NO: 45797 - DNA, 20 bp, Artificial Sequence
  chemically synthesized
aggagctcatggtttgctga

SEQ ID NO: 45798 - DNA, 20 bp, Artificial Sequence
  chemically synthesized
gagctcatggtttgctgaca

SEQ ID NO: 45799 - DNA, 20 bp, Artificial Sequence
  chemically synthesized
agctcatggtttgctgacag

SEQ ID NO: 45800 - DNA, 20 bp, Artificial Sequence
  chemically synthesized
tcatggtttgctgacagagg

SEQ ID NO: 45801 - DNA, 20 bp, Artificial Sequence
  chemically synthesized
tggtttgctgacagaggtgg

SEQ ID NO: 45802 - DNA, 20 bp, Artificial Sequence
  chemically synthesized
gtttgctgacagaggtggca

SEQ ID NO: 45803 - DNA, 20 bp, Artificial Sequence
  chemically synthesized
tttgctgacagaggtggcag

SEQ ID NO: 45804 - DNA, 20 bp, Artificial Sequence
  chemically synthesized
gctgacagaggtggcagagg

SEQ ID NO: 45805 - DNA, 20 bp, Artificial Sequence
  chemically synthesized
tccttcctgttgcctgtaat

SEQ ID NO: 45806 - DNA, 20 bp, Artificial Sequence
  chemically synthesized
ttgtatttgcaatgtgcttt

SEQ ID NO: 45807 - DNA, 20 bp, Artificial Sequence
  chemically synthesized
tatttgcaatgtgcttttgg

SEQ ID NO: 45808 - DNA, 20 bp, Artificial Sequence
  chemically synthesized
ttttggcagcttcctcatca

SEQ ID NO: 45809 - DNA, 20 bp, Artificial Sequence
  chemically synthesized
tttggcagcttcctcatcaa

SEQ ID NO: 45810 - DNA, 20 bp, Artificial Sequence
  chemically synthesized
tcctcatcaaaggcctcccc

SEQ ID NO: 45811 - DNA, 20 bp, Artificial Sequence
  chemically synthesized
ctcatcaaaggcctcccctg

SEQ ID NO: 45812 - DNA, 20 bp, Artificial Sequence
  chemically synthesized
tcaaaggcctcccctggagc

SEQ ID NO: 45813 - DNA, 20 bp, Artificial Sequence
  chemically synthesized
ggcctcccctggagcaagaa

SEQ ID NO: 45814 - DNA, 20 bp, Artificial Sequence
  chemically synthesized
tcccctggagcaagaataga

SEQ ID NO: 45815 - DNA, 20 bp, Artificial Sequence
  chemically synthesized
cccctggagcaagaatagat

SEQ ID NO: 45816 - DNA, 20 bp, Artificial Sequence
  chemically synthesized
cctggagcaagaatagatgg

SEQ ID NO: 45817 - DNA, 20 bp, Artificial Sequence
  chemically synthesized
ctttccctgctgctcccctt

SEQ ID NO: 45818 - DNA, 20 bp, Artificial Sequence
  chemically synthesized
tttccctgctgctccccttt

SEQ ID NO: 45819 - DNA, 20 bp, Artificial Sequence
  chemically synthesized
gctgctcccctttgggacct

SEQ ID NO: 45820 - DNA, 20 bp, Artificial Sequence
  chemically synthesized
gaccttggcctctcacctac

SEQ ID NO: 45821 - DNA, 20 bp, Artificial Sequence
  chemically synthesized
accttggcctctcacctacc

SEQ ID NO: 45822 - DNA, 20 bp, Artificial Sequence
  chemically synthesized
ccttggcctctcacctaccg

SEQ ID NO: 45823 - DNA, 20 bp, Artificial Sequence
  chemically synthesized
gctgcgatggcgggctcgat

SEQ ID NO: 45824 - DNA, 20 bp, Artificial Sequence
  chemically synthesized
ataactctgaccttacctca

SEQ ID NO: 45825 - DNA, 20 bp, Artificial Sequence
  chemically synthesized
gtctttgtgcactggctctc

SEQ ID NO: 45826 - DNA, 20 bp, Artificial Sequence
  chemically synthesized
tcagagcaggccatttcact

SEQ ID NO: 45827 - DNA, 20 bp, Artificial Sequence
  chemically synthesized
tctgctgtgcatctgcaagg

SEQ ID NO: 45828 - DNA, 20 bp, Artificial Sequence
  chemically synthesized
tggtacacaataggtgttta

SEQ ID NO: 45829 - DNA, 20 bp, Artificial Sequence
  chemically synthesized
tcttgaacatggtgtgtaaa

SEQ ID NO: 45830 - DNA, 20 bp, Artificial Sequence
  chemically synthesized
gtaaaaggaatctttgcaaa

SEQ ID NO: 45831 - DNA, 20 bp, Artificial Sequence
  chemically synthesized
agctgagcttgtgcctacca

SEQ ID NO: 45832 - DNA, 20 bp, Artificial Sequence
  chemically synthesized
cttgtgcctaccatagaatt

SEQ ID NO: 45833 - DNA, 20 bp, Artificial Sequence
  chemically synthesized
cgtctttgcaaacttaaaac

SEQ ID NO: 45834 - DNA, 20 bp, Artificial Sequence
  chemically synthesized
tagttggtaaggtcagtgtg

SEQ ID NO: 45835 - DNA, 20 bp, Artificial Sequence
  chemically synthesized
cataaagggcagaggccgga

SEQ ID NO: 45836 - DNA, 20 bp, Artificial Sequence
  chemically synthesized
gccaggttaaggccagtgga

SEQ ID NO: 45837 - DNA, 20 bp, Artificial Sequence
  chemically synthesized
aaagaattcggtgggcagcg

SEQ ID NO: 45838 - DNA, 20 bp, Artificial Sequence
  chemically synthesized
gggcagcgaggagtccacag

SEQ ID NO: 45839 - DNA, 20 bp, Artificial Sequence
  chemically synthesized
aaggtgggcccggcagaact

SEQ ID NO: 45840 - DNA, 20 bp, Artificial Sequence
  chemically synthesized
ttggagtctggcatcccacg

SEQ ID NO: 45841 - DNA, 20 bp, Artificial Sequence
  chemically synthesized
ggcctgccttccagcccagt

SEQ ID NO: 45842 - DNA, 20 bp, Artificial Sequence
  chemically synthesized
ttccagcccagttaggattt

SEQ ID NO: 45843 - DNA, 20 bp, Artificial Sequence
  chemically synthesized
gaaacctgatcctccagtcc

SEQ ID NO: 45844 - DNA, 20 bp, Artificial Sequence
  chemically synthesized
tccgttaatgtttaatcaga

SEQ ID NO: 45845 - DNA, 20 bp, Artificial Sequence
  chemically synthesized
gcgggcgccgccgttcagtt

SEQ ID NO: 45846 - DNA, 20 bp, Artificial Sequence
  chemically synthesized
agttcagggtctgagcctgg

SEQ ID NO: 45847 - DNA, 20 bp, Artificial Sequence
  chemically synthesized
agcggctcccagctcccagc

SEQ ID NO: 45848 - DNA, 20 bp, Artificial Sequence
  chemically synthesized
tgctgctgctgctgctgctc

SEQ ID NO: 45849 - DNA, 20 bp, Artificial Sequence
  chemically synthesized
ttccaccgctgcgccaaggt

SEQ ID NO: 45850 - DNA, 20 bp, Artificial Sequence
  chemically synthesized
ctgcgccaaggtgcgggtgt

SEQ ID NO: 45851 - DNA, 20 bp, Artificial Sequence
  chemically synthesized
cccccatgtaagagaggaag

SEQ ID NO: 45852 - DNA, 20 bp, Artificial Sequence
  chemically synthesized
aggcaaggcggcgggggagg

SEQ ID NO: 45853 - DNA, 20 bp, Artificial Sequence
  chemically synthesized
ctattcagtgggaaggttcg

SEQ ID NO: 45854 - DNA, 20 bp, Artificial Sequence
  chemically synthesized
aagggcgagcagagcactgc

SEQ ID NO: 45855 - DNA, 20 bp, Artificial Sequence
  chemically synthesized
tctgcctcgccgcggcacag

SEQ ID NO: 45856 - DNA, 20 bp, Artificial Sequence
  chemically synthesized
gccgcggcacaggtgggtga

SEQ ID NO: 45857 - DNA, 20 bp, Artificial Sequence
  chemically synthesized
cggcacaggtgggtgaagga

SEQ ID NO: 45858 - DNA, 20 bp, Artificial Sequence
  chemically synthesized
aaagcgggcttgccattata

SEQ ID NO: 45859 - DNA, 20 bp, Artificial Sequence
  chemically synthesized
tttggaaaacatgggcagcg

SEQ ID NO: 45860 - DNA, 20 bp, Artificial Sequence
  chemically synthesized
ggccctacccgagacagggg

SEQ ID NO: 45861 - DNA, 20 bp, Artificial Sequence
  chemically synthesized
gtctgccgaccgtgtgcggg

SEQ ID NO: 45862 - DNA, 20 bp, Artificial Sequence
  chemically synthesized
aggttctgtgtcccccagct

SEQ ID NO: 45863 - DNA, 20 bp, Artificial Sequence
  chemically synthesized
ccccagcttggagtcagatg

SEQ ID NO: 45864 - DNA, 20 bp, Artificial Sequence
  chemically synthesized
gcttggagtcagatgtgggg

SEQ ID NO: 45865 - DNA, 20 bp, Artificial Sequence
  chemically synthesized
aagggaaagttctgttgacc

SEQ ID NO: 45866 - DNA, 20 bp, Artificial Sequence
  chemically synthesized
acttacaatgcaagccccgg

SEQ ID NO: 45867 - DNA, 20 bp, Artificial Sequence
  chemically synthesized
ctgcctgcccacgcttctgt

SEQ ID NO: 45868 - DNA, 20 bp, Artificial Sequence
  chemically synthesized
cacgcttctgtctgagtgtg

SEQ ID NO: 45869 - DNA, 20 bp, Artificial Sequence
  chemically synthesized
tgtctgagtgtgctgggtgg

SEQ ID NO: 45870 - DNA, 20 bp, Artificial Sequence
  chemically synthesized
ctgagcctttgactttctcg

SEQ ID NO: 45871 - DNA, 20 bp, Artificial Sequence
  chemically synthesized
gactttctcgagggatgttg

SEQ ID NO: 45872 - DNA, 20 bp, Artificial Sequence
  chemically synthesized
ggatgttgtggggttgtggc

SEQ ID NO: 45873 - DNA, 20 bp, Artificial Sequence
  chemically synthesized
aaacaactgttctggaaata

SEQ ID NO: 45874 - DNA, 20 bp, Artificial Sequence
  chemically synthesized
tgagtaccccatcctgagag

SEQ ID NO: 45875 - DNA, 20 bp, Artificial Sequence
  chemically synthesized
accacctgaaccaagccctt

SEQ ID NO: 45876 - DNA, 20 bp, Artificial Sequence
  chemically synthesized
tcattcaatggttattttgt

SEQ ID NO: 45877 - DNA, 20 bp, Artificial Sequence
  chemically synthesized
caatggttattttgtgggaa

SEQ ID NO: 45878 - DNA, 20 bp, Artificial Sequence
  chemically synthesized
tattttgtgggaatcgaatt

SEQ ID NO: 45879 - DNA, 20 bp, Artificial Sequence
  chemically synthesized
tcaccccaggtgcattagaa

SEQ ID NO: 45880 - DNA, 20 bp, Artificial Sequence
  chemically synthesized
agaactgacactccactgca

SEQ ID NO: 45881 - DNA, 20 bp, Artificial Sequence
  chemically synthesized
ttagcggaaggcattttcag

SEQ ID NO: 45882 - DNA, 20 bp, Artificial Sequence
  chemically synthesized
tgggtctttgaagcattagt

SEQ ID NO: 45883 - DNA, 20 bp, Artificial Sequence
  chemically synthesized
ttcagcgatgatggtgtcat

SEQ ID NO: 45884 - DNA, 20 bp, Artificial Sequence
  chemically synthesized
gtgtcatgagaattttattc

SEQ ID NO: 45885 - DNA, 20 bp, Artificial Sequence
  chemically synthesized
tttttcttttttttttgaga

SEQ ID NO: 45886 - DNA, 20 bp, Artificial Sequence
  chemically synthesized
ttcgctcttgttgcccaggc

SEQ ID NO: 45887 - DNA, 20 bp, Artificial Sequence
  chemically synthesized
ctcactgcaacatctgtctc

SEQ ID NO: 45888 - DNA, 20 bp, Artificial Sequence
  chemically synthesized
gcctcagcctcccaagaagc

SEQ ID NO: 45889 - DNA, 20 bp, Artificial Sequence
  chemically synthesized
ttttgtatttttagtagaga

SEQ ID NO: 45890 - DNA, 20 bp, Artificial Sequence
  chemically synthesized
gcaaactcctgacctcctca

SEQ ID NO: 45891 - DNA, 20 bp, Artificial Sequence
  chemically synthesized
gcctcagcctcccaaagtgc

SEQ ID NO: 45892 - DNA, 20 bp, Artificial Sequence
  chemically synthesized
attatttttaatttagttgt

SEQ ID NO: 45893 - DNA, 20 bp, Artificial Sequence
  chemically synthesized
accgttttggccctaaggct

SEQ ID NO: 45894 - DNA, 20 bp, Artificial Sequence
  chemically synthesized
gccctaaggctttgggtaaa

SEQ ID NO: 45895 - DNA, 20 bp, Artificial Sequence
  chemically synthesized
ggactctgttctactctgac

SEQ ID NO: 45896 - DNA, 20 bp, Artificial Sequence
  chemically synthesized
agatgcatatatacagagat

SEQ ID NO: 45897 - DNA, 20 bp, Artificial Sequence
  chemically synthesized
gtaggggccaaggaggagca

SEQ ID NO: 45898 - DNA, 20 bp, Artificial Sequence
  chemically synthesized
tggggcctaatgggaggtgt

SEQ ID NO: 45899 - DNA, 20 bp, Artificial Sequence
  chemically synthesized
ttggtgccgtccttgtgata

SEQ ID NO: 45900 - DNA, 20 bp, Artificial Sequence
  chemically synthesized
catgcttcctggagagcttg

SEQ ID NO: 45901 - DNA, 20 bp, Artificial Sequence
  chemically synthesized
agagcttgcagaatcatgag

SEQ ID NO: 45902 - DNA, 20 bp, Artificial Sequence
  chemically synthesized
tgcctgcatttgtagagcat

SEQ ID NO: 45903 - DNA, 20 bp, Artificial Sequence
  chemically synthesized
gtatctgaggctccgagagg

SEQ ID NO: 45904 - DNA, 20 bp, Artificial Sequence
  chemically synthesized
caaccagtaaatattggagc

SEQ ID NO: 45905 - DNA, 20 bp, Artificial Sequence
  chemically synthesized
tctgactggggcatggggga

SEQ ID NO: 45906 - DNA, 20 bp, Artificial Sequence
  chemically synthesized
gcgaccaggcccgtagagag

SEQ ID NO: 45907 - DNA, 20 bp, Artificial Sequence
  chemically synthesized
gtacagaggaaaacctgttg

SEQ ID NO: 45908 - DNA, 20 bp, Artificial Sequence
  chemically synthesized
cccgtagttcccatttttgc

SEQ ID NO: 45909 - DNA, 20 bp, Artificial Sequence
  chemically synthesized
tgaaagtgttatataaccat

SEQ ID NO: 45910 - DNA, 20 bp, Artificial Sequence
  chemically synthesized
aataataatagttggcctat

SEQ ID NO: 45911 - DNA, 20 bp, Artificial Sequence
  chemically synthesized
ttttgttgtaatttgtaagt

SEQ ID NO: 45912 - DNA, 20 bp, Artificial Sequence
  chemically synthesized
ggggtgagataaagtacacc

SEQ ID NO: 45913 - DNA, 20 bp, Artificial Sequence
  chemically synthesized
taaagtacacctagggtttg

SEQ ID NO: 45914 - DNA, 20 bp, Artificial Sequence
  chemically synthesized
tgttcctccttgcatggggc

SEQ ID NO: 45915 - DNA, 20 bp, Artificial Sequence
  chemically synthesized
gcaggcccaggctgcccgcc

SEQ ID NO: 45916 - DNA, 20 bp, Artificial Sequence
  chemically synthesized
ttcctggcttcctggtgaag

SEQ ID NO: 45917 - DNA, 20 bp, Artificial Sequence
  chemically synthesized
gctggtgagccacccttttt

SEQ ID NO: 45918 - DNA, 20 bp, Artificial Sequence
  chemically synthesized
aagtatgtattgagcactta

SEQ ID NO: 45919 - DNA, 20 bp, Artificial Sequence
  chemically synthesized
gtaactactggctttctgta

SEQ ID NO: 45920 - DNA, 20 bp, Artificial Sequence
  chemically synthesized
aggggaccacacagacagct

SEQ ID NO: 45921 - DNA, 20 bp, Artificial Sequence
  chemically synthesized
cagacagctaggggtagagc

SEQ ID NO: 45922 - DNA, 20 bp, Artificial Sequence
  chemically synthesized
aacctgtagggacaaggccc

SEQ ID NO: 45923 - DNA, 20 bp, Artificial Sequence
  chemically synthesized
cctgggatgttcagtggagc

SEQ ID NO: 45924 - DNA, 20 bp, Artificial Sequence
  chemically synthesized
tttataaaaaagcatgactc

SEQ ID NO: 45925 - DNA, 20 bp, Artificial Sequence
  chemically synthesized
cctttgaagctgttgctatc

SEQ ID NO: 45926 - DNA, 20 bp, Artificial Sequence
  chemically synthesized
gtgaagtcccttctttagga

SEQ ID NO: 45927 - DNA, 20 bp, Artificial Sequence
  chemically synthesized
cagggtggccctcctccctc

SEQ ID NO: 45928 - DNA, 20 bp, Artificial Sequence
  chemically synthesized
gtggaggggcagaaagggga

SEQ ID NO: 45929 - DNA, 20 bp, Artificial Sequence
  chemically synthesized
aagatttgaagcactagggc

SEQ ID NO: 45930 - DNA, 20 bp, Artificial Sequence
  chemically synthesized
agcactagggccagggtgag

SEQ ID NO: 45931 - DNA, 20 bp, Artificial Sequence
  chemically synthesized
cctaaagaagggacttcact

SEQ ID NO: 45932 - DNA, 20 bp, Artificial Sequence
  chemically synthesized
ctggatagcaacagcttcaa

SEQ ID NO: 45933 - DNA, 20 bp, Artificial Sequence
  chemically synthesized
ttcaaaggaattttggaccc

SEQ ID NO: 45934 - DNA, 20 bp, Artificial Sequence
  chemically synthesized
ggcagcagatgcattggcac

SEQ ID NO: 45935 - DNA, 20 bp, Artificial Sequence
  chemically synthesized
aatggctggcaggcagacca

SEQ ID NO: 45936 - DNA, 20 bp, Artificial Sequence
  chemically synthesized
ggggcatggccaggcttaaa

SEQ ID NO: 45937 - DNA, 20 bp, Artificial Sequence
  chemically synthesized
caggaagtgccattcccaaa

SEQ ID NO: 45938 - DNA, 20 bp, Artificial Sequence
  chemically synthesized
agaaggccatggaagacatg

SEQ ID NO: 45939 - DNA, 20 bp, Artificial Sequence
  chemically synthesized
gtgcgctctgactgcgagag

SEQ ID NO: 45940 - DNA, 20 bp, Artificial Sequence
  chemically synthesized
gtaggtgccaggcaacctcc

SEQ ID NO: 45941 - DNA, 20 bp, Artificial Sequence
  chemically synthesized
ttacaacaaaagagacacaa

SEQ ID NO: 45942 - DNA, 20 bp, Artificial Sequence
  chemically synthesized
cccctcccccatgccccagt

SEQ ID NO: 45943 - DNA, 20 bp, Artificial Sequence
  chemically synthesized
ggagccaggaaaccgtggac

SEQ ID NO: 45944 - DNA, 20 bp, Artificial Sequence
  chemically synthesized
ataggcctgctgggaaagtc

SEQ ID NO: 45945 - DNA, 20 bp, Artificial Sequence
  chemically synthesized
gctctacaaatgcaggcaga

SEQ ID NO: 45946 - DNA, 20 bp, Artificial Sequence
  chemically synthesized
ccttttgtgttgctatataa

SEQ ID NO: 45947 - DNA, 20 bp, Artificial Sequence
  chemically synthesized
atataaaggaatacctgaag

SEQ ID NO: 45948 - DNA, 20 bp, Artificial Sequence
  chemically synthesized
gtgagtaatttacaaggaaa

SEQ ID NO: 45949 - DNA, 20 bp, Artificial Sequence
  chemically synthesized
gacggcaccaagcctttcac

SEQ ID NO: 45950 - DNA, 20 bp, Artificial Sequence
  chemically synthesized
cactggctccccacagcctc

SEQ ID NO: 45951 - DNA, 20 bp, Artificial Sequence
  chemically synthesized
tatgcatcttggactccagt

SEQ ID NO: 45952 - DNA, 20 bp, Artificial Sequence
  chemically synthesized
ggactccagtcagagtagaa

SEQ ID NO: 45953 - DNA, 20 bp, Artificial Sequence
  chemically synthesized
ttttgaacctcagaacttgt

SEQ ID NO: 45954 - DNA, 20 bp, Artificial Sequence
  chemically synthesized
gaaaggcagtaatgggcaat

SEQ ID NO: 45955 - DNA, 20 bp, Artificial Sequence
  chemically synthesized
ggcaatcagagtctgcttgg

SEQ ID NO: 45956 - DNA, 20 bp, Artificial Sequence
  chemically synthesized
taatctatgcagcaaaatat

SEQ ID NO: 45957 - DNA, 20 bp, Artificial Sequence
  chemically synthesized
aacattttacatttcagacg

SEQ ID NO: 45958 - DNA, 20 bp, Artificial Sequence
  chemically synthesized
actttgggaggctgaggcgg

SEQ ID NO: 45959 - DNA, 20 bp, Artificial Sequence
  chemically synthesized
gaggcgggaggatcacctcc

SEQ ID NO: 45960 - DNA, 20 bp, Artificial Sequence
  chemically synthesized
tcggatccactgaggaggtc

SEQ ID NO: 45961 - DNA, 20 bp, Artificial Sequence
  chemically synthesized
ttcatggtacctcctaatcc

SEQ ID NO: 45962 - DNA, 20 bp, Artificial Sequence
  chemically synthesized
tgccttccgctaaataaaaa

SEQ ID NO: 45963 - DNA, 20 bp, Artificial Sequence
  chemically synthesized
ttccgctaaataaaaattga

SEQ ID NO: 45964 - DNA, 20 bp, Artificial Sequence
  chemically synthesized
ataaaaattgaatgaattgg

SEQ ID NO: 45965 - DNA, 20 bp, Artificial Sequence
  chemically synthesized
tgggagagtactctgtgcag

SEQ ID NO: 45966 - DNA, 20 bp, Artificial Sequence
  chemically synthesized
aaacccagttctaatgcacc

SEQ ID NO: 45967 - DNA, 20 bp, Artificial Sequence
  chemically synthesized
gtttctcatgactaaaagaa

SEQ ID NO: 45968 - DNA, 20 bp, Artificial Sequence
  chemically synthesized
cgattcccacaaaataacca

SEQ ID NO: 45969 - DNA, 20 bp, Artificial Sequence
  chemically synthesized
tcccacaaaataaccattga

SEQ ID NO: 45970 - DNA, 20 bp, Artificial Sequence
  chemically synthesized
acaaaataaccattgaatga

SEQ ID NO: 45971 - DNA, 20 bp, Artificial Sequence
  chemically synthesized
gcctctgcttactcacctct

SEQ ID NO: 45972 - DNA, 20 bp, Artificial Sequence
  chemically synthesized
tgcttactcacctctcagga

SEQ ID NO: 45973 - DNA, 20 bp, Artificial Sequence
  chemically synthesized
aggaagagggctatactgag

SEQ ID NO: 45974 - DNA, 20 bp, Artificial Sequence
  chemically synthesized
agaagcgtgggcaggcagct

SEQ ID NO: 45975 - DNA, 20 bp, Artificial Sequence
  chemically synthesized
gggcaggcagctgtgagtgg

SEQ ID NO: 45976 - DNA, 20 bp, Artificial Sequence
  chemically synthesized
agattaggcaatggaggctc

SEQ ID NO: 45977 - DNA, 20 bp, Artificial Sequence
  chemically synthesized
gcctgagggccagaagctgg

SEQ ID NO: 45978 - DNA, 20 bp, Artificial Sequence
  chemically synthesized
tgaggcgccgggctcagctc

SEQ ID NO: 45979 - DNA, 20 bp, Artificial Sequence
  chemically synthesized
caccaagggcccttccctgc

SEQ ID NO: 45980 - DNA, 20 bp, Artificial Sequence
  chemically synthesized
aaaggacgccaatgggcctc

SEQ ID NO: 45981 - DNA, 20 bp, Artificial Sequence
  chemically synthesized
ttttcttcggctgaaacaga

SEQ ID NO: 45982 - DNA, 20 bp, Artificial Sequence
  chemically synthesized
aacagatggaatactagagc

SEQ ID NO: 45983 - DNA, 20 bp, Artificial Sequence
  chemically synthesized
cttcccaccccgcccctgtc

SEQ ID NO: 45984 - DNA, 20 bp, Artificial Sequence
  chemically synthesized
cagaaactgggaaatctggg

SEQ ID NO: 45985 - DNA, 20 bp, Artificial Sequence
  chemically synthesized
tgctcgcccttcctcggcct

SEQ ID NO: 45986 - DNA, 20 bp, Artificial Sequence
  chemically synthesized
caaccccgcgaaccttccca

SEQ ID NO: 45987 - DNA, 20 bp, Artificial Sequence
  chemically synthesized
agcaccgcaccgtcccggct

SEQ ID NO: 45988 - DNA, 20 bp, Artificial Sequence
  chemically synthesized
aggtggctgtggttccgtgc

SEQ ID NO: 45989 - DNA, 20 bp, Artificial Sequence
  chemically synthesized
agggcgcgtgaaggggcgcg

SEQ ID NO: 45990 - DNA, 20 bp, Artificial Sequence
  chemically synthesized
acgtcgctgcggaaaccttc

SEQ ID NO: 45991 - DNA, 20 bp, Artificial Sequence
  chemically synthesized
ctgcggaaaccttctagggt

SEQ ID NO: 45992 - DNA, 20 bp, Artificial Sequence
  chemically synthesized
ttaacggaacccccggactg

SEQ ID NO: 45993 - DNA, 20 bp, Artificial Sequence
  chemically synthesized
ctcccgcctctcaccctgcg

SEQ ID NO: 45994 - DNA, 20 bp, Artificial Sequence
  chemically synthesized
gcccaccttttcagtgtttc

SEQ ID NO: 45995 - DNA, 20 bp, Artificial Sequence
  chemically synthesized
cctgctgaccagtgagactt

SEQ ID NO: 45996 - DNA, 20 bp, Artificial Sequence
  chemically synthesized
tgtggactcctcgctgccca

SEQ ID NO: 45997 - DNA, 20 bp, Artificial Sequence
  chemically synthesized
tccagcctacatgcatttca

SEQ ID NO: 45998 - DNA, 20 bp, Artificial Sequence
  chemically synthesized
agacgtcatataggtacatt

SEQ ID NO: 45999 - DNA, 20 bp, Artificial Sequence
  chemically synthesized
acctattgtgtaccaggcag

SEQ ID NO: 46000 - DNA, 20 bp, Artificial Sequence
  chemically synthesized
gatactgggaagaaacaaag

SEQ ID NO: 46001 - DNA, 20 bp, Artificial Sequence
  chemically synthesized
ttgcagatgcacagcagatt

SEQ ID NO: 46002 - DNA, 20 bp, Artificial Sequence
  chemically synthesized
tccgagtgaaatggcctgct

SEQ ID NO: 46003 - DNA, 20 bp, Artificial Sequence
  chemically synthesized
cctgctctgaatctaggtgc

SEQ ID NO: 46004 - DNA, 20 bp, Artificial Sequence
  chemically synthesized
gcacaaagacagtgcaacca

SEQ ID NO: 46005 - DNA, 20 bp, Artificial Sequence
  chemically synthesized
gtgactccatgaggtaaggt

SEQ ID NO: 46006 - DNA, 20 bp, Artificial Sequence
  chemically synthesized
tcgagcccgccatcgcagca

SEQ ID NO: 46007 - DNA, 20 bp, Artificial Sequence
  chemically synthesized
tccttcctgttgcctgtaat

SEQ ID NO: 46008 - DNA, 20 bp, Artificial Sequence
  chemically synthesized
tcaaaggcctcccctggagc

SEQ ID NO: 46009 - DNA, 20 bp, Artificial Sequence
  chemically synthesized
gaccttggcctctcacctac

SEQ ID NO: 46010 - DNA, 20 bp, Artificial Sequence
  chemically synthesized
tcccagtatcgacagccctt

SEQ ID NO: 46011 - DNA, 20 bp, Artificial Sequence
  chemically synthesized
aagctgagcttgtgcctacc

SEQ ID NO: 46012 - DNA, 20 bp, Artificial Sequence
  chemically synthesized
tgccaggttaaggccagtgg

SEQ ID NO: 46013 - DNA, 20 bp, Artificial Sequence
  chemically synthesized
ctgggaactgcaccaggcac

SEQ ID NO: 46014 - DNA, 20 bp, Artificial Sequence
  chemically synthesized
gtattccatctgtttcagcc

SEQ ID NO: 46015 - DNA, 20 bp, Artificial Sequence
  chemically synthesized
ttgtggggttgtggccagga

SEQ ID NO: 46016 - DNA, 20 bp, Artificial Sequence
  chemically synthesized
ttattttgtgggaatcgaat

SEQ ID NO: 46017 - DNA, 20 bp, Artificial Sequence
  chemically synthesized
atgaaaatattttttggcaa

SEQ ID NO: 46018 - DNA, 20 bp, Artificial Sequence
  chemically synthesized
caatccttttcttttagtca

SEQ ID NO: 46019 - DNA, 20 bp, Artificial Sequence
  chemically synthesized
gttcagcgatgatggtgtca

SEQ ID NO: 46020 - DNA, 20 bp, Artificial Sequence
  chemically synthesized
ccatgcttcctggagagctt

SEQ ID NO: 46021 - DNA, 20 bp, Artificial Sequence
  chemically synthesized
agtaactactggctttctgt

SEQ ID NO: 46022 - DNA, 20 bp, Artificial Sequence
  chemically synthesized
gtcacatcttcggtggaggg

SEQ ID NO: 46023 - DNA, 20 bp, Artificial Sequence
  chemically synthesized
aagcactagggccagggtga

SEQ ID NO: 46024 - DNA, 20 bp, Artificial Sequence
  chemically synthesized
aggcagcagatgcattggca

SEQ ID NO: 46025 - DNA, 20 bp, Artificial Sequence
  chemically synthesized
aggcttaaagggaattctat

SEQ ID NO: 46026 - DNA, 20 bp, Artificial Sequence
  chemically synthesized
aggaggaacatgatgacatg

SEQ ID NO: 46027 - DNA, 20 bp, Artificial Sequence
  chemically synthesized
ccccctcccccatgccccag

SEQ ID NO: 46028 - DNA, 20 bp, Artificial Sequence
  chemically synthesized
aggcaacacttcttaaagag

SEQ ID NO: 46029 - DNA, 20 bp, Artificial Sequence
  chemically synthesized
cctcagaacttgtttggatt

SEQ ID NO: 46030 - DNA, 20 bp, Artificial Sequence
  chemically synthesized
gggcaatcagagtctgcttg

SEQ ID NO: 46031 - DNA, 20 bp, Artificial Sequence
  chemically synthesized
gaaactccatctcaaaaaaa

SEQ ID NO: 46032 - DNA, 20 bp, Artificial Sequence
  chemically synthesized
gttcatggtacctcctaatc

SEQ ID NO: 46033 - DNA, 20 bp, Artificial Sequence
  chemically synthesized
gcctcagtttctcatgacta

SEQ ID NO: 46034 - DNA, 20 bp, Artificial Sequence
  chemically synthesized
tgttccaaacttccaccaga

SEQ ID NO: 46035 - DNA, 20 bp, Artificial Sequence
  chemically synthesized
cacaaccccacaacatccct

SEQ ID NO: 46036 - DNA, 20 bp, Artificial Sequence
  chemically synthesized
tgggcaggcagctgtgagtg

SEQ ID NO: 46037 - DNA, 20 bp, Artificial Sequence
  chemically synthesized
aagtcctgggctggtaatac

SEQ ID NO: 46038 - DNA, 20 bp, Artificial Sequence
  chemically synthesized
taaaggacgccaatgggcct

SEQ ID NO: 46039 - DNA, 20 bp, Artificial Sequence
  chemically synthesized
gagcatgagttctgtgtcat

SEQ ID NO: 46040 - DNA, 20 bp, Artificial Sequence
  chemically synthesized
cccacctgtgccgcggcgag

SEQ ID NO: 46041 - DNA, 20 bp, Artificial Sequence
  chemically synthesized
cgtcagattacgcgcagagg

SEQ ID NO: 46042 - DNA, 20 bp, Artificial Sequence
  chemically synthesized
aagacgtcatataggtacat

SEQ ID NO: 46043 - DNA, 20 bp, Artificial Sequence
  chemically synthesized
ttccttttacacaccatgtt

SEQ ID NO: 46044 - DNA, 20 bp, Artificial Sequence
  chemically synthesized
ggaagggctgtcgatactgg

SEQ ID NO: 46045 - DNA, 20 bp, Artificial Sequence
  chemically synthesized
atcaaaggcctcccctggag

SEQ ID NO: 46046 - DNA, 20 bp, Artificial Sequence
  chemically synthesized
atatgacgtctttgcaaact

SEQ ID NO: 46047 - DNA, 20 bp, Artificial Sequence
  chemically synthesized
gtgggttccgatttggtttg

SEQ ID NO: 46048 - DNA, 20 bp, Artificial Sequence
  chemically synthesized
atttcaagttaccactgctc

SEQ ID NO: 46049 - DNA, 20 bp, Artificial Sequence
  chemically synthesized
gaacaaagatacagagctgg

SEQ ID NO: 46050 - DNA, 20 bp, Artificial Sequence
  chemically synthesized
tctgaaatgtaaaatgttac

SEQ ID NO: 46051 - DNA, 20 bp, Artificial Sequence
  chemically synthesized
tccaaacaagttctgaggtt

SEQ ID NO: 46052 - DNA, 20 bp, Artificial Sequence
  chemically synthesized
agttggagcagacaagagct

SEQ ID NO: 46053 - DNA, 20 bp, Artificial Sequence
  chemically synthesized
agctgggtgcaggtacagag

SEQ ID NO: 46054 - DNA, 20 bp, Artificial Sequence
  chemically synthesized
cctagtgcttcaaatcttaa

SEQ ID NO: 46055 - DNA, 20 bp, Artificial Sequence
  chemically synthesized
ggtggtgcagaagcacaaat

SEQ ID NO: 46056 - DNA, 20 bp, Artificial Sequence
  chemically synthesized
tttacccaaagccttagggc

SEQ ID NO: 46057 - DNA, 20 bp, Artificial Sequence
  chemically synthesized
accatcaaataaatcacaaa

SEQ ID NO: 46058 - DNA, 20 bp, Artificial Sequence
  chemically synthesized
ggtcacactgcagacaggga

SEQ ID NO: 46059 - DNA, 20 bp, Artificial Sequence
  chemically synthesized
gattacgcgcagagggaaga

SEQ ID NO: 46060 - DNA, 20 bp, Artificial Sequence
  chemically synthesized
atcaactttggactccagca

SEQ ID NO: 46061 - DNA, 20 bp, Artificial Sequence
  chemically synthesized
agggaggatcataaattcgc

SEQ ID NO: 46062 - DNA, 20 bp, Artificial Sequence
  chemically synthesized
cctcctgcctggtacacaat

SEQ ID NO: 46063 - DNA, 20 bp, Artificial Sequence
  chemically synthesized
gtacacaataggtgtttact

SEQ ID NO: 46064 - DNA, 20 bp, Artificial Sequence
  chemically synthesized
tgtttactggatgcttgtcc

SEQ ID NO: 46065 - DNA, 20 bp, Artificial Sequence
  chemically synthesized
aaattgaatcttctggaaag

SEQ ID NO: 46066 - DNA, 20 bp, Artificial Sequence
  chemically synthesized
gaggccggagggggtccagg

SEQ ID NO: 46067 - DNA, 20 bp, Artificial Sequence
  chemically synthesized
tgggcagcgaggagtccaca

SEQ ID NO: 46068 - DNA, 20 bp, Artificial Sequence
  chemically synthesized
cagcgaggagtccacagtag

SEQ ID NO: 46069 - DNA, 20 bp, Artificial Sequence
  chemically synthesized
cggcctgccttccagcccag

SEQ ID NO: 46070 - DNA, 20 bp, Artificial Sequence
  chemically synthesized
ttccagcccagttaggattt

SEQ ID NO: 46071 - DNA, 20 bp, Artificial Sequence
  chemically synthesized
tccctctgcgcgtaatctga

SEQ ID NO: 46072 - DNA, 20 bp, Artificial Sequence
  chemically synthesized
ctccagtccgggggttccgt

SEQ ID NO: 46073 - DNA, 20 bp, Artificial Sequence
  chemically synthesized
cgtcaagcacccacacccta

SEQ ID NO: 46074 - DNA, 20 bp, Artificial Sequence
  chemically synthesized
cagcggctcccagctcccag

SEQ ID NO: 46075 - DNA, 20 bp, Artificial Sequence
  chemically synthesized
ccgcagccgggacggtgcgg

SEQ ID NO: 46076 - DNA, 20 bp, Artificial Sequence
  chemically synthesized
ggtgctgtttcctctcgggc

SEQ ID NO: 46077 - DNA, 20 bp, Artificial Sequence
  chemically synthesized
agtgcaggtcgccgagggct

SEQ ID NO: 46078 - DNA, 20 bp, Artificial Sequence
  chemically synthesized
agcactgccaggatatcctg

SEQ ID NO: 46079 - DNA, 20 bp, Artificial Sequence
  chemically synthesized
aggatatcctgcccagattt

SEQ ID NO: 46080 - DNA, 20 bp, Artificial Sequence
  chemically synthesized
ctgcaccaggcacagagaaa

SEQ ID NO: 46081 - DNA, 20 bp, Artificial Sequence
  chemically synthesized
gggcttgccattatagtggg

SEQ ID NO: 46082 - DNA, 20 bp, Artificial Sequence
  chemically synthesized
gccattatagtgggttccga

SEQ ID NO: 46083 - DNA, 20 bp, Artificial Sequence
  chemically synthesized
aactcatgctctagtattcc

SEQ ID NO: 46084 - DNA, 20 bp, Artificial Sequence
  chemically synthesized
gtctgccgaccgtgtgcggg

SEQ ID NO: 46085 - DNA, 20 bp, Artificial Sequence
  chemically synthesized
cgagtttgctcaacaactct

SEQ ID NO: 46086 - DNA, 20 bp, Artificial Sequence
  chemically synthesized
cttctggccctcaggctgtg

SEQ ID NO: 46087 - DNA, 20 bp, Artificial Sequence
  chemically synthesized
cttcttcccggggcgagacc

SEQ ID NO: 46088 - DNA, 20 bp, Artificial Sequence
  chemically synthesized
ttggctgaggttctgtgtcc

SEQ ID NO: 46089 - DNA, 20 bp, Artificial Sequence
  chemically synthesized
agtcagatgtggggttgaat

SEQ ID NO: 46090 - DNA, 20 bp, Artificial Sequence
  chemically synthesized
tggcttcctctcactagctg

SEQ ID NO: 46091 - DNA, 20 bp, Artificial Sequence
  chemically synthesized
caagccccggggggatcact

SEQ ID NO: 46092 - DNA, 20 bp, Artificial Sequence
  chemically synthesized
tgccactcacagctgcctgc

SEQ ID NO: 46093 - DNA, 20 bp, Artificial Sequence
  chemically synthesized
cacctgaaccaagcccttga

SEQ ID NO: 46094 - DNA, 20 bp, Artificial Sequence
  chemically synthesized
gaggatgtttcttctctggt

SEQ ID NO: 46095 - DNA, 20 bp, Artificial Sequence
  chemically synthesized
tcaccccaggtgcattagaa

SEQ ID NO: 46096 - DNA, 20 bp, Artificial Sequence
  chemically synthesized
ggtgtcatgagaattttatt

SEQ ID NO: 46097 - DNA, 20 bp, Artificial Sequence
  chemically synthesized
tttttcttttttttttgaga

SEQ ID NO: 46098 - DNA, 20 bp, Artificial Sequence
  chemically synthesized
tgcctcagcctcccaagaag

SEQ ID NO: 46099 - DNA, 20 bp, Artificial Sequence
  chemically synthesized
ttttgtatttttagtagaga

SEQ ID NO: 46100 - DNA, 20 bp, Artificial Sequence
  chemically synthesized
tgtaaaatgttacgaaaacc

SEQ ID NO: 46101 - DNA, 20 bp, Artificial Sequence
  chemically synthesized
acgaaaaccaaaagtttttt

SEQ ID NO: 46102 - DNA, 20 bp, Artificial Sequence
  chemically synthesized
agcacctgacgtgaactgac

SEQ ID NO: 46103 - DNA, 20 bp, Artificial Sequence
  chemically synthesized
catattcatatattttgctg

SEQ ID NO: 46104 - DNA, 20 bp, Artificial Sequence
  chemically synthesized
catagattacagtatgcagc

SEQ ID NO: 46105 - DNA, 20 bp, Artificial Sequence
  chemically synthesized
tccagattcttccaagcaga

SEQ ID NO: 46106 - DNA, 20 bp, Artificial Sequence
  chemically synthesized
aaacaagttctgaggttcaa

SEQ ID NO: 46107 - DNA, 20 bp, Artificial Sequence
  chemically synthesized
gttcaaaaccgttttggccc

SEQ ID NO: 46108 - DNA, 20 bp, Artificial Sequence
  chemically synthesized
gtaggggccaaggaggagca

SEQ ID NO: 46109 - DNA, 20 bp, Artificial Sequence
  chemically synthesized
aggaggagcatggagtttgg

SEQ ID NO: 46110 - DNA, 20 bp, Artificial Sequence
  chemically synthesized
catagatagtggctgctata

SEQ ID NO: 46111 - DNA, 20 bp, Artificial Sequence
  chemically synthesized
tggaagtggggcctaatggg

SEQ ID NO: 46112 - DNA, 20 bp, Artificial Sequence
  chemically synthesized
atgggggaggaacccctgtg

SEQ ID NO: 46113 - DNA, 20 bp, Artificial Sequence
  chemically synthesized
ataatgagtaagttctcccg

SEQ ID NO: 46114 - DNA, 20 bp, Artificial Sequence
  chemically synthesized
ccgctatgatttcccttgaa

SEQ ID NO: 46115 - DNA, 20 bp, Artificial Sequence
  chemically synthesized
cttgaaggctgattattaaa

SEQ ID NO: 46116 - DNA, 20 bp, Artificial Sequence
  chemically synthesized
tggcacctccctctcttctc

SEQ ID NO: 46117 - DNA, 20 bp, Artificial Sequence
  chemically synthesized
ctcttgcttcttctcttgcc

SEQ ID NO: 46118 - DNA, 20 bp, Artificial Sequence
  chemically synthesized
caccttctgccatcagtgaa

SEQ ID NO: 46119 - DNA, 20 bp, Artificial Sequence
  chemically synthesized
accagaagcagatgctggtg

SEQ ID NO: 46120 - DNA, 20 bp, Artificial Sequence
  chemically synthesized
tgctggtgccatgcttcctg

SEQ ID NO: 46121 - DNA, 20 bp, Artificial Sequence
  chemically synthesized
catttgtagagcatctggat

SEQ ID NO: 46122 - DNA, 20 bp, Artificial Sequence
  chemically synthesized
ttggagctggaattcaggtc

SEQ ID NO: 46123 - DNA, 20 bp, Artificial Sequence
  chemically synthesized
cggtttcctggctccaaagc

SEQ ID NO: 46124 - DNA, 20 bp, Artificial Sequence
  chemically synthesized
tggcctatatgagttcttta

SEQ ID NO: 46125 - DNA, 20 bp, Artificial Sequence
  chemically synthesized
ggggtgagataaagtacacc

SEQ ID NO: 46126 - DNA, 20 bp, Artificial Sequence
  chemically synthesized
taaagtacacctagggtttg

SEQ ID NO: 46127 - DNA, 20 bp, Artificial Sequence
  chemically synthesized
atgtcttccatggccttctt

SEQ ID NO: 46128 - DNA, 20 bp, Artificial Sequence
  chemically synthesized
cactgcatatacactgggga

SEQ ID NO: 46129 - DNA, 20 bp, Artificial Sequence
  chemically synthesized
gggtaccaagcacagtaact

SEQ ID NO: 46130 - DNA, 20 bp, Artificial Sequence
  chemically synthesized
tattctcctcaccctggccc

SEQ ID NO: 46131 - DNA, 20 bp, Artificial Sequence
  chemically synthesized
tagtgcttcaaatcttaaaa

SEQ ID NO: 46132 - DNA, 20 bp, Artificial Sequence
  chemically synthesized
tcttaaaaaaacgtttttat

SEQ ID NO: 46133 - DNA, 20 bp, Artificial Sequence
  chemically synthesized
tggtgcagaagcacaaataa

SEQ ID NO: 46134 - DNA, 20 bp, Artificial Sequence
  chemically synthesized
gcacaaataaaaacgttttt

SEQ ID NO: 46135 - DNA, 20 bp, Artificial Sequence
  chemically synthesized
gggacttcactctggatagc

SEQ ID NO: 46136 - DNA, 20 bp, Artificial Sequence
  chemically synthesized
aggaattttggaccctagag

SEQ ID NO: 46137 - DNA, 20 bp, Artificial Sequence
  chemically synthesized
catcccagggccttgtccct

SEQ ID NO: 46138 - DNA, 20 bp, Artificial Sequence
  chemically synthesized
aatggctggcaggcagacca

SEQ ID NO: 46139 - DNA, 20 bp, Artificial Sequence
  chemically synthesized
gacgtaccactggggcatgg

SEQ ID NO: 46140 - DNA, 20 bp, Artificial Sequence
  chemically synthesized
atacagaaagccagtagtta

SEQ ID NO: 46141 - DNA, 20 bp, Artificial Sequence
  chemically synthesized
aatacatacttgctgtcccc

SEQ ID NO: 46142 - DNA, 20 bp, Artificial Sequence
  chemically synthesized
actacgggccacactcgaca

SEQ ID NO: 46143 - DNA, 20 bp, Artificial Sequence
  chemically synthesized
ataaattgagggaaaaaatc

SEQ ID NO: 46144 - DNA, 20 bp, Artificial Sequence
  chemically synthesized
ggtgagtaatttacaaggaa

SEQ ID NO: 46145 - DNA, 20 bp, Artificial Sequence
  chemically synthesized
ggaaaagggatttattcagc

SEQ ID NO: 46146 - DNA, 20 bp, Artificial Sequence
  chemically synthesized
ccaggaagcatggcaccagc

SEQ ID NO: 46147 - DNA, 20 bp, Artificial Sequence
  chemically synthesized
tgcttctggtgagggcctta

SEQ ID NO: 46148 - DNA, 20 bp, Artificial Sequence
  chemically synthesized
actgaggaccaaatttccac

SEQ ID NO: 46149 - DNA, 20 bp, Artificial Sequence
  chemically synthesized
attatagcagccactatcta

SEQ ID NO: 46150 - DNA, 20 bp, Artificial Sequence
  chemically synthesized
agcagccactatctatggtg

SEQ ID NO: 46151 - DNA, 20 bp, Artificial Sequence
  chemically synthesized
ccactatctatggtgatttg

SEQ ID NO: 46152 - DNA, 20 bp, Artificial Sequence
  chemically synthesized
aactgctctcaggcagacat

SEQ ID NO: 46153 - DNA, 20 bp, Artificial Sequence
  chemically synthesized
acccaaagccttagggccaa

SEQ ID NO: 46154 - DNA, 20 bp, Artificial Sequence
  chemically synthesized
aaacggttttgaacctcaga

SEQ ID NO: 46155 - DNA, 20 bp, Artificial Sequence
  chemically synthesized
gttttgaacctcagaacttg

SEQ ID NO: 46156 - DNA, 20 bp, Artificial Sequence
  chemically synthesized
ggcagtaatgggcaatcaga

SEQ ID NO: 46157 - DNA, 20 bp, Artificial Sequence
  chemically synthesized
aataaatcacaaaaaaaact

SEQ ID NO: 46158 - DNA, 20 bp, Artificial Sequence
  chemically synthesized
tcggatccactgaggaggtc

SEQ ID NO: 46159 - DNA, 20 bp, Artificial Sequence
  chemically synthesized
tggtggcaggtacctgtaat

SEQ ID NO: 46160 - DNA, 20 bp, Artificial Sequence
  chemically synthesized
tgtgctccttatcttccacc

SEQ ID NO: 46161 - DNA, 20 bp, Artificial Sequence
  chemically synthesized
catcatcgctgaactcctac

SEQ ID NO: 46162 - DNA, 20 bp, Artificial Sequence
  chemically synthesized
gtgacctcctctctctgggc

SEQ ID NO: 46163 - DNA, 20 bp, Artificial Sequence
  chemically synthesized
agtttctcatgactaaaaga

SEQ ID NO: 46164 - DNA, 20 bp, Artificial Sequence
  chemically synthesized
ggattggtctaaaaattatt

SEQ ID NO: 46165 - DNA, 20 bp, Artificial Sequence
  chemically synthesized
aaaaaatattttcattctaa

SEQ ID NO: 46166 - DNA, 20 bp, Artificial Sequence
  chemically synthesized
accagagaagaaacatcctc

SEQ ID NO: 46167 - DNA, 20 bp, Artificial Sequence
  chemically synthesized
ggttcaggtggtcatacagc

SEQ ID NO: 46168 - DNA, 20 bp, Artificial Sequence
  chemically synthesized
gtactcactatttccagaac

SEQ ID NO: 46169 - DNA, 20 bp, Artificial Sequence
  chemically synthesized
ttcccctctgccccaggagc

SEQ ID NO: 46170 - DNA, 20 bp, Artificial Sequence
  chemically synthesized
aaaactgcaagtgatccccc

SEQ ID NO: 46171 - DNA, 20 bp, Artificial Sequence
  chemically synthesized
ctgctgccactgagccgtag

SEQ ID NO: 46172 - DNA, 20 bp, Artificial Sequence
  chemically synthesized
gacgattgtcacctcccttt

SEQ ID NO: 46173 - DNA, 20 bp, Artificial Sequence
  chemically synthesized
ccacagctagtgagaggaag

SEQ ID NO: 46174 - DNA, 20 bp, Artificial Sequence
  chemically synthesized
ctagtggtctcgccccggga

SEQ ID NO: 46175 - DNA, 20 bp, Artificial Sequence
  chemically synthesized
ggccctccaccctccgctgc

SEQ ID NO: 46176 - DNA, 20 bp, Artificial Sequence
  chemically synthesized
ggaacccactataatggcaa

SEQ ID NO: 46177 - DNA, 20 bp, Artificial Sequence
  chemically synthesized
gtggctgtggttccgtgctc

SEQ ID NO: 46178 - DNA, 20 bp, Artificial Sequence
  chemically synthesized
gcggaaaccttctagggtgt

SEQ ID NO: 46179 - DNA, 20 bp, Artificial Sequence
  chemically synthesized
gagccccatcggacgatcct

SEQ ID NO: 46180 - DNA, 20 bp, Artificial Sequence
  chemically synthesized
ggaacccccggactggagga

SEQ ID NO: 46181 - DNA, 20 bp, Artificial Sequence
  chemically synthesized
cctcgccctccccaaacagc

SEQ ID NO: 46182 - DNA, 20 bp, Artificial Sequence
  chemically synthesized
ttctgccgggcccacctttt

SEQ ID NO: 46183 - DNA, 20 bp, Artificial Sequence
  chemically synthesized
taccaactagctgctccttg

SEQ ID NO: 46184 - DNA, 20 bp, Artificial Sequence
  chemically synthesized
aactagctgctccttgaaga

SEQ ID NO: 46185 - DNA, 20 bp, Artificial Sequence
  chemically synthesized
agctgctccttgaagagatt

SEQ ID NO: 46186 - DNA, 20 bp, Artificial Sequence
  chemically synthesized
gtccagcctacatgcatttc

SEQ ID NO: 46187 - DNA, 20 bp, Artificial Sequence
  chemically synthesized
atttcaagggatttatacta

SEQ ID NO: 46188 - DNA, 20 bp, Artificial Sequence
  chemically synthesized
gggatttatactacaaagat

SEQ ID NO: 46189 - DNA, 20 bp, Artificial Sequence
  chemically synthesized
atactacaaagattcaggtt

SEQ ID NO: 46190 - DNA, 20 bp, Artificial Sequence
  chemically synthesized
aattctatggtaggcacaag

SEQ ID NO: 46191 - DNA, 20 bp, Artificial Sequence
  chemically synthesized
aggcacaagctcagctttcc

SEQ ID NO: 46192 - DNA, 20 bp, Artificial Sequence
  chemically synthesized
tttccagaagattcaatttg

SEQ ID NO: 46193 - DNA, 20 bp, Artificial Sequence
  chemically synthesized
ggggaaagagagctcctggc

SEQ ID NO: 46194 - DNA, 20 bp, Artificial Sequence
  chemically synthesized
attgtacatgtggcatgaca

SEQ ID NO: 46195 - DNA, 20 bp, Artificial Sequence
  chemically synthesized
atcctcccttgcagatgcac

SEQ ID NO: 46196 - DNA, 20 bp, Artificial Sequence
  chemically synthesized
caaagttgatgctctttcca

SEQ ID NO: 46197 - DNA, 20 bp, Artificial Sequence
  chemically synthesized
cgcagcacagagtaggagct

SEQ ID NO: 46198 - DNA, 20 bp, Artificial Sequence
  chemically synthesized
taattggaattgtatttgca

SEQ ID NO: 46199 - DNA, 20 bp, Artificial Sequence
  chemically synthesized
tgtatttgcaatgtgctttt

SEQ ID NO: 46200 - DNA, 22 bp, Artificial Sequence
  chemically synthesized
gctcccatctattcttgctcca

SEQ ID NO: 46201 - DNA, 22 bp, Artificial Sequence
  chemically synthesized
ccatctattcttgctccagggg

SEQ ID NO: 46202 - DNA, 22 bp, Artificial Sequence
  chemically synthesized
ttcttgctccaggggaggcctt

SEQ ID NO: 46203 - DNA, 22 bp, Artificial Sequence
  chemically synthesized
ttgctccaggggaggcctttga

SEQ ID NO: 46204 - DNA, 22 bp, Artificial Sequence
  chemically synthesized
gctccaggggaggcctttgatg

SEQ ID NO: 46205 - DNA, 22 bp, Artificial Sequence
  chemically synthesized
ctccaggggaggcctttgatga

SEQ ID NO: 46206 - DNA, 22 bp, Artificial Sequence
  chemically synthesized
caggggaggcctttgatgagga

SEQ ID NO: 46207 - DNA, 22 bp, Artificial Sequence
  chemically synthesized
tgatgaggaagctgccaaaagc

SEQ ID NO: 46208 - DNA, 22 bp, Artificial Sequence
  chemically synthesized
gatgaggaagctgccaaaagca

SEQ ID NO: 46209 - DNA, 22 bp, Artificial Sequence
  chemically synthesized
atgaggaagctgccaaaagcac

SEQ ID NO: 46210 - DNA, 22 bp, Artificial Sequence
  chemically synthesized
ccaaaagcacattgcaaataca

SEQ ID NO: 46211 - DNA, 22 bp, Artificial Sequence
  chemically synthesized
caaatacaattccaattacagg

SEQ ID NO: 46212 - DNA, 22 bp, Artificial Sequence
  chemically synthesized
caattacaggcaacaggaagga

SEQ ID NO: 46213 - DNA, 22 bp, Artificial Sequence
  chemically synthesized
caggcaacaggaaggagaacca

SEQ ID NO: 46214 - DNA, 22 bp, Artificial Sequence
  chemically synthesized
tgccacctctgtcagcaaacca

SEQ ID NO: 46215 - DNA, 22 bp, Artificial Sequence
  chemically synthesized
ccacctctgtcagcaaaccatg

SEQ ID NO: 46216 - DNA, 22 bp, Artificial Sequence
  chemically synthesized
tgtcagcaaaccatgagctcct

SEQ ID NO: 46217 - DNA, 22 bp, Artificial Sequence
  chemically synthesized
tcagcaaaccatgagctcctac

SEQ ID NO: 46218 - DNA, 22 bp, Artificial Sequence
  chemically synthesized
ctactctgtgctgcgatggcgg

SEQ ID NO: 46219 - DNA, 22 bp, Artificial Sequence
  chemically synthesized
ctctgtgctgcgatggcgggct

SEQ ID NO: 46220 - DNA, 22 bp, Artificial Sequence
  chemically synthesized
tgtgctgcgatggcgggctcga

SEQ ID NO: 46221 - DNA, 22 bp, Artificial Sequence
  chemically synthesized
tgctgcgatggcgggctcgatg

SEQ ID NO: 46222 - DNA, 22 bp, Artificial Sequence
  chemically synthesized
cgatggcgggctcgatggggat

SEQ ID NO: 46223 - DNA, 22 bp, Artificial Sequence
  chemically synthesized
gatggggataactctgacctta

SEQ ID NO: 46224 - DNA, 22 bp, Artificial Sequence
  chemically synthesized
tgaccttacctcatggagtcac

SEQ ID NO: 46225 - DNA, 22 bp, Artificial Sequence
  chemically synthesized
accttacctcatggagtcactg

SEQ ID NO: 46226 - DNA, 22 bp, Artificial Sequence
  chemically synthesized
acctcatggagtcactgtcaac

SEQ ID NO: 46227 - DNA, 22 bp, Artificial Sequence
  chemically synthesized
cctcatggagtcactgtcaacc

SEQ ID NO: 46228 - DNA, 22 bp, Artificial Sequence
  chemically synthesized
atggagtcactgtcaacccact

SEQ ID NO: 46229 - DNA, 22 bp, Artificial Sequence
  chemically synthesized
tcaacccactggttgcactgtc

SEQ ID NO: 46230 - DNA, 22 bp, Artificial Sequence
  chemically synthesized
gttgcactgtctttgtgcactg

SEQ ID NO: 46231 - DNA, 22 bp, Artificial Sequence
  chemically synthesized
cactgtctttgtgcactggctc

SEQ ID NO: 46232 - DNA, 22 bp, Artificial Sequence
  chemically synthesized
tctttgtgcactggctctctgg

SEQ ID NO: 46233 - DNA, 22 bp, Artificial Sequence
  chemically synthesized
tgtgcactggctctctggagtg

SEQ ID NO: 46234 - DNA, 22 bp, Artificial Sequence
  chemically synthesized
gtgcactggctctctggagtga

SEQ ID NO: 46235 - DNA, 22 bp, Artificial Sequence
  chemically synthesized
tgcactggctctctggagtgag

SEQ ID NO: 46236 - DNA, 22 bp, Artificial Sequence
  chemically synthesized
gctctctggagtgaggtctttg

SEQ ID NO: 46237 - DNA, 22 bp, Artificial Sequence
  chemically synthesized
tctggagtgaggtctttgcaaa

SEQ ID NO: 46238 - DNA, 22 bp, Artificial Sequence
  chemically synthesized
tggagtgaggtctttgcaaaca

SEQ ID NO: 46239 - DNA, 22 bp, Artificial Sequence
  chemically synthesized
gagtgaggtctttgcaaacaaa

SEQ ID NO: 46240 - DNA, 22 bp, Artificial Sequence
  chemically synthesized
tgcaaacaaagtggaaagagca

SEQ ID NO: 46241 - DNA, 22 bp, Artificial Sequence
  chemically synthesized
gcaaacaaagtggaaagagcat

SEQ ID NO: 46242 - DNA, 22 bp, Artificial Sequence
  chemically synthesized
caaacaaagtggaaagagcatc

SEQ ID NO: 46243 - DNA, 22 bp, Artificial Sequence
  chemically synthesized
tggactccagcacctagattca

SEQ ID NO: 46244 - DNA, 22 bp, Artificial Sequence
  chemically synthesized
ggactccagcacctagattcag

SEQ ID NO: 46245 - DNA, 22 bp, Artificial Sequence
  chemically synthesized
gactccagcacctagattcaga

SEQ ID NO: 46246 - DNA, 22 bp, Artificial Sequence
  chemically synthesized
cagcacctagattcagagcagg

SEQ ID NO: 46247 - DNA, 22 bp, Artificial Sequence
  chemically synthesized
gattcagagcaggccatttcac

SEQ ID NO: 46248 - DNA, 22 bp, Artificial Sequence
  chemically synthesized
agagcaggccatttcactcgga

SEQ ID NO: 46249 - DNA, 22 bp, Artificial Sequence
  chemically synthesized
cactcggaatctgctgtgcatc

SEQ ID NO: 46250 - DNA, 22 bp, Artificial Sequence
  chemically synthesized
actcggaatctgctgtgcatct

SEQ ID NO: 46251 - DNA, 22 bp, Artificial Sequence
  chemically synthesized
ggaatctgctgtgcatctgcaa

SEQ ID NO: 46252 - DNA, 22 bp, Artificial Sequence
  chemically synthesized
ctgtgcatctgcaagggaggat

SEQ ID NO: 46253 - DNA, 22 bp, Artificial Sequence
  chemically synthesized
tgcatctgcaagggaggatcat

SEQ ID NO: 46254 - DNA, 22 bp, Artificial Sequence
  chemically synthesized
caagggaggatcataaattcgc

SEQ ID NO: 46255 - DNA, 22 bp, Artificial Sequence
  chemically synthesized
gcctttgtttcttcccagtatc

SEQ ID NO: 46256 - DNA, 22 bp, Artificial Sequence
  chemically synthesized
tgtttcttcccagtatcgacag

SEQ ID NO: 46257 - DNA, 22 bp, Artificial Sequence
  chemically synthesized
gtttcttcccagtatcgacagc

SEQ ID NO: 46258 - DNA, 22 bp, Artificial Sequence
  chemically synthesized
tttcttcccagtatcgacagcc

SEQ ID NO: 46259 - DNA, 22 bp, Artificial Sequence
  chemically synthesized
cttcccagtatcgacagccctt

SEQ ID NO: 46260 - DNA, 22 bp, Artificial Sequence
  chemically synthesized
ttcccagtatcgacagcccttc

SEQ ID NO: 46261 - DNA, 22 bp, Artificial Sequence
  chemically synthesized
cccagtatcgacagcccttcca

SEQ ID NO: 46262 - DNA, 22 bp, Artificial Sequence
  chemically synthesized
ccagtatcgacagcccttccag

SEQ ID NO: 46263 - DNA, 22 bp, Artificial Sequence
  chemically synthesized
ccagaaagagcaagcctcatgt

SEQ ID NO: 46264 - DNA, 22 bp, Artificial Sequence
  chemically synthesized
cagaaagagcaagcctcatgtc

SEQ ID NO: 46265 - DNA, 22 bp, Artificial Sequence
  chemically synthesized
atgtcatgccacatgtacaatc

SEQ ID NO: 46266 - DNA, 22 bp, Artificial Sequence
  chemically synthesized
aggccaggagctctctttcccc

SEQ ID NO: 46267 - DNA, 22 bp, Artificial Sequence
  chemically synthesized
tctttccccttttcatcctcct

SEQ ID NO: 46268 - DNA, 22 bp, Artificial Sequence
  chemically synthesized
tttccccttttcatcctcctgc

SEQ ID NO: 46269 - DNA, 22 bp, Artificial Sequence
  chemically synthesized
tccccttttcatcctcctgcct

SEQ ID NO: 46270 - DNA, 22 bp, Artificial Sequence
  chemically synthesized
ccccttttcatcctcctgcctg

SEQ ID NO: 46271 - DNA, 22 bp, Artificial Sequence
  chemically synthesized
cccttttcatcctcctgcctgg

SEQ ID NO: 46272 - DNA, 22 bp, Artificial Sequence
  chemically synthesized
ttcatcctcctgcctggtacac

SEQ ID NO: 46273 - DNA, 22 bp, Artificial Sequence
  chemically synthesized
tcatcctcctgcctggtacaca

SEQ ID NO: 46274 - DNA, 22 bp, Artificial Sequence
  chemically synthesized
catcctcctgcctggtacacaa

SEQ ID NO: 46275 - DNA, 22 bp, Artificial Sequence
  chemically synthesized
atcctcctgcctggtacacaat

SEQ ID NO: 46276 - DNA, 22 bp, Artificial Sequence
  chemically synthesized
ctgcctggtacacaataggtgt

SEQ ID NO: 46277 - DNA, 22 bp, Artificial Sequence
  chemically synthesized
cctggtacacaataggtgttta

SEQ ID NO: 46278 - DNA, 22 bp, Artificial Sequence
  chemically synthesized
gtacacaataggtgtttactgg

SEQ ID NO: 46279 - DNA, 22 bp, Artificial Sequence
  chemically synthesized
actggatgcttgtccagttgat

SEQ ID NO: 46280 - DNA, 22 bp, Artificial Sequence
  chemically synthesized
ctggatgcttgtccagttgatt

SEQ ID NO: 46281 - DNA, 22 bp, Artificial Sequence
  chemically synthesized
gatgcttgtccagttgatttct

SEQ ID NO: 46282 - DNA, 22 bp, Artificial Sequence
  chemically synthesized
gtccagttgatttcttgaacat

SEQ ID NO: 46283 - DNA, 22 bp, Artificial Sequence
  chemically synthesized
tccagttgatttcttgaacatg

SEQ ID NO: 46284 - DNA, 22 bp, Artificial Sequence
  chemically synthesized
atttcttgaacatggtgtgtaa

SEQ ID NO: 46285 - DNA, 22 bp, Artificial Sequence
  chemically synthesized
cttgaacatggtgtgtaaaagg

SEQ ID NO: 46286 - DNA, 22 bp, Artificial Sequence
  chemically synthesized
ttgaacatggtgtgtaaaagga

SEQ ID NO: 46287 - DNA, 22 bp, Artificial Sequence
  chemically synthesized
gaacatggtgtgtaaaaggaat

SEQ ID NO: 46288 - DNA, 22 bp, Artificial Sequence
  chemically synthesized
aacatggtgtgtaaaaggaatc

SEQ ID NO: 46289 - DNA, 22 bp, Artificial Sequence
  chemically synthesized
tgcaaattgaatcttctggaaa

SEQ ID NO: 46290 - DNA, 22 bp, Artificial Sequence
  chemically synthesized
gcaaattgaatcttctggaaag

SEQ ID NO: 46291 - DNA, 22 bp, Artificial Sequence
  chemically synthesized
caaattgaatcttctggaaagc

SEQ ID NO: 46292 - DNA, 22 bp, Artificial Sequence
  chemically synthesized
aatcttctggaaagctgagctt

SEQ ID NO: 46293 - DNA, 22 bp, Artificial Sequence
  chemically synthesized
ctggaaagctgagcttgtgcct

SEQ ID NO: 46294 - DNA, 22 bp, Artificial Sequence
  chemically synthesized
tggaaagctgagcttgtgccta

SEQ ID NO: 46295 - DNA, 22 bp, Artificial Sequence
  chemically synthesized
gaaagctgagcttgtgcctacc

SEQ ID NO: 46296 - DNA, 22 bp, Artificial Sequence
  chemically synthesized
agcttgtgcctaccatagaatt

SEQ ID NO: 46297 - DNA, 22 bp, Artificial Sequence
  chemically synthesized
gtgcctaccatagaattctgaa

SEQ ID NO: 46298 - DNA, 22 bp, Artificial Sequence
  chemically synthesized
tgcctaccatagaattctgaat

SEQ ID NO: 46299 - DNA, 22 bp, Artificial Sequence
  chemically synthesized
ccatagaattctgaatgtacct

SEQ ID NO: 46300 - DNA, 22 bp, Artificial Sequence
  chemically synthesized
tgaatgtacctatatgacgtct

SEQ ID NO: 46301 - DNA, 22 bp, Artificial Sequence
  chemically synthesized
aatgtacctatatgacgtcttt

SEQ ID NO: 46302 - DNA, 22 bp, Artificial Sequence
  chemically synthesized
tatgacgtctttgcaaacttaa

SEQ ID NO: 46303 - DNA, 22 bp, Artificial Sequence
  chemically synthesized
tgcaaacttaaaacctgaatct

SEQ ID NO: 46304 - DNA, 22 bp, Artificial Sequence
  chemically synthesized
gcaaacttaaaacctgaatctt

SEQ ID NO: 46305 - DNA, 22 bp, Artificial Sequence
  chemically synthesized
caaacttaaaacctgaatcttt

SEQ ID NO: 46306 - DNA, 22 bp, Artificial Sequence
  chemically synthesized
aaaacctgaatctttgtagtat

SEQ ID NO: 46307 - DNA, 22 bp, Artificial Sequence
  chemically synthesized
aaacctgaatctttgtagtata

SEQ ID NO: 46308 - DNA, 22 bp, Artificial Sequence
  chemically synthesized
aatctttgtagtataaatccct

SEQ ID NO: 46309 - DNA, 22 bp, Artificial Sequence
  chemically synthesized
tgtagtataaatcccttgaaat

SEQ ID NO: 46310 - DNA, 22 bp, Artificial Sequence
  chemically synthesized
gtagtataaatcccttgaaatg

SEQ ID NO: 46311 - DNA, 22 bp, Artificial Sequence
  chemically synthesized
tagtataaatcccttgaaatgc

SEQ ID NO: 46312 - DNA, 22 bp, Artificial Sequence
  chemically synthesized
gaaatgcatgtaggctggacat

SEQ ID NO: 46313 - DNA, 22 bp, Artificial Sequence
  chemically synthesized
aaatgcatgtaggctggacatc

SEQ ID NO: 46314 - DNA, 22 bp, Artificial Sequence
  chemically synthesized
gacatcaaaagcaagcaatctc

SEQ ID NO: 46315 - DNA, 22 bp, Artificial Sequence
  chemically synthesized
ttcaaggagcagctagttggta

SEQ ID NO: 46316 - DNA, 22 bp, Artificial Sequence
  chemically synthesized
caaggagcagctagttggtaag

SEQ ID NO: 46317 - DNA, 22 bp, Artificial Sequence
  chemically synthesized
aaggagcagctagttggtaagg

SEQ ID NO: 46318 - DNA, 22 bp, Artificial Sequence
  chemically synthesized
gttggtaaggtcagtgtgcagg

SEQ ID NO: 46319 - DNA, 22 bp, Artificial Sequence
  chemically synthesized
gtaaggtcagtgtgcagggtgc

SEQ ID NO: 46320 - DNA, 22 bp, Artificial Sequence
  chemically synthesized
agtttagaaggctgccaggtta

SEQ ID NO: 46321 - DNA, 22 bp, Artificial Sequence
  chemically synthesized
agaaggctgccaggttaaggcc

SEQ ID NO: 46322 - DNA, 22 bp, Artificial Sequence
  chemically synthesized
gaaggctgccaggttaaggcca

SEQ ID NO: 46323 - DNA, 22 bp, Artificial Sequence
  chemically synthesized
ccaggttaaggccagtggaaag

SEQ ID NO: 46324 - DNA, 22 bp, Artificial Sequence
  chemically synthesized
aggccagtggaaagaattcggt

SEQ ID NO: 46325 - DNA, 22 bp, Artificial Sequence
  chemically synthesized
ggtgggcagcgaggagtccaca

SEQ ID NO: 46326 - DNA, 22 bp, Artificial Sequence
  chemically synthesized
attcagaagtctcactggtcag

SEQ ID NO: 46327 - DNA, 22 bp, Artificial Sequence
  chemically synthesized
agaagtctcactggtcagcagg

SEQ ID NO: 46328 - DNA, 22 bp, Artificial Sequence
  chemically synthesized
actggtcagcaggagacaaggt

SEQ ID NO: 46329 - DNA, 22 bp, Artificial Sequence
  chemically synthesized
gtcagcaggagacaaggtggac

SEQ ID NO: 46330 - DNA, 22 bp, Artificial Sequence
  chemically synthesized
aaaaggtgggcccggcagaact

SEQ ID NO: 46331 - DNA, 22 bp, Artificial Sequence
  chemically synthesized
ggagtctggcatcccacgcagg

SEQ ID NO: 46332 - DNA, 22 bp, Artificial Sequence
  chemically synthesized
gagtctggcatcccacgcaggg

SEQ ID NO: 46333 - DNA, 22 bp, Artificial Sequence
  chemically synthesized
gcatcccacgcagggtgagagg

SEQ ID NO: 46334 - DNA, 22 bp, Artificial Sequence
  chemically synthesized
gggcgccggcctgccttccagc

SEQ ID NO: 46335 - DNA, 22 bp, Artificial Sequence
  chemically synthesized
ccttccagcccagttaggattt

SEQ ID NO: 46336 - DNA, 22 bp, Artificial Sequence
  chemically synthesized
ccagcccagttaggatttggga

SEQ ID NO: 46337 - DNA, 22 bp, Artificial Sequence
  chemically synthesized
cagcccagttaggatttgggag

SEQ ID NO: 46338 - DNA, 22 bp, Artificial Sequence
  chemically synthesized
ggatttgggagttttttcttcc

SEQ ID NO: 46339 - DNA, 22 bp, Artificial Sequence
  chemically synthesized
gggagttttttcttccctctgc

SEQ ID NO: 46340 - DNA, 22 bp, Artificial Sequence
  chemically synthesized
ggagttttttcttccctctgcg

SEQ ID NO: 46341 - DNA, 22 bp, Artificial Sequence
  chemically synthesized
tttcttccctctgcgcgtaatc

SEQ ID NO: 46342 - DNA, 22 bp, Artificial Sequence
  chemically synthesized
ttcttccctctgcgcgtaatct

SEQ ID NO: 46343 - DNA, 22 bp, Artificial Sequence
  chemically synthesized
tcttccctctgcgcgtaatctg

SEQ ID NO: 46344 - DNA, 22 bp, Artificial Sequence
  chemically synthesized
cttccctctgcgcgtaatctga

SEQ ID NO: 46345 - DNA, 22 bp, Artificial Sequence
  chemically synthesized
ttccctctgcgcgtaatctgac

SEQ ID NO: 46346 - DNA, 22 bp, Artificial Sequence
  chemically synthesized
ccctctgcgcgtaatctgacgc

SEQ ID NO: 46347 - DNA, 22 bp, Artificial Sequence
  chemically synthesized
cctctgcgcgtaatctgacgct

SEQ ID NO: 46348 - DNA, 22 bp, Artificial Sequence
  chemically synthesized
tgcgcgtaatctgacgctgttt

SEQ ID NO: 46349 - DNA, 22 bp, Artificial Sequence
  chemically synthesized
cgcgtaatctgacgctgtttgg

SEQ ID NO: 46350 - DNA, 22 bp, Artificial Sequence
  chemically synthesized
acgctgtttggggagggcgagg

SEQ ID NO: 46351 - DNA, 22 bp, Artificial Sequence
  chemically synthesized
tttggggagggcgaggccgaaa

SEQ ID NO: 46352 - DNA, 22 bp, Artificial Sequence
  chemically synthesized
ggggagggcgaggccgaaacct

SEQ ID NO: 46353 - DNA, 22 bp, Artificial Sequence
  chemically synthesized
gggagggcgaggccgaaacctg

SEQ ID NO: 46354 - DNA, 22 bp, Artificial Sequence
  chemically synthesized
atcctccagtccgggggttccg

SEQ ID NO: 46355 - DNA, 22 bp, Artificial Sequence
  chemically synthesized
cagtccgggggttccgttaatg

SEQ ID NO: 46356 - DNA, 22 bp, Artificial Sequence
  chemically synthesized
cgttaatgtttaatcagatagg

SEQ ID NO: 46357 - DNA, 22 bp, Artificial Sequence
  chemically synthesized
atgtttaatcagataggatcgt

SEQ ID NO: 46358 - DNA, 22 bp, Artificial Sequence
  chemically synthesized
aatcagataggatcgtccgatg

SEQ ID NO: 46359 - DNA, 22 bp, Artificial Sequence
  chemically synthesized
atcagataggatcgtccgatgg

SEQ ID NO: 46360 - DNA, 22 bp, Artificial Sequence
  chemically synthesized
tggtggcgtgatctgcgcgccc

SEQ ID NO: 46361 - DNA, 22 bp, Artificial Sequence
  chemically synthesized
gtggcgtgatctgcgcgcccca

SEQ ID NO: 46362 - DNA, 22 bp, Artificial Sequence
  chemically synthesized
cgcgccccaggcgtcaagcacc

SEQ ID NO: 46363 - DNA, 22 bp, Artificial Sequence
  chemically synthesized
gaaggtttccgcagcgacgtcg

SEQ ID NO: 46364 - DNA, 22 bp, Artificial Sequence
  chemically synthesized
ccgcagcgacgtcgaggcgctc

SEQ ID NO: 46365 - DNA, 22 bp, Artificial Sequence
  chemically synthesized
cgcagcgacgtcgaggcgctca

SEQ ID NO: 46366 - DNA, 22 bp, Artificial Sequence
  chemically synthesized
atggttgcaggcgggcgccgcc

SEQ ID NO: 46367 - DNA, 22 bp, Artificial Sequence
  chemically synthesized
caggcgggcgccgccgttcagt

SEQ ID NO: 46368 - DNA, 22 bp, Artificial Sequence
  chemically synthesized
agttcagggtctgagcctggag

SEQ ID NO: 46369 - DNA, 22 bp, Artificial Sequence
  chemically synthesized
agggtctgagcctggaggagtg

SEQ ID NO: 46370 - DNA, 22 bp, Artificial Sequence
  chemically synthesized
agcctggaggagtgagccaggc

SEQ ID NO: 46371 - DNA, 22 bp, Artificial Sequence
  chemically synthesized
gaggagtgagccaggcagtgag

SEQ ID NO: 46372 - DNA, 22 bp, Artificial Sequence
  chemically synthesized
gctcgggcgggccgggacgcgt

SEQ ID NO: 46373 - DNA, 22 bp, Artificial Sequence
  chemically synthesized
gggcgggccgggacgcgtcgtt

SEQ ID NO: 46374 - DNA, 22 bp, Artificial Sequence
  chemically synthesized
cagcagcggctcccagctccca

SEQ ID NO: 46375 - DNA, 22 bp, Artificial Sequence
  chemically synthesized
ccagctcccagccaggattccg

SEQ ID NO: 46376 - DNA, 22 bp, Artificial Sequence
  chemically synthesized
ccagccaggattccgcgcgccc

SEQ ID NO: 46377 - DNA, 22 bp, Artificial Sequence
  chemically synthesized
cgcgcgccccttcacgcgccct

SEQ ID NO: 46378 - DNA, 22 bp, Artificial Sequence
  chemically synthesized
cacgcgccctgctcctgaactt

SEQ ID NO: 46379 - DNA, 22 bp, Artificial Sequence
  chemically synthesized
acgcgccctgctcctgaacttc

SEQ ID NO: 46380 - DNA, 22 bp, Artificial Sequence
  chemically synthesized
ctcctgaacttcagctcctgca

SEQ ID NO: 46381 - DNA, 22 bp, Artificial Sequence
  chemically synthesized
ctgaacttcagctcctgcacag

SEQ ID NO: 46382 - DNA, 22 bp, Artificial Sequence
  chemically synthesized
aacttcagctcctgcacagtcc

SEQ ID NO: 46383 - DNA, 22 bp, Artificial Sequence
  chemically synthesized
cagctcctgcacagtcctcccc

SEQ ID NO: 46384 - DNA, 22 bp, Artificial Sequence
  chemically synthesized
agctcctgcacagtcctcccca

SEQ ID NO: 46385 - DNA, 22 bp, Artificial Sequence
  chemically synthesized
ctgcacagtcctccccaccgca

SEQ ID NO: 46386 - DNA, 22 bp, Artificial Sequence
  chemically synthesized
cacagtcctccccaccgcaagg

SEQ ID NO: 46387 - DNA, 22 bp, Artificial Sequence
  chemically synthesized
cccaccgcaaggctcaaggcgc

SEQ ID NO: 46388 - DNA, 22 bp, Artificial Sequence
  chemically synthesized
aaggcgccgccggcgtggaccg

SEQ ID NO: 46389 - DNA, 22 bp, Artificial Sequence
  chemically synthesized
taggtctcctcgccaggacagc

SEQ ID NO: 46390 - DNA, 22 bp, Artificial Sequence
  chemically synthesized
ggtctcctcgccaggacagcaa

SEQ ID NO: 46391 - DNA, 22 bp, Artificial Sequence
  chemically synthesized
ctcgccaggacagcaacctctc

SEQ ID NO: 46392 - DNA, 22 bp, Artificial Sequence
  chemically synthesized
gccaggacagcaacctctcccc

SEQ ID NO: 46393 - DNA, 22 bp, Artificial Sequence
  chemically synthesized
tcccctggccctcatgggcacc

SEQ ID NO: 46394 - DNA, 22 bp, Artificial Sequence
  chemically synthesized
ccctggccctcatgggcaccgt

SEQ ID NO: 46395 - DNA, 22 bp, Artificial Sequence
  chemically synthesized
gccctcatgggcaccgtcagct

SEQ ID NO: 46396 - DNA, 22 bp, Artificial Sequence
  chemically synthesized
atgggcaccgtcagctccaggc

SEQ ID NO: 46397 - DNA, 22 bp, Artificial Sequence
  chemically synthesized
caggcggtcctggtggccgctg

SEQ ID NO: 46398 - DNA, 22 bp, Artificial Sequence
  chemically synthesized
gtggccgctgccactgctgctg

SEQ ID NO: 46399 - DNA, 22 bp, Artificial Sequence
  chemically synthesized
ccactgctgctgctgctgctgc

SEQ ID NO: 46400 - DNA, 22 bp, Artificial Sequence
  chemically synthesized
ctgctgctgctgctgctgctcc

SEQ ID NO: 46401 - DNA, 22 bp, Artificial Sequence
  chemically synthesized
ctgctgctgctgctgctcctgg

SEQ ID NO: 46402 - DNA, 22 bp, Artificial Sequence
  chemically synthesized
ctgctgctgctgctcctgggtc

SEQ ID NO: 46403 - DNA, 22 bp, Artificial Sequence
  chemically synthesized
ctgctgctgctcctgggtcccg

SEQ ID NO: 46404 - DNA, 22 bp, Artificial Sequence
  chemically synthesized
ctgctgctcctgggtcccgcgg

SEQ ID NO: 46405 - DNA, 22 bp, Artificial Sequence
  chemically synthesized
ctgctcctgggtcccgcgggcg

SEQ ID NO: 46406 - DNA, 22 bp, Artificial Sequence
  chemically synthesized
ctcctgggtcccgcgggcgccc

SEQ ID NO: 46407 - DNA, 22 bp, Artificial Sequence
  chemically synthesized
ctgggtcccgcgggcgcccgtg

SEQ ID NO: 46408 - DNA, 22 bp, Artificial Sequence
  chemically synthesized
ggtcccgcgggcgcccgtgcgc

SEQ ID NO: 46409 - DNA, 22 bp, Artificial Sequence
  chemically synthesized
cgaggagctggtgctagccttg

SEQ ID NO: 46410 - DNA, 22 bp, Artificial Sequence
  chemically synthesized
gtgctagccttgcgttccgagg

SEQ ID NO: 46411 - DNA, 22 bp, Artificial Sequence
  chemically synthesized
gccttgcgttccgaggaggacg

SEQ ID NO: 46412 - DNA, 22 bp, Artificial Sequence
  chemically synthesized
gcgttccgaggaggacggcctg

SEQ ID NO: 46413 - DNA, 22 bp, Artificial Sequence
  chemically synthesized
cgttccgaggaggacggcctgg

SEQ ID NO: 46414 - DNA, 22 bp, Artificial Sequence
  chemically synthesized
cgaggaggacggcctggccgaa

SEQ ID NO: 46415 - DNA, 22 bp, Artificial Sequence
  chemically synthesized
gccgaagcacccgagcacggaa

SEQ ID NO: 46416 - DNA, 22 bp, Artificial Sequence
  chemically synthesized
ccaccgctgcgccaaggtgcgg

SEQ ID NO: 46417 - DNA, 22 bp, Artificial Sequence
  chemically synthesized
caccgctgcgccaaggtgcggg

SEQ ID NO: 46418 - DNA, 22 bp, Artificial Sequence
  chemically synthesized
cgccaaggtgcgggtgtaggga

SEQ ID NO: 46419 - DNA, 22 bp, Artificial Sequence
  chemically synthesized
tttcctctcgggcctcagtttc

SEQ ID NO: 46420 - DNA, 22 bp, Artificial Sequence
  chemically synthesized
cctctcgggcctcagtttcccc

SEQ ID NO: 46421 - DNA, 22 bp, Artificial Sequence
  chemically synthesized
ctctcgggcctcagtttccccc

SEQ ID NO: 46422 - DNA, 22 bp, Artificial Sequence
  chemically synthesized
tcgggcctcagtttccccccat

SEQ ID NO: 46423 - DNA, 22 bp, Artificial Sequence
  chemically synthesized
gggcctcagtttccccccatgt

SEQ ID NO: 46424 - DNA, 22 bp, Artificial Sequence
  chemically synthesized
agtttccccccatgtaagagag

SEQ ID NO: 46425 - DNA, 22 bp, Artificial Sequence
  chemically synthesized
ccccccatgtaagagaggaagt

SEQ ID NO: 46426 - DNA, 22 bp, Artificial Sequence
  chemically synthesized
cccccatgtaagagaggaagtg

SEQ ID NO: 46427 - DNA, 22 bp, Artificial Sequence
  chemically synthesized
ttcgcttggcacgatcttgggg

SEQ ID NO: 46428 - DNA, 22 bp, Artificial Sequence
  chemically synthesized
cgcttggcacgatcttggggac

SEQ ID NO: 46429 - DNA, 22 bp, Artificial Sequence
  chemically synthesized
gcttggcacgatcttggggact

SEQ ID NO: 46430 - DNA, 22 bp, Artificial Sequence
  chemically synthesized
ggcacgatcttggggactgcag

SEQ ID NO: 46431 - DNA, 22 bp, Artificial Sequence
  chemically synthesized
gcacgatcttggggactgcagg

SEQ ID NO: 46432 - DNA, 22 bp, Artificial Sequence
  chemically synthesized
ggggactgcaggcaaggcggcg

SEQ ID NO: 46433 - DNA, 22 bp, Artificial Sequence
  chemically synthesized
gggactgcaggcaaggcggcgg

SEQ ID NO: 46434 - DNA, 22 bp, Artificial Sequence
  chemically synthesized
caggcaaggcggcgggggagga

SEQ ID NO: 46435 - DNA, 22 bp, Artificial Sequence
  chemically synthesized
tttggggacttgctggggcgtg

SEQ ID NO: 46436 - DNA, 22 bp, Artificial Sequence
  chemically synthesized
tggggacttgctggggcgtgcg

SEQ ID NO: 46437 - DNA, 22 bp, Artificial Sequence
  chemically synthesized
ggggacttgctggggcgtgcgg

SEQ ID NO: 46438 - DNA, 22 bp, Artificial Sequence
  chemically synthesized
gggacttgctggggcgtgcggc

SEQ ID NO: 46439 - DNA, 22 bp, Artificial Sequence
  chemically synthesized
gctggggcgtgcggctgcgcta

SEQ ID NO: 46440 - DNA, 22 bp, Artificial Sequence
  chemically synthesized
ctggggcgtgcggctgcgctat

SEQ ID NO: 46441 - DNA, 22 bp, Artificial Sequence
  chemically synthesized
gggcgtgcggctgcgctattca

SEQ ID NO: 46442 - DNA, 22 bp, Artificial Sequence
  chemically synthesized
cgctattcagtgggaaggttcg

SEQ ID NO: 46443 - DNA, 22 bp, Artificial Sequence
  chemically synthesized
ttcagtgggaaggttcgcgggg

SEQ ID NO: 46444 - DNA, 22 bp, Artificial Sequence
  chemically synthesized
agtgggaaggttcgcggggttg

SEQ ID NO: 46445 - DNA, 22 bp, Artificial Sequence
  chemically synthesized
gcggggttgggagacccggagg

SEQ ID NO: 46446 - DNA, 22 bp, Artificial Sequence
  chemically synthesized
ggagacccggaggccgaggaag

SEQ ID NO: 46447 - DNA, 22 bp, Artificial Sequence
  chemically synthesized
ccaggatatcctgcccagattt

SEQ ID NO: 46448 - DNA, 22 bp, Artificial Sequence
  chemically synthesized
cccagatttcccagtttctgcc

SEQ ID NO: 46449 - DNA, 22 bp, Artificial Sequence
  chemically synthesized
cccagtttctgcctcgccgcgg

SEQ ID NO: 46450 - DNA, 22 bp, Artificial Sequence
  chemically synthesized
ccagtttctgcctcgccgcggc

SEQ ID NO: 46451 - DNA, 22 bp, Artificial Sequence
  chemically synthesized
ctgcctcgccgcggcacaggtg

SEQ ID NO: 46452 - DNA, 22 bp, Artificial Sequence
  chemically synthesized
tgcctcgccgcggcacaggtgg

SEQ ID NO: 46453 - DNA, 22 bp, Artificial Sequence
  chemically synthesized
cctcgccgcggcacaggtgggt

SEQ ID NO: 46454 - DNA, 22 bp, Artificial Sequence
  chemically synthesized
gccgcggcacaggtgggtgaag

SEQ ID NO: 46455 - DNA, 22 bp, Artificial Sequence
  chemically synthesized
gaacgtactgggaactgcacca

SEQ ID NO: 46456 - DNA, 22 bp, Artificial Sequence
  chemically synthesized
ggaactgcaccaggcacagaga

SEQ ID NO: 46457 - DNA, 22 bp, Artificial Sequence
  chemically synthesized
caccaggcacagagaaagcggg

SEQ ID NO: 46458 - DNA, 22 bp, Artificial Sequence
  chemically synthesized
gccattatagtgggttccgatt

SEQ ID NO: 46459 - DNA, 22 bp, Artificial Sequence
  chemically synthesized
ccattatagtgggttccgattt

SEQ ID NO: 46460 - DNA, 22 bp, Artificial Sequence
  chemically synthesized
tagtgggttccgatttggtttg

SEQ ID NO: 46461 - DNA, 22 bp, Artificial Sequence
  chemically synthesized
cgatttggtttggaaaacatgg

SEQ ID NO: 46462 - DNA, 22 bp, Artificial Sequence
  chemically synthesized
ggtttggaaaacatgggcagcg

SEQ ID NO: 46463 - DNA, 22 bp, Artificial Sequence
  chemically synthesized
gtttggaaaacatgggcagcgg

SEQ ID NO: 46464 - DNA, 22 bp, Artificial Sequence
  chemically synthesized
ggaaaacatgggcagcggaggg

SEQ ID NO: 46465 - DNA, 22 bp, Artificial Sequence
  chemically synthesized
gaaaacatgggcagcggagggt

SEQ ID NO: 46466 - DNA, 22 bp, Artificial Sequence
  chemically synthesized
gagagaaggccctacccgagac

SEQ ID NO: 46467 - DNA, 22 bp, Artificial Sequence
  chemically synthesized
cccgagacaggggcggggtggg

SEQ ID NO: 46468 - DNA, 22 bp, Artificial Sequence
  chemically synthesized
ggagcacgaggcaatttcttta

SEQ ID NO: 46469 - DNA, 22 bp, Artificial Sequence
  chemically synthesized
ctttatgacacagaactcatgc

SEQ ID NO: 46470 - DNA, 22 bp, Artificial Sequence
  chemically synthesized
tttatgacacagaactcatgct

SEQ ID NO: 46471 - DNA, 22 bp, Artificial Sequence
  chemically synthesized
tatgacacagaactcatgctct

SEQ ID NO: 46472 - DNA, 22 bp, Artificial Sequence
  chemically synthesized
atgacacagaactcatgctcta

SEQ ID NO: 46473 - DNA, 22 bp, Artificial Sequence
  chemically synthesized
tgacacagaactcatgctctag

SEQ ID NO: 46474 - DNA, 22 bp, Artificial Sequence
  chemically synthesized
atgctctagtattccatctgtt

SEQ ID NO: 46475 - DNA, 22 bp, Artificial Sequence
  chemically synthesized
tagtattccatctgtttcagcc

SEQ ID NO: 46476 - DNA, 22 bp, Artificial Sequence
  chemically synthesized
gtattccatctgtttcagccga

SEQ ID NO: 46477 - DNA, 22 bp, Artificial Sequence
  chemically synthesized
catctgtttcagccgaagaaaa

SEQ ID NO: 46478 - DNA, 22 bp, Artificial Sequence
  chemically synthesized
tttcagccgaagaaaagaacca

SEQ ID NO: 46479 - DNA, 22 bp, Artificial Sequence
  chemically synthesized
cagccgaagaaaagaaccagct

SEQ ID NO: 46480 - DNA, 22 bp, Artificial Sequence
  chemically synthesized
agccgaagaaaagaaccagctg

SEQ ID NO: 46481 - DNA, 22 bp, Artificial Sequence
  chemically synthesized
aaggggcaggggagaaggggcg

SEQ ID NO: 46482 - DNA, 22 bp, Artificial Sequence
  chemically synthesized
tcgaggcccattggcgtccttt

SEQ ID NO: 46483 - DNA, 22 bp, Artificial Sequence
  chemically synthesized
gaggcccattggcgtcctttag

SEQ ID NO: 46484 - DNA, 22 bp, Artificial Sequence
  chemically synthesized
gcgtcctttaggactcaggcag

SEQ ID NO: 46485 - DNA, 22 bp, Artificial Sequence
  chemically synthesized
taggactcaggcagggaagggc

SEQ ID NO: 46486 - DNA, 22 bp, Artificial Sequence
  chemically synthesized
aggactcaggcagggaagggcc

SEQ ID NO: 46487 - DNA, 22 bp, Artificial Sequence
  chemically synthesized
ggactcaggcagggaagggccc

SEQ ID NO: 46488 - DNA, 22 bp, Artificial Sequence
  chemically synthesized
aggcagggaagggcccttggtg

SEQ ID NO: 46489 - DNA, 22 bp, Artificial Sequence
  chemically synthesized
ggtgctctggagccggaggtgg

SEQ ID NO: 46490 - DNA, 22 bp, Artificial Sequence
  chemically synthesized
gtgctctggagccggaggtggt

SEQ ID NO: 46491 - DNA, 22 bp, Artificial Sequence
  chemically synthesized
tggagccggaggtggtgcgcct

SEQ ID NO: 46492 - DNA, 22 bp, Artificial Sequence
  chemically synthesized
gagccggaggtggtgcgcctgg

SEQ ID NO: 46493 - DNA, 22 bp, Artificial Sequence
  chemically synthesized
gtactgggaccccggagctgag

SEQ ID NO: 46494 - DNA, 22 bp, Artificial Sequence
  chemically synthesized
ggaccccggagctgagcccggc

SEQ ID NO: 46495 - DNA, 22 bp, Artificial Sequence
  chemically synthesized
agcccggcgcctcagcccacct

SEQ ID NO: 46496 - DNA, 22 bp, Artificial Sequence
  chemically synthesized
agcccacctggctgtctgccga

SEQ ID NO: 46497 - DNA, 22 bp, Artificial Sequence
  chemically synthesized
gctgtctgccgaccgtgtgcgg

SEQ ID NO: 46498 - DNA, 22 bp, Artificial Sequence
  chemically synthesized
tctgccgaccgtgtgcggggcg

SEQ ID NO: 46499 - DNA, 22 bp, Artificial Sequence
  chemically synthesized
ccgaccgtgtgcggggcgagtt

SEQ ID NO: 46500 - DNA, 22 bp, Artificial Sequence
  chemically synthesized
gctcaacaactctgccagcttc

SEQ ID NO: 46501 - DNA, 22 bp, Artificial Sequence
  chemically synthesized
ctcaacaactctgccagcttct

SEQ ID NO: 46502 - DNA, 22 bp, Artificial Sequence
  chemically synthesized
aacaactctgccagcttctggc

SEQ ID NO: 46503 - DNA, 22 bp, Artificial Sequence
  chemically synthesized
tgccagcttctggccctcaggc

SEQ ID NO: 46504 - DNA, 22 bp, Artificial Sequence
  chemically synthesized
ccagcttctggccctcaggctg

SEQ ID NO: 46505 - DNA, 22 bp, Artificial Sequence
  chemically synthesized
ctggccctcaggctgtgggaag

SEQ ID NO: 46506 - DNA, 22 bp, Artificial Sequence
  chemically synthesized
tggccctcaggctgtgggaagc

SEQ ID NO: 46507 - DNA, 22 bp, Artificial Sequence
  chemically synthesized
gccctcaggctgtgggaagctt

SEQ ID NO: 46508 - DNA, 22 bp, Artificial Sequence
  chemically synthesized
aggctgtgggaagcttcttccc

SEQ ID NO: 46509 - DNA, 22 bp, Artificial Sequence
  chemically synthesized
tgggaagcttcttcccggggcg

SEQ ID NO: 46510 - DNA, 22 bp, Artificial Sequence
  chemically synthesized
cttcccggggcgagaccactag

SEQ ID NO: 46511 - DNA, 22 bp, Artificial Sequence
  chemically synthesized
ttcccggggcgagaccactagc

SEQ ID NO: 46512 - DNA, 22 bp, Artificial Sequence
  chemically synthesized
cccggggcgagaccactagctt

SEQ ID NO: 46513 - DNA, 22 bp, Artificial Sequence
  chemically synthesized
ccggggcgagaccactagcttt

SEQ ID NO: 46514 - DNA, 22 bp, Artificial Sequence
  chemically synthesized
gctttttctaagtattaccagc

SEQ ID NO: 46515 - DNA, 22 bp, Artificial Sequence
  chemically synthesized
tttctaagtattaccagcccag

SEQ ID NO: 46516 - DNA, 22 bp, Artificial Sequence
  chemically synthesized
ttctaagtattaccagcccagg

SEQ ID NO: 46517 - DNA, 22 bp, Artificial Sequence
  chemically synthesized
tctaagtattaccagcccagga

SEQ ID NO: 46518 - DNA, 22 bp, Artificial Sequence
  chemically synthesized
ctaagtattaccagcccaggac

SEQ ID NO: 46519 - DNA, 22 bp, Artificial Sequence
  chemically synthesized
taagtattaccagcccaggact

SEQ ID NO: 46520 - DNA, 22 bp, Artificial Sequence
  chemically synthesized
agtattaccagcccaggacttg

SEQ ID NO: 46521 - DNA, 22 bp, Artificial Sequence
  chemically synthesized
ccagcccaggacttggctgagg

SEQ ID NO: 46522 - DNA, 22 bp, Artificial Sequence
  chemically synthesized
ggctgaggttctgtgtccccca

SEQ ID NO: 46523 - DNA, 22 bp, Artificial Sequence
  chemically synthesized
gctgaggttctgtgtcccccag

SEQ ID NO: 46524 - DNA, 22 bp, Artificial Sequence
  chemically synthesized
aggttctgtgtcccccagcttg

SEQ ID NO: 46525 - DNA, 22 bp, Artificial Sequence
  chemically synthesized
tgtgtcccccagcttggagtca

SEQ ID NO: 46526 - DNA, 22 bp, Artificial Sequence
  chemically synthesized
tgtcccccagcttggagtcaga

SEQ ID NO: 46527 - DNA, 22 bp, Artificial Sequence
  chemically synthesized
ggagtcagatgtggggttgaat

SEQ ID NO: 46528 - DNA, 22 bp, Artificial Sequence
  chemically synthesized
gagtcagatgtggggttgaatc

SEQ ID NO: 46529 - DNA, 22 bp, Artificial Sequence
  chemically synthesized
aatcttggcttcctctcactag

SEQ ID NO: 46530 - DNA, 22 bp, Artificial Sequence
  chemically synthesized
ggcttcctctcactagctgtgg

SEQ ID NO: 46531 - DNA, 22 bp, Artificial Sequence
  chemically synthesized
gcttcctctcactagctgtggt

SEQ ID NO: 46532 - DNA, 22 bp, Artificial Sequence
  chemically synthesized
cctctcactagctgtggtgctt

SEQ ID NO: 46533 - DNA, 22 bp, Artificial Sequence
  chemically synthesized
ctctcactagctgtggtgcttg

SEQ ID NO: 46534 - DNA, 22 bp, Artificial Sequence
  chemically synthesized
tcactagctgtggtgcttgaca

SEQ ID NO: 46535 - DNA, 22 bp, Artificial Sequence
  chemically synthesized
actagctgtggtgcttgacaag

SEQ ID NO: 46536 - DNA, 22 bp, Artificial Sequence
  chemically synthesized
gctgtggtgcttgacaagtcac

SEQ ID NO: 46537 - DNA, 22 bp, Artificial Sequence
  chemically synthesized
tggtgcttgacaagtcacttat

SEQ ID NO: 46538 - DNA, 22 bp, Artificial Sequence
  chemically synthesized
gacaagtcacttatccttgagc

SEQ ID NO: 46539 - DNA, 22 bp, Artificial Sequence
  chemically synthesized
acaagtcacttatccttgagcc

SEQ ID NO: 46540 - DNA, 22 bp, Artificial Sequence
  chemically synthesized
atccttgagcctccattgccta

SEQ ID NO: 46541 - DNA, 22 bp, Artificial Sequence
  chemically synthesized
tccttgagcctccattgcctaa

SEQ ID NO: 46542 - DNA, 22 bp, Artificial Sequence
  chemically synthesized
gagcctccattgcctaatcttt

SEQ ID NO: 46543 - DNA, 22 bp, Artificial Sequence
  chemically synthesized
agcctccattgcctaatcttta

SEQ ID NO: 46544 - DNA, 22 bp, Artificial Sequence
  chemically synthesized
cattgcctaatctttaaaaggg

SEQ ID NO: 46545 - DNA, 22 bp, Artificial Sequence
  chemically synthesized
cctaatctttaaaagggaggtg

SEQ ID NO: 46546 - DNA, 22 bp, Artificial Sequence
  chemically synthesized
atctttaaaagggaggtgacaa

SEQ ID NO: 46547 - DNA, 22 bp, Artificial Sequence
  chemically synthesized
taaaagggaggtgacaatcgtc

SEQ ID NO: 46548 - DNA, 22 bp, Artificial Sequence
  chemically synthesized
aaaagggaggtgacaatcgtcc

SEQ ID NO: 46549 - DNA, 22 bp, Artificial Sequence
  chemically synthesized
aaagggaggtgacaatcgtccc

SEQ ID NO: 46550 - DNA, 22 bp, Artificial Sequence
  chemically synthesized
cggctcagtggcagcagatggg

SEQ ID NO: 46551 - DNA, 22 bp, Artificial Sequence
  chemically synthesized
agtggcagcagatggggagatg

SEQ ID NO: 46552 - DNA, 22 bp, Artificial Sequence
  chemically synthesized
tgttgaccatgagtgaacttac

SEQ ID NO: 46553 - DNA, 22 bp, Artificial Sequence
  chemically synthesized
ttgaccatgagtgaacttacaa

SEQ ID NO: 46554 - DNA, 22 bp, Artificial Sequence
  chemically synthesized
accatgagtgaacttacaatgc

SEQ ID NO: 46555 - DNA, 22 bp, Artificial Sequence
  chemically synthesized
acaatgcaagccccggggggat

SEQ ID NO: 46556 - DNA, 22 bp, Artificial Sequence
  chemically synthesized
caatgcaagccccggggggatc

SEQ ID NO: 46557 - DNA, 22 bp, Artificial Sequence
  chemically synthesized
gcagttttgtccctgtctgcag

SEQ ID NO: 46558 - DNA, 22 bp, Artificial Sequence
  chemically synthesized
cagttttgtccctgtctgcagt

SEQ ID NO: 46559 - DNA, 22 bp, Artificial Sequence
  chemically synthesized
tgtccctgtctgcagtgtgacc

SEQ ID NO: 46560 - DNA, 22 bp, Artificial Sequence
  chemically synthesized
gtccctgtctgcagtgtgacct

SEQ ID NO: 46561 - DNA, 22 bp, Artificial Sequence
  chemically synthesized
tccctgtctgcagtgtgacctg

SEQ ID NO: 46562 - DNA, 22 bp, Artificial Sequence
  chemically synthesized
tctgcagtgtgacctgttggtg

SEQ ID NO: 46563 - DNA, 22 bp, Artificial Sequence
  chemically synthesized
cagtgtgacctgttggtgacat

SEQ ID NO: 46564 - DNA, 22 bp, Artificial Sequence
  chemically synthesized
ttggtgacattgtctttgctcc

SEQ ID NO: 46565 - DNA, 22 bp, Artificial Sequence
  chemically synthesized
gtgacattgtctttgctccaaa

SEQ ID NO: 46566 - DNA, 22 bp, Artificial Sequence
  chemically synthesized
tctttgctccaaaccacagctc

SEQ ID NO: 46567 - DNA, 22 bp, Artificial Sequence
  chemically synthesized
tgctccaaaccacagctcctgg

SEQ ID NO: 46568 - DNA, 22 bp, Artificial Sequence
  chemically synthesized
gctccaaaccacagctcctggg

SEQ ID NO: 46569 - DNA, 22 bp, Artificial Sequence
  chemically synthesized
ctccaaaccacagctcctgggg

SEQ ID NO: 46570 - DNA, 22 bp, Artificial Sequence
  chemically synthesized
caaaccacagctcctggggcag

SEQ ID NO: 46571 - DNA, 22 bp, Artificial Sequence
  chemically synthesized
ctggggcagaggggaaaattct

SEQ ID NO: 46572 - DNA, 22 bp, Artificial Sequence
  chemically synthesized
gggcagaggggaaaattctgcc

SEQ ID NO: 46573 - DNA, 22 bp, Artificial Sequence
  chemically synthesized
tgccactcacagctgcctgccc

SEQ ID NO: 46574 - DNA, 22 bp, Artificial Sequence
  chemically synthesized
ccactcacagctgcctgcccac

SEQ ID NO: 46575 - DNA, 22 bp, Artificial Sequence
  chemically synthesized
acagctgcctgcccacgcttct

SEQ ID NO: 46576 - DNA, 22 bp, Artificial Sequence
  chemically synthesized
cctgcccacgcttctgtctgag

SEQ ID NO: 46577 - DNA, 22 bp, Artificial Sequence
  chemically synthesized
cccacgcttctgtctgagtgtg

SEQ ID NO: 46578 - DNA, 22 bp, Artificial Sequence
  chemically synthesized
ctgtctgagtgtgctgggtggc

SEQ ID NO: 46579 - DNA, 22 bp, Artificial Sequence
  chemically synthesized
tgtctgagtgtgctgggtggca

SEQ ID NO: 46580 - DNA, 22 bp, Artificial Sequence
  chemically synthesized
tctgagtgtgctgggtggcagg

SEQ ID NO: 46581 - DNA, 22 bp, Artificial Sequence
  chemically synthesized
agtgtgctgggtggcaggatgg

SEQ ID NO: 46582 - DNA, 22 bp, Artificial Sequence
  chemically synthesized
ggtggcaggatggcaagtcctt

SEQ ID NO: 46583 - DNA, 22 bp, Artificial Sequence
  chemically synthesized
actcagctcagtatagccctct

SEQ ID NO: 46584 - DNA, 22 bp, Artificial Sequence
  chemically synthesized
ctcagctcagtatagccctctt

SEQ ID NO: 46585 - DNA, 22 bp, Artificial Sequence
  chemically synthesized
agctcagtatagccctcttcct

SEQ ID NO: 46586 - DNA, 22 bp, Artificial Sequence
  chemically synthesized
agtatagccctcttccttgttc

SEQ ID NO: 46587 - DNA, 22 bp, Artificial Sequence
  chemically synthesized
ttccttgttccctgagcctttg

SEQ ID NO: 46588 - DNA, 22 bp, Artificial Sequence
  chemically synthesized
ccttgttccctgagcctttgac

SEQ ID NO: 46589 - DNA, 22 bp, Artificial Sequence
  chemically synthesized
cttgttccctgagcctttgact

SEQ ID NO: 46590 - DNA, 22 bp, Artificial Sequence
  chemically synthesized
gttccctgagcctttgactttc

SEQ ID NO: 46591 - DNA, 22 bp, Artificial Sequence
  chemically synthesized
ttccctgagcctttgactttct

SEQ ID NO: 46592 - DNA, 22 bp, Artificial Sequence
  chemically synthesized
cctgagcctttgactttctcga

SEQ ID NO: 46593 - DNA, 22 bp, Artificial Sequence
  chemically synthesized
agcctttgactttctcgaggga

SEQ ID NO: 46594 - DNA, 22 bp, Artificial Sequence
  chemically synthesized
tgactttctcgagggatgttgt

SEQ ID NO: 46595 - DNA, 22 bp, Artificial Sequence
  chemically synthesized
gactttctcgagggatgttgtg

SEQ ID NO: 46596 - DNA, 22 bp, Artificial Sequence
  chemically synthesized
actttctcgagggatgttgtgg

SEQ ID NO: 46597 - DNA, 22 bp, Artificial Sequence
  chemically synthesized
tctcgagggatgttgtggggtt

SEQ ID NO: 46598 - DNA, 22 bp, Artificial Sequence
  chemically synthesized
ctcgagggatgttgtggggttg

SEQ ID NO: 46599 - DNA, 22 bp, Artificial Sequence
  chemically synthesized
tcgagggatgttgtggggttgt

SEQ ID NO: 46600 - DNA, 22 bp, Artificial Sequence
  chemically synthesized
gagggatgttgtggggttgtgg

SEQ ID NO: 46601 - DNA, 22 bp, Artificial Sequence
  chemically synthesized
tggggttgtggccaggataaga

SEQ ID NO: 46602 - DNA, 22 bp, Artificial Sequence
  chemically synthesized
tggccaggataagaaagggcat

SEQ ID NO: 46603 - DNA, 22 bp, Artificial Sequence
  chemically synthesized
caagttaccactgctccaaaac

SEQ ID NO: 46604 - DNA, 22 bp, Artificial Sequence
  chemically synthesized
aagttaccactgctccaaaaca

SEQ ID NO: 46605 - DNA, 22 bp, Artificial Sequence
  chemically synthesized
ccactgctccaaaacaactgtt

SEQ ID NO: 46606 - DNA, 22 bp, Artificial Sequence
  chemically synthesized
ctccaaaacaactgttctggaa

SEQ ID NO: 46607 - DNA, 22 bp, Artificial Sequence
  chemically synthesized
caaaacaactgttctggaaata

SEQ ID NO: 46608 - DNA, 22 bp, Artificial Sequence
  chemically synthesized
ttctggaaatagtgagtacccc

SEQ ID NO: 46609 - DNA, 22 bp, Artificial Sequence
  chemically synthesized
tggaaatagtgagtaccccatc

SEQ ID NO: 46610 - DNA, 22 bp, Artificial Sequence
  chemically synthesized
gaaatagtgagtaccccatcct

SEQ ID NO: 46611 - DNA, 22 bp, Artificial Sequence
  chemically synthesized
agaggtgagtaagcagaggctg

SEQ ID NO: 46612 - DNA, 22 bp, Artificial Sequence
  chemically synthesized
tatgaccacctgaaccaagccc

SEQ ID NO: 46613 - DNA, 22 bp, Artificial Sequence
  chemically synthesized
aaccaagcccttgaggatgttt

SEQ ID NO: 46614 - DNA, 22 bp, Artificial Sequence
  chemically synthesized
gaggatgtttcttctctggtgg

SEQ ID NO: 46615 - DNA, 22 bp, Artificial Sequence
  chemically synthesized
aggatgtttcttctctggtgga

SEQ ID NO: 46616 - DNA, 22 bp, Artificial Sequence
  chemically synthesized
cttctctggtggaagtttggaa

SEQ ID NO: 46617 - DNA, 22 bp, Artificial Sequence
  chemically synthesized
ttctctggtggaagtttggaac

SEQ ID NO: 46618 - DNA, 22 bp, Artificial Sequence
  chemically synthesized
ctctggtggaagtttggaacag

SEQ ID NO: 46619 - DNA, 22 bp, Artificial Sequence
  chemically synthesized
tctggtggaagtttggaacagg

SEQ ID NO: 46620 - DNA, 22 bp, Artificial Sequence
  chemically synthesized
tggtggaagtttggaacaggag

SEQ ID NO: 46621 - DNA, 22 bp, Artificial Sequence
  chemically synthesized
gtggaagtttggaacaggagcc

SEQ ID NO: 46622 - DNA, 22 bp, Artificial Sequence
  chemically synthesized
ggaacaggagcctcctcaagtt

SEQ ID NO: 46623 - DNA, 22 bp, Artificial Sequence
  chemically synthesized
gaacaggagcctcctcaagttc

SEQ ID NO: 46624 - DNA, 22 bp, Artificial Sequence
  chemically synthesized
ctcaagttcatttattcattca

SEQ ID NO: 46625 - DNA, 22 bp, Artificial Sequence
  chemically synthesized
aagttcatttattcattcattc

SEQ ID NO: 46626 - DNA, 22 bp, Artificial Sequence
  chemically synthesized
atttattcattcattcaatggt

SEQ ID NO: 46627 - DNA, 22 bp, Artificial Sequence
  chemically synthesized
attcattcattcaatggttatt

SEQ ID NO: 46628 - DNA, 22 bp, Artificial Sequence
  chemically synthesized
ttcattcattcaatggttattt

SEQ ID NO: 46629 - DNA, 22 bp, Artificial Sequence
  chemically synthesized
attcattcaatggttattttgt

SEQ ID NO: 46630 - DNA, 22 bp, Artificial Sequence
  chemically synthesized
attcaatggttattttgtggga

SEQ ID NO: 46631 - DNA, 22 bp, Artificial Sequence
  chemically synthesized
aatggttattttgtgggaatcg

SEQ ID NO: 46632 - DNA, 22 bp, Artificial Sequence
  chemically synthesized
ttttgtgggaatcgaatttaga

SEQ ID NO: 46633 - DNA, 22 bp, Artificial Sequence
  chemically synthesized
tgtgggaatcgaatttagaatg

SEQ ID NO: 46634 - DNA, 22 bp, Artificial Sequence
  chemically synthesized
gtgggaatcgaatttagaatga

SEQ ID NO: 46635 - DNA, 22 bp, Artificial Sequence
  chemically synthesized
tgggaatcgaatttagaatgaa

SEQ ID NO: 46636 - DNA, 22 bp, Artificial Sequence
  chemically synthesized
agaatgaaaatattttttggca

SEQ ID NO: 46637 - DNA, 22 bp, Artificial Sequence
  chemically synthesized
gaatgaaaatattttttggcaa

SEQ ID NO: 46638 - DNA, 22 bp, Artificial Sequence
  chemically synthesized
tttggcaagcagaaaataattt

SEQ ID NO: 46639 - DNA, 22 bp, Artificial Sequence
  chemically synthesized
ttggcaagcagaaaataatttt

SEQ ID NO: 46640 - DNA, 22 bp, Artificial Sequence
  chemically synthesized
tggcaagcagaaaataattttt

SEQ ID NO: 46641 - DNA, 22 bp, Artificial Sequence
  chemically synthesized
ggcaagcagaaaataattttta

SEQ ID NO: 46642 - DNA, 22 bp, Artificial Sequence
  chemically synthesized
gcaagcagaaaataatttttag

SEQ ID NO: 46643 - DNA, 22 bp, Artificial Sequence
  chemically synthesized
ttagaccaatccttttctttta

SEQ ID NO: 46644 - DNA, 22 bp, Artificial Sequence
  chemically synthesized
tagaccaatccttttcttttag

SEQ ID NO: 46645 - DNA, 22 bp, Artificial Sequence
  chemically synthesized
agaccaatccttttcttttagt

SEQ ID NO: 46646 - DNA, 22 bp, Artificial Sequence
  chemically synthesized
gaccaatccttttcttttagtc

SEQ ID NO: 46647 - DNA, 22 bp, Artificial Sequence
  chemically synthesized
ttcttttagtcatgagaaactg

SEQ ID NO: 46648 - DNA, 22 bp, Artificial Sequence
  chemically synthesized
tcttttagtcatgagaaactga

SEQ ID NO: 46649 - DNA, 22 bp, Artificial Sequence
  chemically synthesized
cttttagtcatgagaaactgag

SEQ ID NO: 46650 - DNA, 22 bp, Artificial Sequence
  chemically synthesized
ttttagtcatgagaaactgagg

SEQ ID NO: 46651 - DNA, 22 bp, Artificial Sequence
  chemically synthesized
ttagtcatgagaaactgaggcc

SEQ ID NO: 46652 - DNA, 22 bp, Artificial Sequence
  chemically synthesized
tagtcatgagaaactgaggccc

SEQ ID NO: 46653 - DNA, 22 bp, Artificial Sequence
  chemically synthesized
agtcatgagaaactgaggccca

SEQ ID NO: 46654 - DNA, 22 bp, Artificial Sequence
  chemically synthesized
gtcatgagaaactgaggcccag

SEQ ID NO: 46655 - DNA, 22 bp, Artificial Sequence
  chemically synthesized
aggcccagagagaggaggtcac

SEQ ID NO: 46656 - DNA, 22 bp, Artificial Sequence
  chemically synthesized
gaactgggtttccagaactgac

SEQ ID NO: 46657 - DNA, 22 bp, Artificial Sequence
  chemically synthesized
ggtttccagaactgacactcca

SEQ ID NO: 46658 - DNA, 22 bp, Artificial Sequence
  chemically synthesized
ccagaactgacactccactgca

SEQ ID NO: 46659 - DNA, 22 bp, Artificial Sequence
  chemically synthesized
cagaactgacactccactgcac

SEQ ID NO: 46660 - DNA, 22 bp, Artificial Sequence
  chemically synthesized
acactccactgcacagagtact

SEQ ID NO: 46661 - DNA, 22 bp, Artificial Sequence
  chemically synthesized
cactgcacagagtactctccca

SEQ ID NO: 46662 - DNA, 22 bp, Artificial Sequence
  chemically synthesized
cacagagtactctcccaattca

SEQ ID NO: 46663 - DNA, 22 bp, Artificial Sequence
  chemically synthesized
tcccaattcattcaatttttat

SEQ ID NO: 46664 - DNA, 22 bp, Artificial Sequence
  chemically synthesized
ccaattcattcaatttttattt

SEQ ID NO: 46665 - DNA, 22 bp, Artificial Sequence
  chemically synthesized
attcaatttttatttagcggaa

SEQ ID NO: 46666 - DNA, 22 bp, Artificial Sequence
  chemically synthesized
aatttttatttagcggaaggca

SEQ ID NO: 46667 - DNA, 22 bp, Artificial Sequence
  chemically synthesized
ttatttagcggaaggcattttc

SEQ ID NO: 46668 - DNA, 22 bp, Artificial Sequence
  chemically synthesized
tatttagcggaaggcattttca

SEQ ID NO: 46669 - DNA, 22 bp, Artificial Sequence
  chemically synthesized
atttagcggaaggcattttcag

SEQ ID NO: 46670 - DNA, 22 bp, Artificial Sequence
  chemically synthesized
tttagcggaaggcattttcaga

SEQ ID NO: 46671 - DNA, 22 bp, Artificial Sequence
  chemically synthesized
agcggaaggcattttcagatgg

SEQ ID NO: 46672 - DNA, 22 bp, Artificial Sequence
  chemically synthesized
gcggaaggcattttcagatggg

SEQ ID NO: 46673 - DNA, 22 bp, Artificial Sequence
  chemically synthesized
tcagatgggtctttgaagcatt

SEQ ID NO: 46674 - DNA, 22 bp, Artificial Sequence
  chemically synthesized
cagatgggtctttgaagcatta

SEQ ID NO: 46675 - DNA, 22 bp, Artificial Sequence
  chemically synthesized
agatgggtctttgaagcattag

SEQ ID NO: 46676 - DNA, 22 bp, Artificial Sequence
  chemically synthesized
tgaagcattagtaggagttcag

SEQ ID NO: 46677 - DNA, 22 bp, Artificial Sequence
  chemically synthesized
gaagcattagtaggagttcagc

SEQ ID NO: 46678 - DNA, 22 bp, Artificial Sequence
  chemically synthesized
aagcattagtaggagttcagcg

SEQ ID NO: 46679 - DNA, 22 bp, Artificial Sequence
  chemically synthesized
gtaggagttcagcgatgatggt

SEQ ID NO: 46680 - DNA, 22 bp, Artificial Sequence
  chemically synthesized
agcgatgatggtgtcatgagaa

SEQ ID NO: 46681 - DNA, 22 bp, Artificial Sequence
  chemically synthesized
tattctaggattaggaggtacc

SEQ ID NO: 46682 - DNA, 22 bp, Artificial Sequence
  chemically synthesized
attctaggattaggaggtacca

SEQ ID NO: 46683 - DNA, 22 bp, Artificial Sequence
  chemically synthesized
ttctaggattaggaggtaccat

SEQ ID NO: 46684 - DNA, 22 bp, Artificial Sequence
  chemically synthesized
taggattaggaggtaccatgaa

SEQ ID NO: 46685 - DNA, 22 bp, Artificial Sequence
  chemically synthesized
ggattaggaggtaccatgaaca

SEQ ID NO: 46686 - DNA, 22 bp, Artificial Sequence
  chemically synthesized
ggaggtaccatgaacaaagata

SEQ ID NO: 46687 - DNA, 22 bp, Artificial Sequence
  chemically synthesized
ggaaaaccagaggtggaagata

SEQ ID NO: 46688 - DNA, 22 bp, Artificial Sequence
  chemically synthesized
tttttcttttttttttgagatg

SEQ ID NO: 46689 - DNA, 22 bp, Artificial Sequence
  chemically synthesized
tttcttttttttttgagatgga

SEQ ID NO: 46690 - DNA, 22 bp, Artificial Sequence
  chemically synthesized
ttcttttttttttgagatggag

SEQ ID NO: 46691 - DNA, 22 bp, Artificial Sequence
  chemically synthesized
tcttttttttttgagatggagt

SEQ ID NO: 46692 - DNA, 22 bp, Artificial Sequence
  chemically synthesized
cttttttttttgagatggagtt

SEQ ID NO: 46693 - DNA, 22 bp, Artificial Sequence
  chemically synthesized
ttttttttttgagatggagttt

SEQ ID NO: 46694 - DNA, 22 bp, Artificial Sequence
  chemically synthesized
ttttttttgagatggagtttcg

SEQ ID NO: 46695 - DNA, 22 bp, Artificial Sequence
  chemically synthesized
tttttttgagatggagtttcgc

SEQ ID NO: 46696 - DNA, 22 bp, Artificial Sequence
  chemically synthesized
ttttttgagatggagtttcgct

SEQ ID NO: 46697 - DNA, 22 bp, Artificial Sequence
  chemically synthesized
tttttgagatggagtttcgctc

SEQ ID NO: 46698 - DNA, 22 bp, Artificial Sequence
  chemically synthesized
ttttgagatggagtttcgctct

SEQ ID NO: 46699 - DNA, 22 bp, Artificial Sequence
  chemically synthesized
tttgagatggagtttcgctctt

SEQ ID NO: 46700 - DNA, 22 bp, Artificial Sequence
  chemically synthesized
ttgagatggagtttcgctcttg

SEQ ID NO: 46701 - DNA, 22 bp, Artificial Sequence
  chemically synthesized
tgagatggagtttcgctcttgt

SEQ ID NO: 46702 - DNA, 22 bp, Artificial Sequence
  chemically synthesized
gagatggagtttcgctcttgtt

SEQ ID NO: 46703 - DNA, 22 bp, Artificial Sequence
  chemically synthesized
agatggagtttcgctcttgttg

SEQ ID NO: 46704 - DNA, 22 bp, Artificial Sequence
  chemically synthesized
cgctcttgttgcccaggctgga

SEQ ID NO: 46705 - DNA, 22 bp, Artificial Sequence
  chemically synthesized
gctcttgttgcccaggctggag

SEQ ID NO: 46706 - DNA, 22 bp, Artificial Sequence
  chemically synthesized
ttgttgcccaggctggagtgca

SEQ ID NO: 46707 - DNA, 22 bp, Artificial Sequence
  chemically synthesized
gttgcccaggctggagtgcaat

SEQ ID NO: 46708 - DNA, 22 bp, Artificial Sequence
  chemically synthesized
ttgcccaggctggagtgcaatg

SEQ ID NO: 46709 - DNA, 22 bp, Artificial Sequence
  chemically synthesized
cccaggctggagtgcaatggtg

SEQ ID NO: 46710 - DNA, 22 bp, Artificial Sequence
  chemically synthesized
gagtgcaatggtgcagtctcag

SEQ ID NO: 46711 - DNA, 22 bp, Artificial Sequence
  chemically synthesized
agctcactgcaacatctgtctc

SEQ ID NO: 46712 - DNA, 22 bp, Artificial Sequence
  chemically synthesized
actgcaacatctgtctcccggg

SEQ ID NO: 46713 - DNA, 22 bp, Artificial Sequence
  chemically synthesized
caacatctgtctcccgggttca

SEQ ID NO: 46714 - DNA, 22 bp, Artificial Sequence
  chemically synthesized
tctcccgggttcaagtggttct

SEQ ID NO: 46715 - DNA, 22 bp, Artificial Sequence
  chemically synthesized
ccgggttcaagtggttctcctg

SEQ ID NO: 46716 - DNA, 22 bp, Artificial Sequence
  chemically synthesized
aagtggttctcctgcctcagcc

SEQ ID NO: 46717 - DNA, 22 bp, Artificial Sequence
  chemically synthesized
tcctgcctcagcctcccaagaa

SEQ ID NO: 46718 - DNA, 22 bp, Artificial Sequence
  chemically synthesized
ctgcctcagcctcccaagaagc

SEQ ID NO: 46719 - DNA, 22 bp, Artificial Sequence
  chemically synthesized
cctcagcctcccaagaagctgg

SEQ ID NO: 46720 - DNA, 22 bp, Artificial Sequence
  chemically synthesized
agcctcccaagaagctgggatt

SEQ ID NO: 46721 - DNA, 22 bp, Artificial Sequence
  chemically synthesized
ccaagaagctgggattacaggt

SEQ ID NO: 46722 - DNA, 22 bp, Artificial Sequence
  chemically synthesized
ggattacaggtacctgccacca

SEQ ID NO: 46723 - DNA, 22 bp, Artificial Sequence
  chemically synthesized
caggtacctgccaccacgcccg

SEQ ID NO: 46724 - DNA, 22 bp, Artificial Sequence
  chemically synthesized
ccaccacgcccggctaattttt

SEQ ID NO: 46725 - DNA, 22 bp, Artificial Sequence
  chemically synthesized
atttttgtatttttagtagaga

SEQ ID NO: 46726 - DNA, 22 bp, Artificial Sequence
  chemically synthesized
ttgtatttttagtagagaaggg

SEQ ID NO: 46727 - DNA, 22 bp, Artificial Sequence
  chemically synthesized
tgtatttttagtagagaagggg

SEQ ID NO: 46728 - DNA, 22 bp, Artificial Sequence
  chemically synthesized
gtatttttagtagagaaggggt

SEQ ID NO: 46729 - DNA, 22 bp, Artificial Sequence
  chemically synthesized
tatttttagtagagaaggggtt

SEQ ID NO: 46730 - DNA, 22 bp, Artificial Sequence
  chemically synthesized
ttagtagagaaggggtttcacc

SEQ ID NO: 46731 - DNA, 22 bp, Artificial Sequence
  chemically synthesized
tagtagagaaggggtttcacca

SEQ ID NO: 46732 - DNA, 22 bp, Artificial Sequence
  chemically synthesized
agtagagaaggggtttcaccac

SEQ ID NO: 46733 - DNA, 22 bp, Artificial Sequence
  chemically synthesized
gtagagaaggggtttcaccacg

SEQ ID NO: 46734 - DNA, 22 bp, Artificial Sequence
  chemically synthesized
caccacgttggccaggctagtc

SEQ ID NO: 46735 - DNA, 22 bp, Artificial Sequence
  chemically synthesized
accacgttggccaggctagtcg

SEQ ID NO: 46736 - DNA, 22 bp, Artificial Sequence
  chemically synthesized
gccaggctagtcgcaaactcct

SEQ ID NO: 46737 - DNA, 22 bp, Artificial Sequence
  chemically synthesized
gtcgcaaactcctgacctcctc

SEQ ID NO: 46738 - DNA, 22 bp, Artificial Sequence
  chemically synthesized
ctgacctcctcagtggatccga

SEQ ID NO: 46739 - DNA, 22 bp, Artificial Sequence
  chemically synthesized
acctcctcagtggatccgagga

SEQ ID NO: 46740 - DNA, 22 bp, Artificial Sequence
  chemically synthesized
ctcagtggatccgaggaggtga

SEQ ID NO: 46741 - DNA, 22 bp, Artificial Sequence
  chemically synthesized
agtggatccgaggaggtgatcc

SEQ ID NO: 46742 - DNA, 22 bp, Artificial Sequence
  chemically synthesized
ccgcctcagcctcccaaagtgc

SEQ ID NO: 46743 - DNA, 22 bp, Artificial Sequence
  chemically synthesized
agcctcccaaagtgctcgaatt

SEQ ID NO: 46744 - DNA, 22 bp, Artificial Sequence
  chemically synthesized
ccaaagtgctcgaattacaggt

SEQ ID NO: 46745 - DNA, 22 bp, Artificial Sequence
  chemically synthesized
gaattacaggtgtgagccacca

SEQ ID NO: 46746 - DNA, 22 bp, Artificial Sequence
  chemically synthesized
caggtgtgagccaccacgcctg

SEQ ID NO: 46747 - DNA, 22 bp, Artificial Sequence
  chemically synthesized
gcctccacagttctttatccac

SEQ ID NO: 46748 - DNA, 22 bp, Artificial Sequence
  chemically synthesized
cacagttctttatccaccgtct

SEQ ID NO: 46749 - DNA, 22 bp, Artificial Sequence
  chemically synthesized
tttatccaccgtctgaaatgta

SEQ ID NO: 46750 - DNA, 22 bp, Artificial Sequence
  chemically synthesized
tatccaccgtctgaaatgtaaa

SEQ ID NO: 46751 - DNA, 22 bp, Artificial Sequence
  chemically synthesized
atccaccgtctgaaatgtaaaa

SEQ ID NO: 46752 - DNA, 22 bp, Artificial Sequence
  chemically synthesized
tccaccgtctgaaatgtaaaat

SEQ ID NO: 46753 - DNA, 22 bp, Artificial Sequence
  chemically synthesized
aaatgtaaaatgttacgaaaac

SEQ ID NO: 46754 - DNA, 22 bp, Artificial Sequence
  chemically synthesized
cgaaaaccaaaagttttttttg

SEQ ID NO: 46755 - DNA, 22 bp, Artificial Sequence
  chemically synthesized
tttttgtgatttatttgatggt

SEQ ID NO: 46756 - DNA, 22 bp, Artificial Sequence
  chemically synthesized
ttttgtgatttatttgatggta

SEQ ID NO: 46757 - DNA, 22 bp, Artificial Sequence
  chemically synthesized
tttgtgatttatttgatggtag

SEQ ID NO: 46758 - DNA, 22 bp, Artificial Sequence
  chemically synthesized
ttgtgatttatttgatggtagc

SEQ ID NO: 46759 - DNA, 22 bp, Artificial Sequence
  chemically synthesized
tgtgatttatttgatggtagca

SEQ ID NO: 46760 - DNA, 22 bp, Artificial Sequence
  chemically synthesized
gtgatttatttgatggtagcac

SEQ ID NO: 46761 - DNA, 22 bp, Artificial Sequence
  chemically synthesized
tgatttatttgatggtagcacc

SEQ ID NO: 46762 - DNA, 22 bp, Artificial Sequence
  chemically synthesized
atttgatggtagcacctgacgt

SEQ ID NO: 46763 - DNA, 22 bp, Artificial Sequence
  chemically synthesized
tttgatggtagcacctgacgtg

SEQ ID NO: 46764 - DNA, 22 bp, Artificial Sequence
  chemically synthesized
gatggtagcacctgacgtgaac

SEQ ID NO: 46765 - DNA, 22 bp, Artificial Sequence
  chemically synthesized
atggtagcacctgacgtgaact

SEQ ID NO: 46766 - DNA, 22 bp, Artificial Sequence
  chemically synthesized
acgtgaactgacatgagattat

SEQ ID NO: 46767 - DNA, 22 bp, Artificial Sequence
  chemically synthesized
acatgagattatttttaattta

SEQ ID NO: 46768 - DNA, 22 bp, Artificial Sequence
  chemically synthesized
tttttaatttagttgtgtgaat

SEQ ID NO: 46769 - DNA, 22 bp, Artificial Sequence
  chemically synthesized
ttaatttagttgtgtgaatatg

SEQ ID NO: 46770 - DNA, 22 bp, Artificial Sequence
  chemically synthesized
taatttagttgtgtgaatatgc

SEQ ID NO: 46771 - DNA, 22 bp, Artificial Sequence
  chemically synthesized
aatttagttgtgtgaatatgca

SEQ ID NO: 46772 - DNA, 22 bp, Artificial Sequence
  chemically synthesized
atttagttgtgtgaatatgcat

SEQ ID NO: 46773 - DNA, 22 bp, Artificial Sequence
  chemically synthesized
agttgtgtgaatatgcatattc

SEQ ID NO: 46774 - DNA, 22 bp, Artificial Sequence
  chemically synthesized
gttgtgtgaatatgcatattca

SEQ ID NO: 46775 - DNA, 22 bp, Artificial Sequence
  chemically synthesized
tgtgaatatgcatattcatata

SEQ ID NO: 46776 - DNA, 22 bp, Artificial Sequence
  chemically synthesized
atatattttgctgcatagatta

SEQ ID NO: 46777 - DNA, 22 bp, Artificial Sequence
  chemically synthesized
tgctgcatagattacagtatgc

SEQ ID NO: 46778 - DNA, 22 bp, Artificial Sequence
  chemically synthesized
gctgcatagattacagtatgca

SEQ ID NO: 46779 - DNA, 22 bp, Artificial Sequence
  chemically synthesized
ctgcatagattacagtatgcag

SEQ ID NO: 46780 - DNA, 22 bp, Artificial Sequence
  chemically synthesized
catagattacagtatgcagctc

SEQ ID NO: 46781 - DNA, 22 bp, Artificial Sequence
  chemically synthesized
cagtatgcagctccagattctt

SEQ ID NO: 46782 - DNA, 22 bp, Artificial Sequence
  chemically synthesized
cagattcttccaagcagactct

SEQ ID NO: 46783 - DNA, 22 bp, Artificial Sequence
  chemically synthesized
ttccaagcagactctgattgcc

SEQ ID NO: 46784 - DNA, 22 bp, Artificial Sequence
  chemically synthesized
ccaagcagactctgattgccca

SEQ ID NO: 46785 - DNA, 22 bp, Artificial Sequence
  chemically synthesized
caagcagactctgattgcccat

SEQ ID NO: 46786 - DNA, 22 bp, Artificial Sequence
  chemically synthesized
tgattgcccattactgcctttc

SEQ ID NO: 46787 - DNA, 22 bp, Artificial Sequence
  chemically synthesized
attgcccattactgcctttcta

SEQ ID NO: 46788 - DNA, 22 bp, Artificial Sequence
  chemically synthesized
cccattactgcctttctaaaat

SEQ ID NO: 46789 - DNA, 22 bp, Artificial Sequence
  chemically synthesized
ctgcctttctaaaatccaaaca

SEQ ID NO: 46790 - DNA, 22 bp, Artificial Sequence
  chemically synthesized
cctttctaaaatccaaacaagt

SEQ ID NO: 46791 - DNA, 22 bp, Artificial Sequence
  chemically synthesized
tctaaaatccaaacaagttctg

SEQ ID NO: 46792 - DNA, 22 bp, Artificial Sequence
  chemically synthesized
ctaaaatccaaacaagttctga

SEQ ID NO: 46793 - DNA, 22 bp, Artificial Sequence
  chemically synthesized
taaaatccaaacaagttctgag

SEQ ID NO: 46794 - DNA, 22 bp, Artificial Sequence
  chemically synthesized
aaatccaaacaagttctgaggt

SEQ ID NO: 46795 - DNA, 22 bp, Artificial Sequence
  chemically synthesized
tgaggttcaaaaccgttttggc

SEQ ID NO: 46796 - DNA, 22 bp, Artificial Sequence
  chemically synthesized
aggttcaaaaccgttttggccc

SEQ ID NO: 46797 - DNA, 22 bp, Artificial Sequence
  chemically synthesized
aaaaccgttttggccctaaggc

SEQ ID NO: 46798 - DNA, 22 bp, Artificial Sequence
  chemically synthesized
tggccctaaggctttgggtaaa

SEQ ID NO: 46799 - DNA, 22 bp, Artificial Sequence
  chemically synthesized
ggccctaaggctttgggtaaag

SEQ ID NO: 46800 - DNA, 22 bp, Artificial Sequence
  chemically synthesized
gccctaaggctttgggtaaagg

SEQ ID NO: 46801 - DNA, 22 bp, Artificial Sequence
  chemically synthesized
aggctttgggtaaagggggtgg

SEQ ID NO: 46802 - DNA, 22 bp, Artificial Sequence
  chemically synthesized
tgggtaaagggggtggactctg

SEQ ID NO: 46803 - DNA, 22 bp, Artificial Sequence
  chemically synthesized
gggtaaagggggtggactctgt

SEQ ID NO: 46804 - DNA, 22 bp, Artificial Sequence
  chemically synthesized
ggtaaagggggtggactctgtt

SEQ ID NO: 46805 - DNA, 22 bp, Artificial Sequence
  chemically synthesized
tgttctactctgactggagtcc

SEQ ID NO: 46806 - DNA, 22 bp, Artificial Sequence
  chemically synthesized
ttctactctgactggagtccaa

SEQ ID NO: 46807 - DNA, 22 bp, Artificial Sequence
  chemically synthesized
tactctgactggagtccaagat

SEQ ID NO: 46808 - DNA, 22 bp, Artificial Sequence
  chemically synthesized
ctctgactggagtccaagatgc

SEQ ID NO: 46809 - DNA, 22 bp, Artificial Sequence
  chemically synthesized
tgactggagtccaagatgcata

SEQ ID NO: 46810 - DNA, 22 bp, Artificial Sequence
  chemically synthesized
actggagtccaagatgcatata

SEQ ID NO: 46811 - DNA, 22 bp, Artificial Sequence
  chemically synthesized
gagtccaagatgcatatataca

SEQ ID NO: 46812 - DNA, 22 bp, Artificial Sequence
  chemically synthesized
caaggtaggttgaggtaggggc

SEQ ID NO: 46813 - DNA, 22 bp, Artificial Sequence
  chemically synthesized
aggtaggggccaaggaggagca

SEQ ID NO: 46814 - DNA, 22 bp, Artificial Sequence
  chemically synthesized
ggacttgattcatgaggctgtg

SEQ ID NO: 46815 - DNA, 22 bp, Artificial Sequence
  chemically synthesized
gacttgattcatgaggctgtgg

SEQ ID NO: 46816 - DNA, 22 bp, Artificial Sequence
  chemically synthesized
gattcatgaggctgtggggagc

SEQ ID NO: 46817 - DNA, 22 bp, Artificial Sequence
  chemically synthesized
attcatgaggctgtggggagcc

SEQ ID NO: 46818 - DNA, 22 bp, Artificial Sequence
  chemically synthesized
atgaggctgtggggagccagtg

SEQ ID NO: 46819 - DNA, 22 bp, Artificial Sequence
  chemically synthesized
tggggagccagtgaaggttctt

SEQ ID NO: 46820 - DNA, 22 bp, Artificial Sequence
  chemically synthesized
ttaagcaggtatgtctgcctga

SEQ ID NO: 46821 - DNA, 22 bp, Artificial Sequence
  chemically synthesized
aagcaggtatgtctgcctgaga

SEQ ID NO: 46822 - DNA, 22 bp, Artificial Sequence
  chemically synthesized
agcaggtatgtctgcctgagag

SEQ ID NO: 46823 - DNA, 22 bp, Artificial Sequence
  chemically synthesized
cctgagagcagttggagcagac

SEQ ID NO: 46824 - DNA, 22 bp, Artificial Sequence
  chemically synthesized
agagcagttggagcagacaaga

SEQ ID NO: 46825 - DNA, 22 bp, Artificial Sequence
  chemically synthesized
gagcagacaagagctaaaaacc

SEQ ID NO: 46826 - DNA, 22 bp, Artificial Sequence
  chemically synthesized
aaaaccaaacaaatcaccatag

SEQ ID NO: 46827 - DNA, 22 bp, Artificial Sequence
  chemically synthesized
ctataatttgtttgtcccctcc

SEQ ID NO: 46828 - DNA, 22 bp, Artificial Sequence
  chemically synthesized
taatttgtttgtcccctccaaa

SEQ ID NO: 46829 - DNA, 22 bp, Artificial Sequence
  chemically synthesized
gtttgtcccctccaaatctcat

SEQ ID NO: 46830 - DNA, 22 bp, Artificial Sequence
  chemically synthesized
tttgtcccctccaaatctcatg

SEQ ID NO: 46831 - DNA, 22 bp, Artificial Sequence
  chemically synthesized
gtcccctccaaatctcatgtgg

SEQ ID NO: 46832 - DNA, 22 bp, Artificial Sequence
  chemically synthesized
tcccctccaaatctcatgtgga

SEQ ID NO: 46833 - DNA, 22 bp, Artificial Sequence
  chemically synthesized
caaatctcatgtggaaatttgg

SEQ ID NO: 46834 - DNA, 22 bp, Artificial Sequence
  chemically synthesized
atgtggaaatttggtcctcagt

SEQ ID NO: 46835 - DNA, 22 bp, Artificial Sequence
  chemically synthesized
ggtcctcagtgttggaagtggg

SEQ ID NO: 46836 - DNA, 22 bp, Artificial Sequence
  chemically synthesized
gtcctcagtgttggaagtgggg

SEQ ID NO: 46837 - DNA, 22 bp, Artificial Sequence
  chemically synthesized
agtgttggaagtggggcctaat

SEQ ID NO: 46838 - DNA, 22 bp, Artificial Sequence
  chemically synthesized
gaagtggggcctaatgggaggt

SEQ ID NO: 46839 - DNA, 22 bp, Artificial Sequence
  chemically synthesized
atgggaggtgtttgggtcatgg

SEQ ID NO: 46840 - DNA, 22 bp, Artificial Sequence
  chemically synthesized
gggtcatgggggaggaacccct

SEQ ID NO: 46841 - DNA, 22 bp, Artificial Sequence
  chemically synthesized
ggtcatgggggaggaacccctg

SEQ ID NO: 46842 - DNA, 22 bp, Artificial Sequence
  chemically synthesized
tgaaaggcttggtgccgtcctt

SEQ ID NO: 46843 - DNA, 22 bp, Artificial Sequence
  chemically synthesized
ggtgccgtccttgtgataatga

SEQ ID NO: 46844 - DNA, 22 bp, Artificial Sequence
  chemically synthesized
gtgccgtccttgtgataatgag

SEQ ID NO: 46845 - DNA, 22 bp, Artificial Sequence
  chemically synthesized
gtgataatgagtaagttctccc

SEQ ID NO: 46846 - DNA, 22 bp, Artificial Sequence
  chemically synthesized
tgataatgagtaagttctcccg

SEQ ID NO: 46847 - DNA, 22 bp, Artificial Sequence
  chemically synthesized
tcccgctatgatttcccttgaa

SEQ ID NO: 46848 - DNA, 22 bp, Artificial Sequence
  chemically synthesized
ccgctatgatttcccttgaagg

SEQ ID NO: 46849 - DNA, 22 bp, Artificial Sequence
  chemically synthesized
tgatttcccttgaaggctgatt

SEQ ID NO: 46850 - DNA, 22 bp, Artificial Sequence
  chemically synthesized
cccttgaaggctgattattaaa

SEQ ID NO: 46851 - DNA, 22 bp, Artificial Sequence
  chemically synthesized
ccttgaaggctgattattaaaa

SEQ ID NO: 46852 - DNA, 22 bp, Artificial Sequence
  chemically synthesized
gaaggctgattattaaaaagag

SEQ ID NO: 46853 - DNA, 22 bp, Artificial Sequence
  chemically synthesized
aaggctgattattaaaaagagc

SEQ ID NO: 46854 - DNA, 22 bp, Artificial Sequence
  chemically synthesized
attattaaaaagagcttggcac

SEQ ID NO: 46855 - DNA, 22 bp, Artificial Sequence
  chemically synthesized
ttaaaaagagcttggcacctcc

SEQ ID NO: 46856 - DNA, 22 bp, Artificial Sequence
  chemically synthesized
aaaagagcttggcacctccctc

SEQ ID NO: 46857 - DNA, 22 bp, Artificial Sequence
  chemically synthesized
ggcacctccctctcttctctct

SEQ ID NO: 46858 - DNA, 22 bp, Artificial Sequence
  chemically synthesized
gcacctccctctcttctctctt

SEQ ID NO: 46859 - DNA, 22 bp, Artificial Sequence
  chemically synthesized
cctctcttctctcttgcttctt

SEQ ID NO: 46860 - DNA, 22 bp, Artificial Sequence
  chemically synthesized
tcttctctcttgcttcttctct

SEQ ID NO: 46861 - DNA, 22 bp, Artificial Sequence
  chemically synthesized
ttctctcttgcttcttctcttg

SEQ ID NO: 46862 - DNA, 22 bp, Artificial Sequence
  chemically synthesized
ctctcttgcttcttctcttgcc

SEQ ID NO: 46863 - DNA, 22 bp, Artificial Sequence
  chemically synthesized
tctcttgcttcttctcttgcca

SEQ ID NO: 46864 - DNA, 22 bp, Artificial Sequence
  chemically synthesized
tcttgcttcttctcttgccatg

SEQ ID NO: 46865 - DNA, 22 bp, Artificial Sequence
  chemically synthesized
ttgcttcttctcttgccatgtg

SEQ ID NO: 46866 - DNA, 22 bp, Artificial Sequence
  chemically synthesized
gcttcttctcttgccatgtgat

SEQ ID NO: 46867 - DNA, 22 bp, Artificial Sequence
  chemically synthesized
cttcttctcttgccatgtgatt

SEQ ID NO: 46868 - DNA, 22 bp, Artificial Sequence
  chemically synthesized
cttctcttgccatgtgattgat

SEQ ID NO: 46869 - DNA, 22 bp, Artificial Sequence
  chemically synthesized
ttctcttgccatgtgattgatc

SEQ ID NO: 46870 - DNA, 22 bp, Artificial Sequence
  chemically synthesized
ctcttgccatgtgattgatctc

SEQ ID NO: 46871 - DNA, 22 bp, Artificial Sequence
  chemically synthesized
tcttgccatgtgattgatctct

SEQ ID NO: 46872 - DNA, 22 bp, Artificial Sequence
  chemically synthesized
ttgccatgtgattgatctctgc

SEQ ID NO: 46873 - DNA, 22 bp, Artificial Sequence
  chemically synthesized
gccatgtgattgatctctgcac

SEQ ID NO: 46874 - DNA, 22 bp, Artificial Sequence
  chemically synthesized
ccatgtgattgatctctgcaca

SEQ ID NO: 46875 - DNA, 22 bp, Artificial Sequence
  chemically synthesized
atctctgcacatgtaggctccc

SEQ ID NO: 46876 - DNA, 22 bp, Artificial Sequence
  chemically synthesized
tgcacatgtaggctccccttca

SEQ ID NO: 46877 - DNA, 22 bp, Artificial Sequence
  chemically synthesized
cacatgtaggctccccttcacc

SEQ ID NO: 46878 - DNA, 22 bp, Artificial Sequence
  chemically synthesized
cccttcaccttctgccatcagt

SEQ ID NO: 46879 - DNA, 22 bp, Artificial Sequence
  chemically synthesized
caccttctgccatcagtgaaag

SEQ ID NO: 46880 - DNA, 22 bp, Artificial Sequence
  chemically synthesized
accttctgccatcagtgaaagc

SEQ ID NO: 46881 - DNA, 22 bp, Artificial Sequence
  chemically synthesized
ctgccatcagtgaaagcagctt

SEQ ID NO: 46882 - DNA, 22 bp, Artificial Sequence
  chemically synthesized
tgccatcagtgaaagcagctta

SEQ ID NO: 46883 - DNA, 22 bp, Artificial Sequence
  chemically synthesized
ccatcagtgaaagcagcttaag

SEQ ID NO: 46884 - DNA, 22 bp, Artificial Sequence
  chemically synthesized
aaggccctcaccagaagcagat

SEQ ID NO: 46885 - DNA, 22 bp, Artificial Sequence
  chemically synthesized
aggccctcaccagaagcagatg

SEQ ID NO: 46886 - DNA, 22 bp, Artificial Sequence
  chemically synthesized
accagaagcagatgctggtgcc

SEQ ID NO: 46887 - DNA, 22 bp, Artificial Sequence
  chemically synthesized
gtgccatgcttcctggagagct

SEQ ID NO: 46888 - DNA, 22 bp, Artificial Sequence
  chemically synthesized
cctggagagcttgcagaatcat

SEQ ID NO: 46889 - DNA, 22 bp, Artificial Sequence
  chemically synthesized
ctggagagcttgcagaatcatg

SEQ ID NO: 46890 - DNA, 22 bp, Artificial Sequence
  chemically synthesized
gagagcttgcagaatcatgagc

SEQ ID NO: 46891 - DNA, 22 bp, Artificial Sequence
  chemically synthesized
gcagaatcatgagctgaataaa

SEQ ID NO: 46892 - DNA, 22 bp, Artificial Sequence
  chemically synthesized
cagaatcatgagctgaataaat

SEQ ID NO: 46893 - DNA, 22 bp, Artificial Sequence
  chemically synthesized
aataaatcccttttccttgtaa

SEQ ID NO: 46894 - DNA, 22 bp, Artificial Sequence
  chemically synthesized
ttccttgtaaattactcacctt

SEQ ID NO: 46895 - DNA, 22 bp, Artificial Sequence
  chemically synthesized
tccttgtaaattactcaccttc

SEQ ID NO: 46896 - DNA, 22 bp, Artificial Sequence
  chemically synthesized
ccttgtaaattactcaccttca

SEQ ID NO: 46897 - DNA, 22 bp, Artificial Sequence
  chemically synthesized
cttgtaaattactcaccttcag

SEQ ID NO: 46898 - DNA, 22 bp, Artificial Sequence
  chemically synthesized
gtaaattactcaccttcaggta

SEQ ID NO: 46899 - DNA, 22 bp, Artificial Sequence
  chemically synthesized
taaattactcaccttcaggtat

SEQ ID NO: 46900 - DNA, 22 bp, Artificial Sequence
  chemically synthesized
ctcaccttcaggtattccttta

SEQ ID NO: 46901 - DNA, 22 bp, Artificial Sequence
  chemically synthesized
accttcaggtattcctttatat

SEQ ID NO: 46902 - DNA, 22 bp, Artificial Sequence
  chemically synthesized
caggtattcctttatatagcaa

SEQ ID NO: 46903 - DNA, 22 bp, Artificial Sequence
  chemically synthesized
aggtattcctttatatagcaac

SEQ ID NO: 46904 - DNA, 22 bp, Artificial Sequence
  chemically synthesized
ctttatatagcaacacaaaagg

SEQ ID NO: 46905 - DNA, 22 bp, Artificial Sequence
  chemically synthesized
tatatagcaacacaaaaggact

SEQ ID NO: 46906 - DNA, 22 bp, Artificial Sequence
  chemically synthesized
atatagcaacacaaaaggacta

SEQ ID NO: 46907 - DNA, 22 bp, Artificial Sequence
  chemically synthesized
tatagcaacacaaaaggactaa

SEQ ID NO: 46908 - DNA, 22 bp, Artificial Sequence
  chemically synthesized
agacagtggccttgacttttct

SEQ ID NO: 46909 - DNA, 22 bp, Artificial Sequence
  chemically synthesized
gacttttctctctctttaagaa

SEQ ID NO: 46910 - DNA, 22 bp, Artificial Sequence
  chemically synthesized
acttttctctctctttaagaag

SEQ ID NO: 46911 - DNA, 22 bp, Artificial Sequence
  chemically synthesized
ttctctctctttaagaagtgtt

SEQ ID NO: 46912 - DNA, 22 bp, Artificial Sequence
  chemically synthesized
tctctctctttaagaagtgttg

SEQ ID NO: 46913 - DNA, 22 bp, Artificial Sequence
  chemically synthesized
ctctctctttaagaagtgttgc

SEQ ID NO: 46914 - DNA, 22 bp, Artificial Sequence
  chemically synthesized
tctctctttaagaagtgttgcc

SEQ ID NO: 46915 - DNA, 22 bp, Artificial Sequence
  chemically synthesized
tctctttaagaagtgttgcctt

SEQ ID NO: 46916 - DNA, 22 bp, Artificial Sequence
  chemically synthesized
tctttaagaagtgttgcctttg

SEQ ID NO: 46917 - DNA, 22 bp, Artificial Sequence
  chemically synthesized
tttaagaagtgttgcctttgct

SEQ ID NO: 46918 - DNA, 22 bp, Artificial Sequence
  chemically synthesized
taagaagtgttgcctttgctca

SEQ ID NO: 46919 - DNA, 22 bp, Artificial Sequence
  chemically synthesized
aagaagtgttgcctttgctcac

SEQ ID NO: 46920 - DNA, 22 bp, Artificial Sequence
  chemically synthesized
agaagtgttgcctttgctcact

SEQ ID NO: 46921 - DNA, 22 bp, Artificial Sequence
  chemically synthesized
cctttgctcacttagtcatccc

SEQ ID NO: 46922 - DNA, 22 bp, Artificial Sequence
  chemically synthesized
tgctcacttagtcatcccttct

SEQ ID NO: 46923 - DNA, 22 bp, Artificial Sequence
  chemically synthesized
gctcacttagtcatcccttctg

SEQ ID NO: 46924 - DNA, 22 bp, Artificial Sequence
  chemically synthesized
ctcacttagtcatcccttctgc

SEQ ID NO: 46925 - DNA, 22 bp, Artificial Sequence
  chemically synthesized
acttagtcatcccttctgcctg

SEQ ID NO: 46926 - DNA, 22 bp, Artificial Sequence
  chemically synthesized
agtcatcccttctgcctgcatt

SEQ ID NO: 46927 - DNA, 22 bp, Artificial Sequence
  chemically synthesized
gtcatcccttctgcctgcattt

SEQ ID NO: 46928 - DNA, 22 bp, Artificial Sequence
  chemically synthesized
ctgcctgcatttgtagagcatc

SEQ ID NO: 46929 - DNA, 22 bp, Artificial Sequence
  chemically synthesized
tgcctgcatttgtagagcatct

SEQ ID NO: 46930 - DNA, 22 bp, Artificial Sequence
  chemically synthesized
cctgcatttgtagagcatctgg

SEQ ID NO: 46931 - DNA, 22 bp, Artificial Sequence
  chemically synthesized
catttgtagagcatctggatgg

SEQ ID NO: 46932 - DNA, 22 bp, Artificial Sequence
  chemically synthesized
gtagagcatctggatgggagat

SEQ ID NO: 46933 - DNA, 22 bp, Artificial Sequence
  chemically synthesized
tagagcatctggatgggagatt

SEQ ID NO: 46934 - DNA, 22 bp, Artificial Sequence
  chemically synthesized
gatgggagatttatataaccgt

SEQ ID NO: 46935 - DNA, 22 bp, Artificial Sequence
  chemically synthesized
atataaccgtcactcttgactt

SEQ ID NO: 46936 - DNA, 22 bp, Artificial Sequence
  chemically synthesized
tataaccgtcactcttgacttt

SEQ ID NO: 46937 - DNA, 22 bp, Artificial Sequence
  chemically synthesized
ttgactttcccagcaggcctat

SEQ ID NO: 46938 - DNA, 22 bp, Artificial Sequence
  chemically synthesized
gactttcccagcaggcctatgt

SEQ ID NO: 46939 - DNA, 22 bp, Artificial Sequence
  chemically synthesized
actttcccagcaggcctatgtc

SEQ ID NO: 46940 - DNA, 22 bp, Artificial Sequence
  chemically synthesized
tcccagcaggcctatgtcatag

SEQ ID NO: 46941 - DNA, 22 bp, Artificial Sequence
  chemically synthesized
cccagcaggcctatgtcatagg

SEQ ID NO: 46942 - DNA, 22 bp, Artificial Sequence
  chemically synthesized
ccagcaggcctatgtcataggt

SEQ ID NO: 46943 - DNA, 22 bp, Artificial Sequence
  chemically synthesized
tgtcataggtactgtggtctct

SEQ ID NO: 46944 - DNA, 22 bp, Artificial Sequence
  chemically synthesized
tggtctctacaatacagcagag

SEQ ID NO: 46945 - DNA, 22 bp, Artificial Sequence
  chemically synthesized
tacaatacagcagaggtatctg

SEQ ID NO: 46946 - DNA, 22 bp, Artificial Sequence
  chemically synthesized
caatacagcagaggtatctgag

SEQ ID NO: 46947 - DNA, 22 bp, Artificial Sequence
  chemically synthesized
aggctccgagaggttgagtgac

SEQ ID NO: 46948 - DNA, 22 bp, Artificial Sequence
  chemically synthesized
cgagaggttgagtgacttgctc

SEQ ID NO: 46949 - DNA, 22 bp, Artificial Sequence
  chemically synthesized
agtgacttgctcatggctgcac

SEQ ID NO: 46950 - DNA, 22 bp, Artificial Sequence
  chemically synthesized
gctcatggctgcacaaccagta

SEQ ID NO: 46951 - DNA, 22 bp, Artificial Sequence
  chemically synthesized
ctcatggctgcacaaccagtaa

SEQ ID NO: 46952 - DNA, 22 bp, Artificial Sequence
  chemically synthesized
atggctgcacaaccagtaaata

SEQ ID NO: 46953 - DNA, 22 bp, Artificial Sequence
  chemically synthesized
cacaaccagtaaatattggagc

SEQ ID NO: 46954 - DNA, 22 bp, Artificial Sequence
  chemically synthesized
gagctggaattcaggtccacgg

SEQ ID NO: 46955 - DNA, 22 bp, Artificial Sequence
  chemically synthesized
gaattcaggtccacggtttcct

SEQ ID NO: 46956 - DNA, 22 bp, Artificial Sequence
  chemically synthesized
aggtccacggtttcctggctcc

SEQ ID NO: 46957 - DNA, 22 bp, Artificial Sequence
  chemically synthesized
cctggctccaaagcccatgatt

SEQ ID NO: 46958 - DNA, 22 bp, Artificial Sequence
  chemically synthesized
ctggctccaaagcccatgattt

SEQ ID NO: 46959 - DNA, 22 bp, Artificial Sequence
  chemically synthesized
gctccaaagcccatgatttttt

SEQ ID NO: 46960 - DNA, 22 bp, Artificial Sequence
  chemically synthesized
caaagcccatgattttttccct

SEQ ID NO: 46961 - DNA, 22 bp, Artificial Sequence
  chemically synthesized
tttccctcaatttattctgact

SEQ ID NO: 46962 - DNA, 22 bp, Artificial Sequence
  chemically synthesized
ttccctcaatttattctgactg

SEQ ID NO: 46963 - DNA, 22 bp, Artificial Sequence
  chemically synthesized
tccctcaatttattctgactgg

SEQ ID NO: 46964 - DNA, 22 bp, Artificial Sequence
  chemically synthesized
ccctcaatttattctgactggg

SEQ ID NO: 46965 - DNA, 22 bp, Artificial Sequence
  chemically synthesized
cctcaatttattctgactgggg

SEQ ID NO: 46966 - DNA, 22 bp, Artificial Sequence
  chemically synthesized
aatttattctgactggggcatg

SEQ ID NO: 46967 - DNA, 22 bp, Artificial Sequence
  chemically synthesized
attctgactggggcatggggga

SEQ ID NO: 46968 - DNA, 22 bp, Artificial Sequence
  chemically synthesized
ttctgactggggcatgggggag

SEQ ID NO: 46969 - DNA, 22 bp, Artificial Sequence
  chemically synthesized
tgactggggcatgggggagggg

SEQ ID NO: 46970 - DNA, 22 bp, Artificial Sequence
  chemically synthesized
actggggcatgggggagggggt

SEQ ID NO: 46971 - DNA, 22 bp, Artificial Sequence
  chemically synthesized
gggcatgggggagggggtggcc

SEQ ID NO: 46972 - DNA, 22 bp, Artificial Sequence
  chemically synthesized
tgggcagggccaccaggagcga

SEQ ID NO: 46973 - DNA, 22 bp, Artificial Sequence
  chemically synthesized
gggcagggccaccaggagcgac

SEQ ID NO: 46974 - DNA, 22 bp, Artificial Sequence
  chemically synthesized
ggcagggccaccaggagcgacc

SEQ ID NO: 46975 - DNA, 22 bp, Artificial Sequence
  chemically synthesized
ggtgcaggtacagaggaaaacc

SEQ ID NO: 46976 - DNA, 22 bp, Artificial Sequence
  chemically synthesized
ttgtcgagtgtggcccgtagtt

SEQ ID NO: 46977 - DNA, 22 bp, Artificial Sequence
  chemically synthesized
tcgagtgtggcccgtagttccc

SEQ ID NO: 46978 - DNA, 22 bp, Artificial Sequence
  chemically synthesized
ccatttttgcctgaatggcaca

SEQ ID NO: 46979 - DNA, 22 bp, Artificial Sequence
  chemically synthesized
ttgcctgaatggcacatttgaa

SEQ ID NO: 46980 - DNA, 22 bp, Artificial Sequence
  chemically synthesized
tgcctgaatggcacatttgaaa

SEQ ID NO: 46981 - DNA, 22 bp, Artificial Sequence
  chemically synthesized
gcctgaatggcacatttgaaag

SEQ ID NO: 46982 - DNA, 22 bp, Artificial Sequence
  chemically synthesized
cctgaatggcacatttgaaagt

SEQ ID NO: 46983 - DNA, 22 bp, Artificial Sequence
  chemically synthesized
aatggcacatttgaaagtgtta

SEQ ID NO: 46984 - DNA, 22 bp, Artificial Sequence
  chemically synthesized
gaaagtgttatataaccatgtg

SEQ ID NO: 46985 - DNA, 22 bp, Artificial Sequence
  chemically synthesized
aaagtgttatataaccatgtga

SEQ ID NO: 46986 - DNA, 22 bp, Artificial Sequence
  chemically synthesized
tataaccatgtgaataataata

SEQ ID NO: 46987 - DNA, 22 bp, Artificial Sequence
  chemically synthesized
gcctatatgagttctttaattt

SEQ ID NO: 46988 - DNA, 22 bp, Artificial Sequence
  chemically synthesized
tatgagttctttaatttgcttt

SEQ ID NO: 46989 - DNA, 22 bp, Artificial Sequence
  chemically synthesized
tttaatttgctttttggtccgc

SEQ ID NO: 46990 - DNA, 22 bp, Artificial Sequence
  chemically synthesized
taatttgctttttggtccgcat

SEQ ID NO: 46991 - DNA, 22 bp, Artificial Sequence
  chemically synthesized
aatttgctttttggtccgcatt

SEQ ID NO: 46992 - DNA, 22 bp, Artificial Sequence
  chemically synthesized
atttgctttttggtccgcattt

SEQ ID NO: 46993 - DNA, 22 bp, Artificial Sequence
  chemically synthesized
gctttttggtccgcatttggta

SEQ ID NO: 46994 - DNA, 22 bp, Artificial Sequence
  chemically synthesized
ctttttggtccgcatttggtaa

SEQ ID NO: 46995 - DNA, 22 bp, Artificial Sequence
  chemically synthesized
tttggtccgcatttggtaactt

SEQ ID NO: 46996 - DNA, 22 bp, Artificial Sequence
  chemically synthesized
ttggtccgcatttggtaacttc

SEQ ID NO: 46997 - DNA, 22 bp, Artificial Sequence
  chemically synthesized
tggtccgcatttggtaacttct

SEQ ID NO: 46998 - DNA, 22 bp, Artificial Sequence
  chemically synthesized
ggtccgcatttggtaacttctt

SEQ ID NO: 46999 - DNA, 22 bp, Artificial Sequence
  chemically synthesized
gtccgcatttggtaacttcttt

SEQ ID NO: 47000 - DNA, 22 bp, Artificial Sequence
  chemically synthesized
ggtaacttctttatcatctact

SEQ ID NO: 47001 - DNA, 22 bp, Artificial Sequence
  chemically synthesized
gtaacttctttatcatctacta

SEQ ID NO: 47002 - DNA, 22 bp, Artificial Sequence
  chemically synthesized
ctttatcatctactatactctg

SEQ ID NO: 47003 - DNA, 22 bp, Artificial Sequence
  chemically synthesized
tttatcatctactatactctgt

SEQ ID NO: 47004 - DNA, 22 bp, Artificial Sequence
  chemically synthesized
tatcatctactatactctgttg

SEQ ID NO: 47005 - DNA, 22 bp, Artificial Sequence
  chemically synthesized
atcatctactatactctgttgt

SEQ ID NO: 47006 - DNA, 22 bp, Artificial Sequence
  chemically synthesized
tcatctactatactctgttgtg

SEQ ID NO: 47007 - DNA, 22 bp, Artificial Sequence
  chemically synthesized
ctatactctgttgtgtctcttt

SEQ ID NO: 47008 - DNA, 22 bp, Artificial Sequence
  chemically synthesized
tactctgttgtgtctcttttgt

SEQ ID NO: 47009 - DNA, 22 bp, Artificial Sequence
  chemically synthesized
tgttgtgtctcttttgttgtaa

SEQ ID NO: 47010 - DNA, 22 bp, Artificial Sequence
  chemically synthesized
ttgtgtctcttttgttgtaatt

SEQ ID NO: 47011 - DNA, 22 bp, Artificial Sequence
  chemically synthesized
tgtctcttttgttgtaatttgt

SEQ ID NO: 47012 - DNA, 22 bp, Artificial Sequence
  chemically synthesized
ttttgttgtaatttgtaagtag

SEQ ID NO: 47013 - DNA, 22 bp, Artificial Sequence
  chemically synthesized
ttgttgtaatttgtaagtaggg

SEQ ID NO: 47014 - DNA, 22 bp, Artificial Sequence
  chemically synthesized
tgttgtaatttgtaagtagggg

SEQ ID NO: 47015 - DNA, 22 bp, Artificial Sequence
  chemically synthesized
gttgtaatttgtaagtaggggt

SEQ ID NO: 47016 - DNA, 22 bp, Artificial Sequence
  chemically synthesized
ttgtaatttgtaagtaggggtg

SEQ ID NO: 47017 - DNA, 22 bp, Artificial Sequence
  chemically synthesized
taatttgtaagtaggggtgaga

SEQ ID NO: 47018 - DNA, 22 bp, Artificial Sequence
  chemically synthesized
gtaagtaggggtgagataaagt

SEQ ID NO: 47019 - DNA, 22 bp, Artificial Sequence
  chemically synthesized
taagtaggggtgagataaagta

SEQ ID NO: 47020 - DNA, 22 bp, Artificial Sequence
  chemically synthesized
gggtttgctgggtttcttccat

SEQ ID NO: 47021 - DNA, 22 bp, Artificial Sequence
  chemically synthesized
gctgggtttcttccatgtcatc

SEQ ID NO: 47022 - DNA, 22 bp, Artificial Sequence
  chemically synthesized
ctgggtttcttccatgtcatca

SEQ ID NO: 47023 - DNA, 22 bp, Artificial Sequence
  chemically synthesized
ggtttcttccatgtcatcatgt

SEQ ID NO: 47024 - DNA, 22 bp, Artificial Sequence
  chemically synthesized
cttccatgtcatcatgttcctc

SEQ ID NO: 47025 - DNA, 22 bp, Artificial Sequence
  chemically synthesized
ttccatgtcatcatgttcctcc

SEQ ID NO: 47026 - DNA, 22 bp, Artificial Sequence
  chemically synthesized
ccatgtcatcatgttcctcctt

SEQ ID NO: 47027 - DNA, 22 bp, Artificial Sequence
  chemically synthesized
catgtcatcatgttcctccttg

SEQ ID NO: 47028 - DNA, 22 bp, Artificial Sequence
  chemically synthesized
ctccttgcatggggccaggatc

SEQ ID NO: 47029 - DNA, 22 bp, Artificial Sequence
  chemically synthesized
cttgcatggggccaggatccgt

SEQ ID NO: 47030 - DNA, 22 bp, Artificial Sequence
  chemically synthesized
gcatggggccaggatccgtgga

SEQ ID NO: 47031 - DNA, 22 bp, Artificial Sequence
  chemically synthesized
catggggccaggatccgtggag

SEQ ID NO: 47032 - DNA, 22 bp, Artificial Sequence
  chemically synthesized
cctggcacctacgtggtggtgc

SEQ ID NO: 47033 - DNA, 22 bp, Artificial Sequence
  chemically synthesized
gcacctacgtggtggtgctgaa

SEQ ID NO: 47034 - DNA, 22 bp, Artificial Sequence
  chemically synthesized
cgtggtggtgctgaaggaggag

SEQ ID NO: 47035 - DNA, 22 bp, Artificial Sequence
  chemically synthesized
aaggaggagacccacctctcgc

SEQ ID NO: 47036 - DNA, 22 bp, Artificial Sequence
  chemically synthesized
tcgcagtcagagcgcactgccc

SEQ ID NO: 47037 - DNA, 22 bp, Artificial Sequence
  chemically synthesized
gcagtcagagcgcactgcccgc

SEQ ID NO: 47038 - DNA, 22 bp, Artificial Sequence
  chemically synthesized
cccgccgcctgcaggcccaggc

SEQ ID NO: 47039 - DNA, 22 bp, Artificial Sequence
  chemically synthesized
caggcccaggctgcccgccggg

SEQ ID NO: 47040 - DNA, 22 bp, Artificial Sequence
  chemically synthesized
cccgccggggatacctcaccaa

SEQ ID NO: 47041 - DNA, 22 bp, Artificial Sequence
  chemically synthesized
accaagatcctgcatgtcttcc

SEQ ID NO: 47042 - DNA, 22 bp, Artificial Sequence
  chemically synthesized
catgtcttccatggccttcttc

SEQ ID NO: 47043 - DNA, 22 bp, Artificial Sequence
  chemically synthesized
ccatggccttcttcctggcttc

SEQ ID NO: 47044 - DNA, 22 bp, Artificial Sequence
  chemically synthesized
catggccttcttcctggcttcc

SEQ ID NO: 47045 - DNA, 22 bp, Artificial Sequence
  chemically synthesized
cttcctggcttcctggtgaaga

SEQ ID NO: 47046 - DNA, 22 bp, Artificial Sequence
  chemically synthesized
ttcctggcttcctggtgaagat

SEQ ID NO: 47047 - DNA, 22 bp, Artificial Sequence
  chemically synthesized
cctggcttcctggtgaagatga

SEQ ID NO: 47048 - DNA, 22 bp, Artificial Sequence
  chemically synthesized
ctggcttcctggtgaagatgag

SEQ ID NO: 47049 - DNA, 22 bp, Artificial Sequence
  chemically synthesized
gcttcctggtgaagatgagtgg

SEQ ID NO: 47050 - DNA, 22 bp, Artificial Sequence
  chemically synthesized
cctggtgaagatgagtggcgac

SEQ ID NO: 47051 - DNA, 22 bp, Artificial Sequence
  chemically synthesized
ctggtgaagatgagtggcgacc

SEQ ID NO: 47052 - DNA, 22 bp, Artificial Sequence
  chemically synthesized
gtgaagatgagtggcgacctgc

SEQ ID NO: 47053 - DNA, 22 bp, Artificial Sequence
  chemically synthesized
ctggagctggtgagccaccctt

SEQ ID NO: 47054 - DNA, 22 bp, Artificial Sequence
  chemically synthesized
gagctggtgagccacccttttt

SEQ ID NO: 47055 - DNA, 22 bp, Artificial Sequence
  chemically synthesized
gtgagccaccctttttgggaat

SEQ ID NO: 47056 - DNA, 22 bp, Artificial Sequence
  chemically synthesized
tttgggaatggcacttcctgat

SEQ ID NO: 47057 - DNA, 22 bp, Artificial Sequence
  chemically synthesized
ttgggaatggcacttcctgata

SEQ ID NO: 47058 - DNA, 22 bp, Artificial Sequence
  chemically synthesized
tgggaatggcacttcctgatag

SEQ ID NO: 47059 - DNA, 22 bp, Artificial Sequence
  chemically synthesized
gggaatggcacttcctgatagg

SEQ ID NO: 47060 - DNA, 22 bp, Artificial Sequence
  chemically synthesized
ggaatggcacttcctgataggg

SEQ ID NO: 47061 - DNA, 22 bp, Artificial Sequence
  chemically synthesized
cctgatagggctgggccactgc

SEQ ID NO: 47062 - DNA, 22 bp, Artificial Sequence
  chemically synthesized
ctgatagggctgggccactgca

SEQ ID NO: 47063 - DNA, 22 bp, Artificial Sequence
  chemically synthesized
atagggctgggccactgcatat

SEQ ID NO: 47064 - DNA, 22 bp, Artificial Sequence
  chemically synthesized
ggccactgcatatacactgggg

SEQ ID NO: 47065 - DNA, 22 bp, Artificial Sequence
  chemically synthesized
catatacactggggactgtgct

SEQ ID NO: 47066 - DNA, 22 bp, Artificial Sequence
  chemically synthesized
gggactgtgcttagtaggccca

SEQ ID NO: 47067 - DNA, 22 bp, Artificial Sequence
  chemically synthesized
tgcttagtaggcccattgctga

SEQ ID NO: 47068 - DNA, 22 bp, Artificial Sequence
  chemically synthesized
agtaggcccattgctgaaaatc

SEQ ID NO: 47069 - DNA, 22 bp, Artificial Sequence
  chemically synthesized
gtaggcccattgctgaaaatca

SEQ ID NO: 47070 - DNA, 22 bp, Artificial Sequence
  chemically synthesized
ctgaaaatcagaaggggacagc

SEQ ID NO: 47071 - DNA, 22 bp, Artificial Sequence
  chemically synthesized
aaaatcagaaggggacagcaag

SEQ ID NO: 47072 - DNA, 22 bp, Artificial Sequence
  chemically synthesized
agcacttatcgggtaccaagca

SEQ ID NO: 47073 - DNA, 22 bp, Artificial Sequence
  chemically synthesized
atcgggtaccaagcacagtaac

SEQ ID NO: 47074 - DNA, 22 bp, Artificial Sequence
  chemically synthesized
tcgggtaccaagcacagtaact

SEQ ID NO: 47075 - DNA, 22 bp, Artificial Sequence
  chemically synthesized
ctggctttctgtatagaattcc

SEQ ID NO: 47076 - DNA, 22 bp, Artificial Sequence
  chemically synthesized
gctttctgtatagaattccctt

SEQ ID NO: 47077 - DNA, 22 bp, Artificial Sequence
  chemically synthesized
tctgtatagaattccctttaag

SEQ ID NO: 47078 - DNA, 22 bp, Artificial Sequence
  chemically synthesized
ctgtatagaattccctttaagc

SEQ ID NO: 47079 - DNA, 22 bp, Artificial Sequence
  chemically synthesized
tgtatagaattccctttaagcc

SEQ ID NO: 47080 - DNA, 22 bp, Artificial Sequence
  chemically synthesized
tatagaattccctttaagcctg

SEQ ID NO: 47081 - DNA, 22 bp, Artificial Sequence
  chemically synthesized
cctttaagcctggccatgcccc

SEQ ID NO: 47082 - DNA, 22 bp, Artificial Sequence
  chemically synthesized
taagcctggccatgccccagtg

SEQ ID NO: 47083 - DNA, 22 bp, Artificial Sequence
  chemically synthesized
aagcctggccatgccccagtgg

SEQ ID NO: 47084 - DNA, 22 bp, Artificial Sequence
  chemically synthesized
agcctggccatgccccagtggt

SEQ ID NO: 47085 - DNA, 22 bp, Artificial Sequence
  chemically synthesized
gccatgccccagtggtacgtct

SEQ ID NO: 47086 - DNA, 22 bp, Artificial Sequence
  chemically synthesized
tcttcatttgaaagacgaggag

SEQ ID NO: 47087 - DNA, 22 bp, Artificial Sequence
  chemically synthesized
catttgaaagacgaggagactg

SEQ ID NO: 47088 - DNA, 22 bp, Artificial Sequence
  chemically synthesized
atttgaaagacgaggagactga

SEQ ID NO: 47089 - DNA, 22 bp, Artificial Sequence
  chemically synthesized
gaaagacgaggagactgaagtt

SEQ ID NO: 47090 - DNA, 22 bp, Artificial Sequence
  chemically synthesized
aaagacgaggagactgaagttc

SEQ ID NO: 47091 - DNA, 22 bp, Artificial Sequence
  chemically synthesized
aagttcagaggggaccacacag

SEQ ID NO: 47092 - DNA, 22 bp, Artificial Sequence
  chemically synthesized
agaggggaccacacagacagct

SEQ ID NO: 47093 - DNA, 22 bp, Artificial Sequence
  chemically synthesized
ggggtagagcctggatcaaacc

SEQ ID NO: 47094 - DNA, 22 bp, Artificial Sequence
  chemically synthesized
gatcaaacccattggtctgcct

SEQ ID NO: 47095 - DNA, 22 bp, Artificial Sequence
  chemically synthesized
gtctgcctgccagccattcttg

SEQ ID NO: 47096 - DNA, 22 bp, Artificial Sequence
  chemically synthesized
cctgccagccattcttgtgcca

SEQ ID NO: 47097 - DNA, 22 bp, Artificial Sequence
  chemically synthesized
ccagccattcttgtgccaatgc

SEQ ID NO: 47098 - DNA, 22 bp, Artificial Sequence
  chemically synthesized
ttgtgccaatgcatctgctgcc

SEQ ID NO: 47099 - DNA, 22 bp, Artificial Sequence
  chemically synthesized
gtgccaatgcatctgctgccta

SEQ ID NO: 47100 - DNA, 22 bp, Artificial Sequence
  chemically synthesized
tgccaatgcatctgctgcctac

SEQ ID NO: 47101 - DNA, 22 bp, Artificial Sequence
  chemically synthesized
ctgcctacggaaacctgtaggg

SEQ ID NO: 47102 - DNA, 22 bp, Artificial Sequence
  chemically synthesized
cctacggaaacctgtagggaca

SEQ ID NO: 47103 - DNA, 22 bp, Artificial Sequence
  chemically synthesized
cggaaacctgtagggacaaggc

SEQ ID NO: 47104 - DNA, 22 bp, Artificial Sequence
  chemically synthesized
tagggacaaggccctgggatgt

SEQ ID NO: 47105 - DNA, 22 bp, Artificial Sequence
  chemically synthesized
ggatgttcagtggagcctgagt

SEQ ID NO: 47106 - DNA, 22 bp, Artificial Sequence
  chemically synthesized
agtggagcctgagtcattttat

SEQ ID NO: 47107 - DNA, 22 bp, Artificial Sequence
  chemically synthesized
agtcattttataaaaaagcatg

SEQ ID NO: 47108 - DNA, 22 bp, Artificial Sequence
  chemically synthesized
tataaaaaagcatgactctagg

SEQ ID NO: 47109 - DNA, 22 bp, Artificial Sequence
  chemically synthesized
ataaaaaagcatgactctaggg

SEQ ID NO: 47110 - DNA, 22 bp, Artificial Sequence
  chemically synthesized
taaaaaagcatgactctagggt

SEQ ID NO: 47111 - DNA, 22 bp, Artificial Sequence
  chemically synthesized
tagggtccaaaattcctttgaa

SEQ ID NO: 47112 - DNA, 22 bp, Artificial Sequence
  chemically synthesized
gggtccaaaattcctttgaagc

SEQ ID NO: 47113 - DNA, 22 bp, Artificial Sequence
  chemically synthesized
ctttgaagctgttgctatccag

SEQ ID NO: 47114 - DNA, 22 bp, Artificial Sequence
  chemically synthesized
tgaagctgttgctatccagagt

SEQ ID NO: 47115 - DNA, 22 bp, Artificial Sequence
  chemically synthesized
gaagctgttgctatccagagtg

SEQ ID NO: 47116 - DNA, 22 bp, Artificial Sequence
  chemically synthesized
aagctgttgctatccagagtga

SEQ ID NO: 47117 - DNA, 22 bp, Artificial Sequence
  chemically synthesized
ttgctatccagagtgaagtccc

SEQ ID NO: 47118 - DNA, 22 bp, Artificial Sequence
  chemically synthesized
ctatccagagtgaagtcccttc

SEQ ID NO: 47119 - DNA, 22 bp, Artificial Sequence
  chemically synthesized
tccagagtgaagtcccttcttt

SEQ ID NO: 47120 - DNA, 22 bp, Artificial Sequence
  chemically synthesized
ctttaggacagggtggccctcc

SEQ ID NO: 47121 - DNA, 22 bp, Artificial Sequence
  chemically synthesized
tttaggacagggtggccctcct

SEQ ID NO: 47122 - DNA, 22 bp, Artificial Sequence
  chemically synthesized
taggacagggtggccctcctcc

SEQ ID NO: 47123 - DNA, 22 bp, Artificial Sequence
  chemically synthesized
aggacagggtggccctcctccc

SEQ ID NO: 47124 - DNA, 22 bp, Artificial Sequence
  chemically synthesized
ggacagggtggccctcctccct

SEQ ID NO: 47125 - DNA, 22 bp, Artificial Sequence
  chemically synthesized
ctccctcctggatgtcacatct

SEQ ID NO: 47126 - DNA, 22 bp, Artificial Sequence
  chemically synthesized
cctcctggatgtcacatcttcg

SEQ ID NO: 47127 - DNA, 22 bp, Artificial Sequence
  chemically synthesized
ctggatgtcacatcttcggtgg

SEQ ID NO: 47128 - DNA, 22 bp, Artificial Sequence
  chemically synthesized
gatgtcacatcttcggtggagg

SEQ ID NO: 47129 - DNA, 22 bp, Artificial Sequence
  chemically synthesized
cggtggaggggcagaaagggga

SEQ ID NO: 47130 - DNA, 22 bp, Artificial Sequence
  chemically synthesized
ggtggaggggcagaaaggggac

SEQ ID NO: 47131 - DNA, 22 bp, Artificial Sequence
  chemically synthesized
ggtattctcctcaccctggccc

SEQ ID NO: 47132 - DNA, 22 bp, Artificial Sequence
  chemically synthesized
tcctcaccctggccctagtgct

SEQ ID NO: 47133 - DNA, 22 bp, Artificial Sequence
  chemically synthesized
ctcaccctggccctagtgcttc

SEQ ID NO: 47134 - DNA, 22 bp, Artificial Sequence
  chemically synthesized
accctggccctagtgcttcaaa

SEQ ID NO: 47135 - DNA, 22 bp, Artificial Sequence
  chemically synthesized
gccctagtgcttcaaatcttaa

SEQ ID NO: 47136 - DNA, 22 bp, Artificial Sequence
  chemically synthesized
gtgcttcaaatcttaaaaaaac

SEQ ID NO: 47137 - DNA, 22 bp, Artificial Sequence
  chemically synthesized
caaatcttaaaaaaacgttttt

SEQ ID NO: 47138 - DNA, 22 bp, Artificial Sequence
  chemically synthesized
aaatcttaaaaaaacgttttta

SEQ ID NO: 47139 - DNA, 22 bp, Artificial Sequence
  chemically synthesized
aaaaaaacgtttttatttgtgc

SEQ ID NO: 47140 - DNA, 22 bp, Artificial Sequence
  chemically synthesized
aaaaaacgtttttatttgtgct

SEQ ID NO: 47141 - DNA, 22 bp, Artificial Sequence
  chemically synthesized
ttatttgtgcttctgcaccacc

SEQ ID NO: 47142 - DNA, 22 bp, Artificial Sequence
  chemically synthesized
tatttgtgcttctgcaccacct

SEQ ID NO: 47143 - DNA, 22 bp, Artificial Sequence
  chemically synthesized
atttgtgcttctgcaccacctt

SEQ ID NO: 47144 - DNA, 22 bp, Artificial Sequence
  chemically synthesized
tttgtgcttctgcaccaccttc

SEQ ID NO: 47145 - DNA, 22 bp, Artificial Sequence
  chemically synthesized
gtgcttctgcaccaccttctag

SEQ ID NO: 47146 - DNA, 22 bp, Artificial Sequence
  chemically synthesized
tgcttctgcaccaccttctagc

SEQ ID NO: 47147 - DNA, 22 bp, Artificial Sequence
  chemically synthesized
gaaggtggtgcagaagcacaaa

SEQ ID NO: 47148 - DNA, 22 bp, Artificial Sequence
  chemically synthesized
ttttaagatttgaagcactagg

SEQ ID NO: 47149 - DNA, 22 bp, Artificial Sequence
  chemically synthesized
tttaagatttgaagcactaggg

SEQ ID NO: 47150 - DNA, 22 bp, Artificial Sequence
  chemically synthesized
ttaagatttgaagcactagggc

SEQ ID NO: 47151 - DNA, 22 bp, Artificial Sequence
  chemically synthesized
taagatttgaagcactagggcc

SEQ ID NO: 47152 - DNA, 22 bp, Artificial Sequence
  chemically synthesized
aagatttgaagcactagggcca

SEQ ID NO: 47153 - DNA, 22 bp, Artificial Sequence
  chemically synthesized
agatttgaagcactagggccag

SEQ ID NO: 47154 - DNA, 22 bp, Artificial Sequence
  chemically synthesized
gaagcactagggccagggtgag

SEQ ID NO: 47155 - DNA, 22 bp, Artificial Sequence
  chemically synthesized
aagcactagggccagggtgagg

SEQ ID NO: 47156 - DNA, 22 bp, Artificial Sequence
  chemically synthesized
gggccagggtgaggagaatacc

SEQ ID NO: 47157 - DNA, 22 bp, Artificial Sequence
  chemically synthesized
tctgcccctccaccgaagatgt

SEQ ID NO: 47158 - DNA, 22 bp, Artificial Sequence
  chemically synthesized
ctgcccctccaccgaagatgtg

SEQ ID NO: 47159 - DNA, 22 bp, Artificial Sequence
  chemically synthesized
tgcccctccaccgaagatgtga

SEQ ID NO: 47160 - DNA, 22 bp, Artificial Sequence
  chemically synthesized
cccctccaccgaagatgtgaca

SEQ ID NO: 47161 - DNA, 22 bp, Artificial Sequence
  chemically synthesized
caccgaagatgtgacatccagg

SEQ ID NO: 47162 - DNA, 22 bp, Artificial Sequence
  chemically synthesized
tcctaaagaagggacttcactc

SEQ ID NO: 47163 - DNA, 22 bp, Artificial Sequence
  chemically synthesized
aagaagggacttcactctggat

SEQ ID NO: 47164 - DNA, 22 bp, Artificial Sequence
  chemically synthesized
cactctggatagcaacagcttc

SEQ ID NO: 47165 - DNA, 22 bp, Artificial Sequence
  chemically synthesized
actctggatagcaacagcttca

SEQ ID NO: 47166 - DNA, 22 bp, Artificial Sequence
  chemically synthesized
tggatagcaacagcttcaaagg

SEQ ID NO: 47167 - DNA, 22 bp, Artificial Sequence
  chemically synthesized
gatagcaacagcttcaaaggaa

SEQ ID NO: 47168 - DNA, 22 bp, Artificial Sequence
  chemically synthesized
caaaggaattttggaccctaga

SEQ ID NO: 47169 - DNA, 22 bp, Artificial Sequence
  chemically synthesized
aaaggaattttggaccctagag

SEQ ID NO: 47170 - DNA, 22 bp, Artificial Sequence
  chemically synthesized
tggaccctagagtcatgctttt

SEQ ID NO: 47171 - DNA, 22 bp, Artificial Sequence
  chemically synthesized
ggaccctagagtcatgcttttt

SEQ ID NO: 47172 - DNA, 22 bp, Artificial Sequence
  chemically synthesized
gaccctagagtcatgctttttt

SEQ ID NO: 47173 - DNA, 22 bp, Artificial Sequence
  chemically synthesized
gagtcatgcttttttataaaat

SEQ ID NO: 47174 - DNA, 22 bp, Artificial Sequence
  chemically synthesized
ttttataaaatgactcaggctc

SEQ ID NO: 47175 - DNA, 22 bp, Artificial Sequence
  chemically synthesized
tttataaaatgactcaggctcc

SEQ ID NO: 47176 - DNA, 22 bp, Artificial Sequence
  chemically synthesized
ttataaaatgactcaggctcca

SEQ ID NO: 47177 - DNA, 22 bp, Artificial Sequence
  chemically synthesized
tataaaatgactcaggctccac

SEQ ID NO: 47178 - DNA, 22 bp, Artificial Sequence
  chemically synthesized
ataaaatgactcaggctccact

SEQ ID NO: 47179 - DNA, 22 bp, Artificial Sequence
  chemically synthesized
taaaatgactcaggctccactg

SEQ ID NO: 47180 - DNA, 22 bp, Artificial Sequence
  chemically synthesized
aggctccactgaacatcccagg

SEQ ID NO: 47181 - DNA, 22 bp, Artificial Sequence
  chemically synthesized
cactgaacatcccagggccttg

SEQ ID NO: 47182 - DNA, 22 bp, Artificial Sequence
  chemically synthesized
aacatcccagggccttgtccct

SEQ ID NO: 47183 - DNA, 22 bp, Artificial Sequence
  chemically synthesized
gtccctacaggtttccgtaggc

SEQ ID NO: 47184 - DNA, 22 bp, Artificial Sequence
  chemically synthesized
tccctacaggtttccgtaggca

SEQ ID NO: 47185 - DNA, 22 bp, Artificial Sequence
  chemically synthesized
caggtttccgtaggcagcagat

SEQ ID NO: 47186 - DNA, 22 bp, Artificial Sequence
  chemically synthesized
ccgtaggcagcagatgcattgg

SEQ ID NO: 47187 - DNA, 22 bp, Artificial Sequence
  chemically synthesized
cgtaggcagcagatgcattggc

SEQ ID NO: 47188 - DNA, 22 bp, Artificial Sequence
  chemically synthesized
gcacaagaatggctggcaggca

SEQ ID NO: 47189 - DNA, 22 bp, Artificial Sequence
  chemically synthesized
gcaggcagaccaatgggtttga

SEQ ID NO: 47190 - DNA, 22 bp, Artificial Sequence
  chemically synthesized
gatccaggctctacccctagct

SEQ ID NO: 47191 - DNA, 22 bp, Artificial Sequence
  chemically synthesized
atccaggctctacccctagctg

SEQ ID NO: 47192 - DNA, 22 bp, Artificial Sequence
  chemically synthesized
tacccctagctgtctgtgtggt

SEQ ID NO: 47193 - DNA, 22 bp, Artificial Sequence
  chemically synthesized
cccctagctgtctgtgtggtcc

SEQ ID NO: 47194 - DNA, 22 bp, Artificial Sequence
  chemically synthesized
gctgtctgtgtggtcccctctg

SEQ ID NO: 47195 - DNA, 22 bp, Artificial Sequence
  chemically synthesized
tctgtgtggtcccctctgaact

SEQ ID NO: 47196 - DNA, 22 bp, Artificial Sequence
  chemically synthesized
tgtggtcccctctgaacttcag

SEQ ID NO: 47197 - DNA, 22 bp, Artificial Sequence
  chemically synthesized
tgaacttcagtctcctcgtctt

SEQ ID NO: 47198 - DNA, 22 bp, Artificial Sequence
  chemically synthesized
aacttcagtctcctcgtctttc

SEQ ID NO: 47199 - DNA, 22 bp, Artificial Sequence
  chemically synthesized
cagtctcctcgtctttcaaatg

SEQ ID NO: 47200 - DNA, 22 bp, Artificial Sequence
  chemically synthesized
agtctcctcgtctttcaaatga

SEQ ID NO: 47201 - DNA, 22 bp, Artificial Sequence
  chemically synthesized
ctcgtctttcaaatgaagatag

SEQ ID NO: 47202 - DNA, 22 bp, Artificial Sequence
  chemically synthesized
gtctttcaaatgaagatagacg

SEQ ID NO: 47203 - DNA, 22 bp, Artificial Sequence
  chemically synthesized
tcaaatgaagatagacgtacca

SEQ ID NO: 47204 - DNA, 22 bp, Artificial Sequence
  chemically synthesized
caaatgaagatagacgtaccac

SEQ ID NO: 47205 - DNA, 22 bp, Artificial Sequence
  chemically synthesized
aaatgaagatagacgtaccact

SEQ ID NO: 47206 - DNA, 22 bp, Artificial Sequence
  chemically synthesized
gggcatggccaggcttaaaggg

SEQ ID NO: 47207 - DNA, 22 bp, Artificial Sequence
  chemically synthesized
aaagggaattctatacagaaag

SEQ ID NO: 47208 - DNA, 22 bp, Artificial Sequence
  chemically synthesized
aagggaattctatacagaaagc

SEQ ID NO: 47209 - DNA, 22 bp, Artificial Sequence
  chemically synthesized
tatacagaaagccagtagttac

SEQ ID NO: 47210 - DNA, 22 bp, Artificial Sequence
  chemically synthesized
tacagaaagccagtagttactg

SEQ ID NO: 47211 - DNA, 22 bp, Artificial Sequence
  chemically synthesized
ctgtgcttggtacccgataagt

SEQ ID NO: 47212 - DNA, 22 bp, Artificial Sequence
  chemically synthesized
tgcttggtacccgataagtgct

SEQ ID NO: 47213 - DNA, 22 bp, Artificial Sequence
  chemically synthesized
ggtacccgataagtgctcaata

SEQ ID NO: 47214 - DNA, 22 bp, Artificial Sequence
  chemically synthesized
gtacccgataagtgctcaatac

SEQ ID NO: 47215 - DNA, 22 bp, Artificial Sequence
  chemically synthesized
aatacatacttgctgtcccctt

SEQ ID NO: 47216 - DNA, 22 bp, Artificial Sequence
  chemically synthesized
gctgtccccttctgattttcag

SEQ ID NO: 47217 - DNA, 22 bp, Artificial Sequence
  chemically synthesized
ctgtccccttctgattttcagc

SEQ ID NO: 47218 - DNA, 22 bp, Artificial Sequence
  chemically synthesized
tccccttctgattttcagcaat

SEQ ID NO: 47219 - DNA, 22 bp, Artificial Sequence
  chemically synthesized
ctgattttcagcaatgggccta

SEQ ID NO: 47220 - DNA, 22 bp, Artificial Sequence
  chemically synthesized
tgattttcagcaatgggcctac

SEQ ID NO: 47221 - DNA, 22 bp, Artificial Sequence
  chemically synthesized
attttcagcaatgggcctacta

SEQ ID NO: 47222 - DNA, 22 bp, Artificial Sequence
  chemically synthesized
tcagcaatgggcctactaagca

SEQ ID NO: 47223 - DNA, 22 bp, Artificial Sequence
  chemically synthesized
cagcaatgggcctactaagcac

SEQ ID NO: 47224 - DNA, 22 bp, Artificial Sequence
  chemically synthesized
agcaatgggcctactaagcaca

SEQ ID NO: 47225 - DNA, 22 bp, Artificial Sequence
  chemically synthesized
ctaagcacagtccccagtgtat

SEQ ID NO: 47226 - DNA, 22 bp, Artificial Sequence
  chemically synthesized
agcacagtccccagtgtatatg

SEQ ID NO: 47227 - DNA, 22 bp, Artificial Sequence
  chemically synthesized
tcaggaagtgccattcccaaaa

SEQ ID NO: 47228 - DNA, 22 bp, Artificial Sequence
  chemically synthesized
ccaaaaagggtggctcaccagc

SEQ ID NO: 47229 - DNA, 22 bp, Artificial Sequence
  chemically synthesized
accagctccagcaggtcgccac

SEQ ID NO: 47230 - DNA, 22 bp, Artificial Sequence
  chemically synthesized
cagcaggtcgccactcatcttc

SEQ ID NO: 47231 - DNA, 22 bp, Artificial Sequence
  chemically synthesized
atcttcaccaggaagccaggaa

SEQ ID NO: 47232 - DNA, 22 bp, Artificial Sequence
  chemically synthesized
caccaggaagccaggaagaagg

SEQ ID NO: 47233 - DNA, 22 bp, Artificial Sequence
  chemically synthesized
accaggaagccaggaagaaggc

SEQ ID NO: 47234 - DNA, 22 bp, Artificial Sequence
  chemically synthesized
ggtgaggtatccccggcgggca

SEQ ID NO: 47235 - DNA, 22 bp, Artificial Sequence
  chemically synthesized
gtgaggtatccccggcgggcag

SEQ ID NO: 47236 - DNA, 22 bp, Artificial Sequence
  chemically synthesized
ggcctgcaggcggcgggcagtg

SEQ ID NO: 47237 - DNA, 22 bp, Artificial Sequence
  chemically synthesized
caggcggcgggcagtgcgctct

SEQ ID NO: 47238 - DNA, 22 bp, Artificial Sequence
  chemically synthesized
tgactgcgagaggtgggtctcc

SEQ ID NO: 47239 - DNA, 22 bp, Artificial Sequence
  chemically synthesized
actgcgagaggtgggtctcctc

SEQ ID NO: 47240 - DNA, 22 bp, Artificial Sequence
  chemically synthesized
cgagaggtgggtctcctccttc

SEQ ID NO: 47241 - DNA, 22 bp, Artificial Sequence
  chemically synthesized
ctccttcagcaccaccacgtag

SEQ ID NO: 47242 - DNA, 22 bp, Artificial Sequence
  chemically synthesized
cttcagcaccaccacgtaggtg

SEQ ID NO: 47243 - DNA, 22 bp, Artificial Sequence
  chemically synthesized
cagcaccaccacgtaggtgcca

SEQ ID NO: 47244 - DNA, 22 bp, Artificial Sequence
  chemically synthesized
agcaccaccacgtaggtgccag

SEQ ID NO: 47245 - DNA, 22 bp, Artificial Sequence
  chemically synthesized
cacggatcctggccccatgcaa

SEQ ID NO: 47246 - DNA, 22 bp, Artificial Sequence
  chemically synthesized
gccccatgcaaggaggaacatg

SEQ ID NO: 47247 - DNA, 22 bp, Artificial Sequence
  chemically synthesized
ggtgtactttatctcaccccta

SEQ ID NO: 47248 - DNA, 22 bp, Artificial Sequence
  chemically synthesized
tatctcacccctacttacaaat

SEQ ID NO: 47249 - DNA, 22 bp, Artificial Sequence
  chemically synthesized
atctcacccctacttacaaatt

SEQ ID NO: 47250 - DNA, 22 bp, Artificial Sequence
  chemically synthesized
tctcacccctacttacaaatta

SEQ ID NO: 47251 - DNA, 22 bp, Artificial Sequence
  chemically synthesized
acccctacttacaaattacaac

SEQ ID NO: 47252 - DNA, 22 bp, Artificial Sequence
  chemically synthesized
cttacaaattacaacaaaagag

SEQ ID NO: 47253 - DNA, 22 bp, Artificial Sequence
  chemically synthesized
acaaattacaacaaaagagaca

SEQ ID NO: 47254 - DNA, 22 bp, Artificial Sequence
  chemically synthesized
caaattacaacaaaagagacac

SEQ ID NO: 47255 - DNA, 22 bp, Artificial Sequence
  chemically synthesized
caacaaaagagacacaacagag

SEQ ID NO: 47256 - DNA, 22 bp, Artificial Sequence
  chemically synthesized
ccaaatgcggaccaaaaagcaa

SEQ ID NO: 47257 - DNA, 22 bp, Artificial Sequence
  chemically synthesized
aagaactcatataggccaacta

SEQ ID NO: 47258 - DNA, 22 bp, Artificial Sequence
  chemically synthesized
atataggccaactattattatt

SEQ ID NO: 47259 - DNA, 22 bp, Artificial Sequence
  chemically synthesized
ttattattcacatggttatata

SEQ ID NO: 47260 - DNA, 22 bp, Artificial Sequence
  chemically synthesized
ttattcacatggttatataaca

SEQ ID NO: 47261 - DNA, 22 bp, Artificial Sequence
  chemically synthesized
ttcacatggttatataacactt

SEQ ID NO: 47262 - DNA, 22 bp, Artificial Sequence
  chemically synthesized
acatggttatataacactttca

SEQ ID NO: 47263 - DNA, 22 bp, Artificial Sequence
  chemically synthesized
tataacactttcaaatgtgcca

SEQ ID NO: 47264 - DNA, 22 bp, Artificial Sequence
  chemically synthesized
tcaaatgtgccattcaggcaaa

SEQ ID NO: 47265 - DNA, 22 bp, Artificial Sequence
  chemically synthesized
caaatgtgccattcaggcaaaa

SEQ ID NO: 47266 - DNA, 22 bp, Artificial Sequence
  chemically synthesized
aaatgtgccattcaggcaaaaa

SEQ ID NO: 47267 - DNA, 22 bp, Artificial Sequence
  chemically synthesized
aggcaaaaatgggaactacggg

SEQ ID NO: 47268 - DNA, 22 bp, Artificial Sequence
  chemically synthesized
cgggccacactcgacaacaggt

SEQ ID NO: 47269 - DNA, 22 bp, Artificial Sequence
  chemically synthesized
gacaacaggttttcctctgtac

SEQ ID NO: 47270 - DNA, 22 bp, Artificial Sequence
  chemically synthesized
tcctctgtacctgcacccagct

SEQ ID NO: 47271 - DNA, 22 bp, Artificial Sequence
  chemically synthesized
cctctgtacctgcacccagctc

SEQ ID NO: 47272 - DNA, 22 bp, Artificial Sequence
  chemically synthesized
ctctgtacctgcacccagctct

SEQ ID NO: 47273 - DNA, 22 bp, Artificial Sequence
  chemically synthesized
tgtacctgcacccagctctcta

SEQ ID NO: 47274 - DNA, 22 bp, Artificial Sequence
  chemically synthesized
tacctgcacccagctctctacg

SEQ ID NO: 47275 - DNA, 22 bp, Artificial Sequence
  chemically synthesized
cacccagctctctacgggcctg

SEQ ID NO: 47276 - DNA, 22 bp, Artificial Sequence
  chemically synthesized
tctacgggcctggtcgctcctg

SEQ ID NO: 47277 - DNA, 22 bp, Artificial Sequence
  chemically synthesized
tacgggcctggtcgctcctggt

SEQ ID NO: 47278 - DNA, 22 bp, Artificial Sequence
  chemically synthesized
cgggcctggtcgctcctggtgg

SEQ ID NO: 47279 - DNA, 22 bp, Artificial Sequence
  chemically synthesized
gtcgctcctggtggccctgccc

SEQ ID NO: 47280 - DNA, 22 bp, Artificial Sequence
  chemically synthesized
ctggtggccctgcccaaaggcc

SEQ ID NO: 47281 - DNA, 22 bp, Artificial Sequence
  chemically synthesized
gtggccctgcccaaaggccacc

SEQ ID NO: 47282 - DNA, 22 bp, Artificial Sequence
  chemically synthesized
cccaaaggccaccccctccccc

SEQ ID NO: 47283 - DNA, 22 bp, Artificial Sequence
  chemically synthesized
ccccatgccccagtcagaataa

SEQ ID NO: 47284 - DNA, 22 bp, Artificial Sequence
  chemically synthesized
agggaaaaaatcatgggctttg

SEQ ID NO: 47285 - DNA, 22 bp, Artificial Sequence
  chemically synthesized
tggagccaggaaaccgtggacc

SEQ ID NO: 47286 - DNA, 22 bp, Artificial Sequence
  chemically synthesized
ggagccaggaaaccgtggacct

SEQ ID NO: 47287 - DNA, 22 bp, Artificial Sequence
  chemically synthesized
gagccaggaaaccgtggacctg

SEQ ID NO: 47288 - DNA, 22 bp, Artificial Sequence
  chemically synthesized
aattccagctccaatatttact

SEQ ID NO: 47289 - DNA, 22 bp, Artificial Sequence
  chemically synthesized
cagctccaatatttactggttg

SEQ ID NO: 47290 - DNA, 22 bp, Artificial Sequence
  chemically synthesized
caatatttactggttgtgcagc

SEQ ID NO: 47291 - DNA, 22 bp, Artificial Sequence
  chemically synthesized
actggttgtgcagccatgagca

SEQ ID NO: 47292 - DNA, 22 bp, Artificial Sequence
  chemically synthesized
ctggttgtgcagccatgagcaa

SEQ ID NO: 47293 - DNA, 22 bp, Artificial Sequence
  chemically synthesized
gttgtgcagccatgagcaagtc

SEQ ID NO: 47294 - DNA, 22 bp, Artificial Sequence
  chemically synthesized
tgcagccatgagcaagtcactc

SEQ ID NO: 47295 - DNA, 22 bp, Artificial Sequence
  chemically synthesized
aacctctcggagcctcagatac

SEQ ID NO: 47296 - DNA, 22 bp, Artificial Sequence
  chemically synthesized
tcggagcctcagatacctctgc

SEQ ID NO: 47297 - DNA, 22 bp, Artificial Sequence
  chemically synthesized
ggagcctcagatacctctgctg

SEQ ID NO: 47298 - DNA, 22 bp, Artificial Sequence
  chemically synthesized
agatacctctgctgtattgtag

SEQ ID NO: 47299 - DNA, 22 bp, Artificial Sequence
  chemically synthesized
tgctgtattgtagagaccacag

SEQ ID NO: 47300 - DNA, 22 bp, Artificial Sequence
  chemically synthesized
ctgtattgtagagaccacagta

SEQ ID NO: 47301 - DNA, 22 bp, Artificial Sequence
  chemically synthesized
tattgtagagaccacagtacct

SEQ ID NO: 47302 - DNA, 22 bp, Artificial Sequence
  chemically synthesized
tagagaccacagtacctatgac

SEQ ID NO: 47303 - DNA, 22 bp, Artificial Sequence
  chemically synthesized
tgacataggcctgctgggaaag

SEQ ID NO: 47304 - DNA, 22 bp, Artificial Sequence
  chemically synthesized
ctgggaaagtcaagagtgacgg

SEQ ID NO: 47305 - DNA, 22 bp, Artificial Sequence
  chemically synthesized
ggaaagtcaagagtgacggtta

SEQ ID NO: 47306 - DNA, 22 bp, Artificial Sequence
  chemically synthesized
tataaatctcccatccagatgc

SEQ ID NO: 47307 - DNA, 22 bp, Artificial Sequence
  chemically synthesized
ccatccagatgctctacaaatg

SEQ ID NO: 47308 - DNA, 22 bp, Artificial Sequence
  chemically synthesized
tacaaatgcaggcagaagggat

SEQ ID NO: 47309 - DNA, 22 bp, Artificial Sequence
  chemically synthesized
caaatgcaggcagaagggatga

SEQ ID NO: 47310 - DNA, 22 bp, Artificial Sequence
  chemically synthesized
agtgagcaaaggcaacacttct

SEQ ID NO: 47311 - DNA, 22 bp, Artificial Sequence
  chemically synthesized
cttaaagagagagaaaagtcaa

SEQ ID NO: 47312 - DNA, 22 bp, Artificial Sequence
  chemically synthesized
ttaaagagagagaaaagtcaag

SEQ ID NO: 47313 - DNA, 22 bp, Artificial Sequence
  chemically synthesized
aaagagagagaaaagtcaaggc

SEQ ID NO: 47314 - DNA, 22 bp, Artificial Sequence
  chemically synthesized
aagagagagaaaagtcaaggcc

SEQ ID NO: 47315 - DNA, 22 bp, Artificial Sequence
  chemically synthesized
tcttagtccttttgtgttgcta

SEQ ID NO: 47316 - DNA, 22 bp, Artificial Sequence
  chemically synthesized
agtccttttgtgttgctatata

SEQ ID NO: 47317 - DNA, 22 bp, Artificial Sequence
  chemically synthesized
gtccttttgtgttgctatataa

SEQ ID NO: 47318 - DNA, 22 bp, Artificial Sequence
  chemically synthesized
ttgtgttgctatataaaggaat

SEQ ID NO: 47319 - DNA, 22 bp, Artificial Sequence
  chemically synthesized
tgtgttgctatataaaggaata

SEQ ID NO: 47320 - DNA, 22 bp, Artificial Sequence
  chemically synthesized
gtgttgctatataaaggaatac

SEQ ID NO: 47321 - DNA, 22 bp, Artificial Sequence
  chemically synthesized
tgttgctatataaaggaatacc

SEQ ID NO: 47322 - DNA, 22 bp, Artificial Sequence
  chemically synthesized
ctatataaaggaatacctgaag

SEQ ID NO: 47323 - DNA, 22 bp, Artificial Sequence
  chemically synthesized
tataaaggaatacctgaaggtg

SEQ ID NO: 47324 - DNA, 22 bp, Artificial Sequence
  chemically synthesized
aaggtgagtaatttacaaggaa

SEQ ID NO: 47325 - DNA, 22 bp, Artificial Sequence
  chemically synthesized
acaaggaaaagggatttattca

SEQ ID NO: 47326 - DNA, 22 bp, Artificial Sequence
  chemically synthesized
caaggaaaagggatttattcag

SEQ ID NO: 47327 - DNA, 22 bp, Artificial Sequence
  chemically synthesized
attcagctcatgattctgcaag

SEQ ID NO: 47328 - DNA, 22 bp, Artificial Sequence
  chemically synthesized
ttcagctcatgattctgcaagc

SEQ ID NO: 47329 - DNA, 22 bp, Artificial Sequence
  chemically synthesized
agctcatgattctgcaagctct

SEQ ID NO: 47330 - DNA, 22 bp, Artificial Sequence
  chemically synthesized
atgattctgcaagctctccagg

SEQ ID NO: 47331 - DNA, 22 bp, Artificial Sequence
  chemically synthesized
tgcaagctctccaggaagcatg

SEQ ID NO: 47332 - DNA, 22 bp, Artificial Sequence
  chemically synthesized
caagctctccaggaagcatggc

SEQ ID NO: 47333 - DNA, 22 bp, Artificial Sequence
  chemically synthesized
tccaggaagcatggcaccagca

SEQ ID NO: 47334 - DNA, 22 bp, Artificial Sequence
  chemically synthesized
caggaagcatggcaccagcatc

SEQ ID NO: 47335 - DNA, 22 bp, Artificial Sequence
  chemically synthesized
cttctggtgagggccttaagct

SEQ ID NO: 47336 - DNA, 22 bp, Artificial Sequence
  chemically synthesized
ctggtgagggccttaagctgct

SEQ ID NO: 47337 - DNA, 22 bp, Artificial Sequence
  chemically synthesized
tggtgagggccttaagctgctt

SEQ ID NO: 47338 - DNA, 22 bp, Artificial Sequence
  chemically synthesized
gtgagggccttaagctgctttc

SEQ ID NO: 47339 - DNA, 22 bp, Artificial Sequence
  chemically synthesized
aagctgctttcactgatggcag

SEQ ID NO: 47340 - DNA, 22 bp, Artificial Sequence
  chemically synthesized
agctgctttcactgatggcaga

SEQ ID NO: 47341 - DNA, 22 bp, Artificial Sequence
  chemically synthesized
ctttcactgatggcagaaggtg

SEQ ID NO: 47342 - DNA, 22 bp, Artificial Sequence
  chemically synthesized
tcactgatggcagaaggtgaag

SEQ ID NO: 47343 - DNA, 22 bp, Artificial Sequence
  chemically synthesized
cactgatggcagaaggtgaagg

SEQ ID NO: 47344 - DNA, 22 bp, Artificial Sequence
  chemically synthesized
actgatggcagaaggtgaaggg

SEQ ID NO: 47345 - DNA, 22 bp, Artificial Sequence
  chemically synthesized
atggcagaaggtgaaggggagc

SEQ ID NO: 47346 - DNA, 22 bp, Artificial Sequence
  chemically synthesized
catgtgcagagatcaatcacat

SEQ ID NO: 47347 - DNA, 22 bp, Artificial Sequence
  chemically synthesized
tttttaataatcagccttcaag

SEQ ID NO: 47348 - DNA, 22 bp, Artificial Sequence
  chemically synthesized
tttaataatcagccttcaaggg

SEQ ID NO: 47349 - DNA, 22 bp, Artificial Sequence
  chemically synthesized
ttaataatcagccttcaaggga

SEQ ID NO: 47350 - DNA, 22 bp, Artificial Sequence
  chemically synthesized
taataatcagccttcaagggaa

SEQ ID NO: 47351 - DNA, 22 bp, Artificial Sequence
  chemically synthesized
aataatcagccttcaagggaaa

SEQ ID NO: 47352 - DNA, 22 bp, Artificial Sequence
  chemically synthesized
ataatcagccttcaagggaaat

SEQ ID NO: 47353 - DNA, 22 bp, Artificial Sequence
  chemically synthesized
caagggaaatcatagcgggaga

SEQ ID NO: 47354 - DNA, 22 bp, Artificial Sequence
  chemically synthesized
aagggaaatcatagcgggagaa

SEQ ID NO: 47355 - DNA, 22 bp, Artificial Sequence
  chemically synthesized
actcattatcacaaggacggca

SEQ ID NO: 47356 - DNA, 22 bp, Artificial Sequence
  chemically synthesized
ctcattatcacaaggacggcac

SEQ ID NO: 47357 - DNA, 22 bp, Artificial Sequence
  chemically synthesized
attatcacaaggacggcaccaa

SEQ ID NO: 47358 - DNA, 22 bp, Artificial Sequence
  chemically synthesized
tcacaaggacggcaccaagcct

SEQ ID NO: 47359 - DNA, 22 bp, Artificial Sequence
  chemically synthesized
tcacaggggttcctcccccatg

SEQ ID NO: 47360 - DNA, 22 bp, Artificial Sequence
  chemically synthesized
cacaggggttcctcccccatga

SEQ ID NO: 47361 - DNA, 22 bp, Artificial Sequence
  chemically synthesized
acaggggttcctcccccatgac

SEQ ID NO: 47362 - DNA, 22 bp, Artificial Sequence
  chemically synthesized
ctcccccatgacccaaacacct

SEQ ID NO: 47363 - DNA, 22 bp, Artificial Sequence
  chemically synthesized
ccccatgacccaaacacctccc

SEQ ID NO: 47364 - DNA, 22 bp, Artificial Sequence
  chemically synthesized
ccattaggccccacttccaaca

SEQ ID NO: 47365 - DNA, 22 bp, Artificial Sequence
  chemically synthesized
ggccccacttccaacactgagg

SEQ ID NO: 47366 - DNA, 22 bp, Artificial Sequence
  chemically synthesized
ccaacactgaggaccaaatttc

SEQ ID NO: 47367 - DNA, 22 bp, Artificial Sequence
  chemically synthesized
caacactgaggaccaaatttcc

SEQ ID NO: 47368 - DNA, 22 bp, Artificial Sequence
  chemically synthesized
aggaccaaatttccacatgaga

SEQ ID NO: 47369 - DNA, 22 bp, Artificial Sequence
  chemically synthesized
ccacatgagatttggaggggac

SEQ ID NO: 47370 - DNA, 22 bp, Artificial Sequence
  chemically synthesized
cacatgagatttggaggggaca

SEQ ID NO: 47371 - DNA, 22 bp, Artificial Sequence
  chemically synthesized
ggaggggacaaacaaattatag

SEQ ID NO: 47372 - DNA, 22 bp, Artificial Sequence
  chemically synthesized
gaggggacaaacaaattatagc

SEQ ID NO: 47373 - DNA, 22 bp, Artificial Sequence
  chemically synthesized
tagcagccactatctatggtga

SEQ ID NO: 47374 - DNA, 22 bp, Artificial Sequence
  chemically synthesized
tctatggtgatttgtttggttt

SEQ ID NO: 47375 - DNA, 22 bp, Artificial Sequence
  chemically synthesized
tggtgatttgtttggtttttag

SEQ ID NO: 47376 - DNA, 22 bp, Artificial Sequence
  chemically synthesized
gtttggtttttagctcttgtct

SEQ ID NO: 47377 - DNA, 22 bp, Artificial Sequence
  chemically synthesized
tttggtttttagctcttgtctg

SEQ ID NO: 47378 - DNA, 22 bp, Artificial Sequence
  chemically synthesized
ggtttttagctcttgtctgctc

SEQ ID NO: 47379 - DNA, 22 bp, Artificial Sequence
  chemically synthesized
gtttttagctcttgtctgctcc

SEQ ID NO: 47380 - DNA, 22 bp, Artificial Sequence
  chemically synthesized
ttagctcttgtctgctccaact

SEQ ID NO: 47381 - DNA, 22 bp, Artificial Sequence
  chemically synthesized
tagctcttgtctgctccaactg

SEQ ID NO: 47382 - DNA, 22 bp, Artificial Sequence
  chemically synthesized
agctcttgtctgctccaactgc

SEQ ID NO: 47383 - DNA, 22 bp, Artificial Sequence
  chemically synthesized
gctcttgtctgctccaactgct

SEQ ID NO: 47384 - DNA, 22 bp, Artificial Sequence
  chemically synthesized
ttgtctgctccaactgctctca

SEQ ID NO: 47385 - DNA, 22 bp, Artificial Sequence
  chemically synthesized
gtctgctccaactgctctcagg

SEQ ID NO: 47386 - DNA, 22 bp, Artificial Sequence
  chemically synthesized
tctgctccaactgctctcaggc

SEQ ID NO: 47387 - DNA, 22 bp, Artificial Sequence
  chemically synthesized
ctccaactgctctcaggcagac

SEQ ID NO: 47388 - DNA, 22 bp, Artificial Sequence
  chemically synthesized
caactgctctcaggcagacata

SEQ ID NO: 47389 - DNA, 22 bp, Artificial Sequence
  chemically synthesized
ctctcaggcagacatacctgct

SEQ ID NO: 47390 - DNA, 22 bp, Artificial Sequence
  chemically synthesized
tcaggcagacatacctgcttaa

SEQ ID NO: 47391 - DNA, 22 bp, Artificial Sequence
  chemically synthesized
aggcagacatacctgcttaaga

SEQ ID NO: 47392 - DNA, 22 bp, Artificial Sequence
  chemically synthesized
cttaagaaccttcactggctcc

SEQ ID NO: 47393 - DNA, 22 bp, Artificial Sequence
  chemically synthesized
aagaaccttcactggctcccca

SEQ ID NO: 47394 - DNA, 22 bp, Artificial Sequence
  chemically synthesized
agaaccttcactggctccccac

SEQ ID NO: 47395 - DNA, 22 bp, Artificial Sequence
  chemically synthesized
cactggctccccacagcctcat

SEQ ID NO: 47396 - DNA, 22 bp, Artificial Sequence
  chemically synthesized
actggctccccacagcctcatg

SEQ ID NO: 47397 - DNA, 22 bp, Artificial Sequence
  chemically synthesized
gctccccacagcctcatgaatc

SEQ ID NO: 47398 - DNA, 22 bp, Artificial Sequence
  chemically synthesized
cccacagcctcatgaatcaagt

SEQ ID NO: 47399 - DNA, 22 bp, Artificial Sequence
  chemically synthesized
atgaatcaagtccaaactccat

SEQ ID NO: 47400 - DNA, 22 bp, Artificial Sequence
  chemically synthesized
catgctcctccttggcccctac

SEQ ID NO: 47401 - DNA, 22 bp, Artificial Sequence
  chemically synthesized
ctccttggcccctacctcaacc

SEQ ID NO: 47402 - DNA, 22 bp, Artificial Sequence
  chemically synthesized
cttggcccctacctcaacctac

SEQ ID NO: 47403 - DNA, 22 bp, Artificial Sequence
  chemically synthesized
ggcccctacctcaacctacctt

SEQ ID NO: 47404 - DNA, 22 bp, Artificial Sequence
  chemically synthesized
gcccctacctcaacctaccttg

SEQ ID NO: 47405 - DNA, 22 bp, Artificial Sequence
  chemically synthesized
cctcaacctaccttgcagcccc

SEQ ID NO: 47406 - DNA, 22 bp, Artificial Sequence
  chemically synthesized
aacctaccttgcagccccatca

SEQ ID NO: 47407 - DNA, 22 bp, Artificial Sequence
  chemically synthesized
ccttgcagccccatcacccata

SEQ ID NO: 47408 - DNA, 22 bp, Artificial Sequence
  chemically synthesized
gcagccccatcacccatatctc

SEQ ID NO: 47409 - DNA, 22 bp, Artificial Sequence
  chemically synthesized
cagccccatcacccatatctct

SEQ ID NO: 47410 - DNA, 22 bp, Artificial Sequence
  chemically synthesized
tgtatatatgcatcttggactc

SEQ ID NO: 47411 - DNA, 22 bp, Artificial Sequence
  chemically synthesized
tatatatgcatcttggactcca

SEQ ID NO: 47412 - DNA, 22 bp, Artificial Sequence
  chemically synthesized
ggactccagtcagagtagaaca

SEQ ID NO: 47413 - DNA, 22 bp, Artificial Sequence
  chemically synthesized
gactccagtcagagtagaacag

SEQ ID NO: 47414 - DNA, 22 bp, Artificial Sequence
  chemically synthesized
cagtcagagtagaacagagtcc

SEQ ID NO: 47415 - DNA, 22 bp, Artificial Sequence
  chemically synthesized
tacccaaagccttagggccaaa

SEQ ID NO: 47416 - DNA, 22 bp, Artificial Sequence
  chemically synthesized
acccaaagccttagggccaaaa

SEQ ID NO: 47417 - DNA, 22 bp, Artificial Sequence
  chemically synthesized
cccaaagccttagggccaaaac

SEQ ID NO: 47418 - DNA, 22 bp, Artificial Sequence
  chemically synthesized
agggccaaaacggttttgaacc

SEQ ID NO: 47419 - DNA, 22 bp, Artificial Sequence
  chemically synthesized
gggccaaaacggttttgaacct

SEQ ID NO: 47420 - DNA, 22 bp, Artificial Sequence
  chemically synthesized
tgaacctcagaacttgtttgga

SEQ ID NO: 47421 - DNA, 22 bp, Artificial Sequence
  chemically synthesized
gaacctcagaacttgtttggat

SEQ ID NO: 47422 - DNA, 22 bp, Artificial Sequence
  chemically synthesized
aacctcagaacttgtttggatt

SEQ ID NO: 47423 - DNA, 22 bp, Artificial Sequence
  chemically synthesized
agaacttgtttggattttagaa

SEQ ID NO: 47424 - DNA, 22 bp, Artificial Sequence
  chemically synthesized
gtttggattttagaaaggcagt

SEQ ID NO: 47425 - DNA, 22 bp, Artificial Sequence
  chemically synthesized
tttggattttagaaaggcagta

SEQ ID NO: 47426 - DNA, 22 bp, Artificial Sequence
  chemically synthesized
ggattttagaaaggcagtaatg

SEQ ID NO: 47427 - DNA, 22 bp, Artificial Sequence
  chemically synthesized
gattttagaaaggcagtaatgg

SEQ ID NO: 47428 - DNA, 22 bp, Artificial Sequence
  chemically synthesized
tagaaaggcagtaatgggcaat

SEQ ID NO: 47429 - DNA, 22 bp, Artificial Sequence
  chemically synthesized
agaaaggcagtaatgggcaatc

SEQ ID NO: 47430 - DNA, 22 bp, Artificial Sequence
  chemically synthesized
gaaaggcagtaatgggcaatca

SEQ ID NO: 47431 - DNA, 22 bp, Artificial Sequence
  chemically synthesized
cttggaagaatctggagctgca

SEQ ID NO: 47432 - DNA, 22 bp, Artificial Sequence
  chemically synthesized
ggaagaatctggagctgcatac

SEQ ID NO: 47433 - DNA, 22 bp, Artificial Sequence
  chemically synthesized
gaagaatctggagctgcatact

SEQ ID NO: 47434 - DNA, 22 bp, Artificial Sequence
  chemically synthesized
gagctgcatactgtaatctatg

SEQ ID NO: 47435 - DNA, 22 bp, Artificial Sequence
  chemically synthesized
catactgtaatctatgcagcaa

SEQ ID NO: 47436 - DNA, 22 bp, Artificial Sequence
  chemically synthesized
taatctatgcagcaaaatatat

SEQ ID NO: 47437 - DNA, 22 bp, Artificial Sequence
  chemically synthesized
tgcagcaaaatatatgaatatg

SEQ ID NO: 47438 - DNA, 22 bp, Artificial Sequence
  chemically synthesized
acacaactaaattaaaaataat

SEQ ID NO: 47439 - DNA, 22 bp, Artificial Sequence
  chemically synthesized
aattaaaaataatctcatgtca

SEQ ID NO: 47440 - DNA, 22 bp, Artificial Sequence
  chemically synthesized
aaaataatctcatgtcagttca

SEQ ID NO: 47441 - DNA, 22 bp, Artificial Sequence
  chemically synthesized
atgtcagttcacgtcaggtgct

SEQ ID NO: 47442 - DNA, 22 bp, Artificial Sequence
  chemically synthesized
acgtcaggtgctaccatcaaat

SEQ ID NO: 47443 - DNA, 22 bp, Artificial Sequence
  chemically synthesized
ccatcaaataaatcacaaaaaa

SEQ ID NO: 47444 - DNA, 22 bp, Artificial Sequence
  chemically synthesized
ttggttttcgtaacattttaca

SEQ ID NO: 47445 - DNA, 22 bp, Artificial Sequence
  chemically synthesized
tggttttcgtaacattttacat

SEQ ID NO: 47446 - DNA, 22 bp, Artificial Sequence
  chemically synthesized
ggttttcgtaacattttacatt

SEQ ID NO: 47447 - DNA, 22 bp, Artificial Sequence
  chemically synthesized
gttttcgtaacattttacattt

SEQ ID NO: 47448 - DNA, 22 bp, Artificial Sequence
  chemically synthesized
tcgtaacattttacatttcaga

SEQ ID NO: 47449 - DNA, 22 bp, Artificial Sequence
  chemically synthesized
cgtaacattttacatttcagac

SEQ ID NO: 47450 - DNA, 22 bp, Artificial Sequence
  chemically synthesized
gtaacattttacatttcagacg

SEQ ID NO: 47451 - DNA, 22 bp, Artificial Sequence
  chemically synthesized
tacatttcagacggtggataaa

SEQ ID NO: 47452 - DNA, 22 bp, Artificial Sequence
  chemically synthesized
acatttcagacggtggataaag

SEQ ID NO: 47453 - DNA, 22 bp, Artificial Sequence
  chemically synthesized
catttcagacggtggataaaga

SEQ ID NO: 47454 - DNA, 22 bp, Artificial Sequence
  chemically synthesized
cagacggtggataaagaactgt

SEQ ID NO: 47455 - DNA, 22 bp, Artificial Sequence
  chemically synthesized
agacggtggataaagaactgtg

SEQ ID NO: 47456 - DNA, 22 bp, Artificial Sequence
  chemically synthesized
tggaggccaggcgtggtggctc

SEQ ID NO: 47457 - DNA, 22 bp, Artificial Sequence
  chemically synthesized
acacctgtaattcgagcacttt

SEQ ID NO: 47458 - DNA, 22 bp, Artificial Sequence
  chemically synthesized
taattcgagcactttgggaggc

SEQ ID NO: 47459 - DNA, 22 bp, Artificial Sequence
  chemically synthesized
gagcactttgggaggctgaggc

SEQ ID NO: 47460 - DNA, 22 bp, Artificial Sequence
  chemically synthesized
tgggaggctgaggcgggaggat

SEQ ID NO: 47461 - DNA, 22 bp, Artificial Sequence
  chemically synthesized
gggaggctgaggcgggaggatc

SEQ ID NO: 47462 - DNA, 22 bp, Artificial Sequence
  chemically synthesized
ggaggctgaggcgggaggatca

SEQ ID NO: 47463 - DNA, 22 bp, Artificial Sequence
  chemically synthesized
aggcgggaggatcacctcctcg

SEQ ID NO: 47464 - DNA, 22 bp, Artificial Sequence
  chemically synthesized
ctcggatccactgaggaggtca

SEQ ID NO: 47465 - DNA, 22 bp, Artificial Sequence
  chemically synthesized
ggatccactgaggaggtcagga

SEQ ID NO: 47466 - DNA, 22 bp, Artificial Sequence
  chemically synthesized
aggaggtcaggagtttgcgact

SEQ ID NO: 47467 - DNA, 22 bp, Artificial Sequence
  chemically synthesized
gcgactagcctggccaacgtgg

SEQ ID NO: 47468 - DNA, 22 bp, Artificial Sequence
  chemically synthesized
cgactagcctggccaacgtggt

SEQ ID NO: 47469 - DNA, 22 bp, Artificial Sequence
  chemically synthesized
gcctggccaacgtggtgaaacc

SEQ ID NO: 47470 - DNA, 22 bp, Artificial Sequence
  chemically synthesized
gccaacgtggtgaaaccccttc

SEQ ID NO: 47471 - DNA, 22 bp, Artificial Sequence
  chemically synthesized
ctctactaaaaatacaaaaatt

SEQ ID NO: 47472 - DNA, 22 bp, Artificial Sequence
  chemically synthesized
tctactaaaaatacaaaaatta

SEQ ID NO: 47473 - DNA, 22 bp, Artificial Sequence
  chemically synthesized
tactaaaaatacaaaaattagc

SEQ ID NO: 47474 - DNA, 22 bp, Artificial Sequence
  chemically synthesized
ctaaaaatacaaaaattagccg

SEQ ID NO: 47475 - DNA, 22 bp, Artificial Sequence
  chemically synthesized
aaaatacaaaaattagccgggc

SEQ ID NO: 47476 - DNA, 22 bp, Artificial Sequence
  chemically synthesized
gccgggcgtggtggcaggtacc

SEQ ID NO: 47477 - DNA, 22 bp, Artificial Sequence
  chemically synthesized
taatcccagcttcttgggaggc

SEQ ID NO: 47478 - DNA, 22 bp, Artificial Sequence
  chemically synthesized
cttgggaggctgaggcaggaga

SEQ ID NO: 47479 - DNA, 22 bp, Artificial Sequence
  chemically synthesized
ttgggaggctgaggcaggagaa

SEQ ID NO: 47480 - DNA, 22 bp, Artificial Sequence
  chemically synthesized
gggaggctgaggcaggagaacc

SEQ ID NO: 47481 - DNA, 22 bp, Artificial Sequence
  chemically synthesized
ggaggctgaggcaggagaacca

SEQ ID NO: 47482 - DNA, 22 bp, Artificial Sequence
  chemically synthesized
aggcaggagaaccacttgaacc

SEQ ID NO: 47483 - DNA, 22 bp, Artificial Sequence
  chemically synthesized
gaacccgggagacagatgttgc

SEQ ID NO: 47484 - DNA, 22 bp, Artificial Sequence
  chemically synthesized
aacccgggagacagatgttgca

SEQ ID NO: 47485 - DNA, 22 bp, Artificial Sequence
  chemically synthesized
cagtgagctgagactgcaccat

SEQ ID NO: 47486 - DNA, 22 bp, Artificial Sequence
  chemically synthesized
agactgcaccattgcactccag

SEQ ID NO: 47487 - DNA, 22 bp, Artificial Sequence
  chemically synthesized
caccattgcactccagcctggg

SEQ ID NO: 47488 - DNA, 22 bp, Artificial Sequence
  chemically synthesized
cactccagcctgggcaacaaga

SEQ ID NO: 47489 - DNA, 22 bp, Artificial Sequence
  chemically synthesized
cagcctgggcaacaagagcgaa

SEQ ID NO: 47490 - DNA, 22 bp, Artificial Sequence
  chemically synthesized
ggcaacaagagcgaaactccat

SEQ ID NO: 47491 - DNA, 22 bp, Artificial Sequence
  chemically synthesized
catctcaaaaaaaaaagaaaaa

SEQ ID NO: 47492 - DNA, 22 bp, Artificial Sequence
  chemically synthesized
aaaaaaaaaagaaaaagaactg

SEQ ID NO: 47493 - DNA, 22 bp, Artificial Sequence
  chemically synthesized
tggacatgtgctccttatcttc

SEQ ID NO: 47494 - DNA, 22 bp, Artificial Sequence
  chemically synthesized
cttatcttccacctctggtttt

SEQ ID NO: 47495 - DNA, 22 bp, Artificial Sequence
  chemically synthesized
atcttccacctctggttttccc

SEQ ID NO: 47496 - DNA, 22 bp, Artificial Sequence
  chemically synthesized
tcttccacctctggttttccca

SEQ ID NO: 47497 - DNA, 22 bp, Artificial Sequence
  chemically synthesized
ccacctctggttttcccagctc

SEQ ID NO: 47498 - DNA, 22 bp, Artificial Sequence
  chemically synthesized
cacctctggttttcccagctct

SEQ ID NO: 47499 - DNA, 22 bp, Artificial Sequence
  chemically synthesized
tggttttcccagctctgtatct

SEQ ID NO: 47500 - DNA, 22 bp, Artificial Sequence
  chemically synthesized
gttttcccagctctgtatcttt

SEQ ID NO: 47501 - DNA, 22 bp, Artificial Sequence
  chemically synthesized
tcccagctctgtatctttgttc

SEQ ID NO: 47502 - DNA, 22 bp, Artificial Sequence
  chemically synthesized
cccagctctgtatctttgttca

SEQ ID NO: 47503 - DNA, 22 bp, Artificial Sequence
  chemically synthesized
ccagctctgtatctttgttcat

SEQ ID NO: 47504 - DNA, 22 bp, Artificial Sequence
  chemically synthesized
tgtatctttgttcatggtacct

SEQ ID NO: 47505 - DNA, 22 bp, Artificial Sequence
  chemically synthesized
tatctttgttcatggtacctcc

SEQ ID NO: 47506 - DNA, 22 bp, Artificial Sequence
  chemically synthesized
tgttcatggtacctcctaatcc

SEQ ID NO: 47507 - DNA, 22 bp, Artificial Sequence
  chemically synthesized
gttcatggtacctcctaatcct

SEQ ID NO: 47508 - DNA, 22 bp, Artificial Sequence
  chemically synthesized
ttcatggtacctcctaatccta

SEQ ID NO: 47509 - DNA, 22 bp, Artificial Sequence
  chemically synthesized
atggtacctcctaatcctagaa

SEQ ID NO: 47510 - DNA, 22 bp, Artificial Sequence
  chemically synthesized
ctaatcctagaataaaattctc

SEQ ID NO: 47511 - DNA, 22 bp, Artificial Sequence
  chemically synthesized
atcctagaataaaattctcatg

SEQ ID NO: 47512 - DNA, 22 bp, Artificial Sequence
  chemically synthesized
gaataaaattctcatgacacca

SEQ ID NO: 47513 - DNA, 22 bp, Artificial Sequence
  chemically synthesized
tcatgacaccatcatcgctgaa

SEQ ID NO: 47514 - DNA, 22 bp, Artificial Sequence
  chemically synthesized
atgacaccatcatcgctgaact

SEQ ID NO: 47515 - DNA, 22 bp, Artificial Sequence
  chemically synthesized
aactcctactaatgcttcaaag

SEQ ID NO: 47516 - DNA, 22 bp, Artificial Sequence
  chemically synthesized
ctactaatgcttcaaagaccca

SEQ ID NO: 47517 - DNA, 22 bp, Artificial Sequence
  chemically synthesized
ctaatgcttcaaagacccatct

SEQ ID NO: 47518 - DNA, 22 bp, Artificial Sequence
  chemically synthesized
atgcttcaaagacccatctgaa

SEQ ID NO: 47519 - DNA, 22 bp, Artificial Sequence
  chemically synthesized
caaagacccatctgaaaatgcc

SEQ ID NO: 47520 - DNA, 22 bp, Artificial Sequence
  chemically synthesized
aaagacccatctgaaaatgcct

SEQ ID NO: 47521 - DNA, 22 bp, Artificial Sequence
  chemically synthesized
aaaatgccttccgctaaataaa

SEQ ID NO: 47522 - DNA, 22 bp, Artificial Sequence
  chemically synthesized
ccgctaaataaaaattgaatga

SEQ ID NO: 47523 - DNA, 22 bp, Artificial Sequence
  chemically synthesized
cgctaaataaaaattgaatgaa

SEQ ID NO: 47524 - DNA, 22 bp, Artificial Sequence
  chemically synthesized
aataaaaattgaatgaattggg

SEQ ID NO: 47525 - DNA, 22 bp, Artificial Sequence
  chemically synthesized
aatgaattgggagagtactctg

SEQ ID NO: 47526 - DNA, 22 bp, Artificial Sequence
  chemically synthesized
ggagagtactctgtgcagtgga

SEQ ID NO: 47527 - DNA, 22 bp, Artificial Sequence
  chemically synthesized
tgtgcagtggagtgtcagttct

SEQ ID NO: 47528 - DNA, 22 bp, Artificial Sequence
  chemically synthesized
tgcagtggagtgtcagttctgg

SEQ ID NO: 47529 - DNA, 22 bp, Artificial Sequence
  chemically synthesized
tggaaacccagttctaatgcac

SEQ ID NO: 47530 - DNA, 22 bp, Artificial Sequence
  chemically synthesized
gaaacccagttctaatgcacct

SEQ ID NO: 47531 - DNA, 22 bp, Artificial Sequence
  chemically synthesized
taatgcacctggggtgacctcc

SEQ ID NO: 47532 - DNA, 22 bp, Artificial Sequence
  chemically synthesized
atgcacctggggtgacctcctc

SEQ ID NO: 47533 - DNA, 22 bp, Artificial Sequence
  chemically synthesized
gggtgacctcctctctctgggc

SEQ ID NO: 47534 - DNA, 22 bp, Artificial Sequence
  chemically synthesized
ctctctctgggcctcagtttct

SEQ ID NO: 47535 - DNA, 22 bp, Artificial Sequence
  chemically synthesized
tctctgggcctcagtttctcat

SEQ ID NO: 47536 - DNA, 22 bp, Artificial Sequence
  chemically synthesized
tctgggcctcagtttctcatga

SEQ ID NO: 47537 - DNA, 22 bp, Artificial Sequence
  chemically synthesized
tgggcctcagtttctcatgact

SEQ ID NO: 47538 - DNA, 22 bp, Artificial Sequence
  chemically synthesized
ggcctcagtttctcatgactaa

SEQ ID NO: 47539 - DNA, 22 bp, Artificial Sequence
  chemically synthesized
agtttctcatgactaaaagaaa

SEQ ID NO: 47540 - DNA, 22 bp, Artificial Sequence
  chemically synthesized
ctcatgactaaaagaaaaggat

SEQ ID NO: 47541 - DNA, 22 bp, Artificial Sequence
  chemically synthesized
tcatgactaaaagaaaaggatt

SEQ ID NO: 47542 - DNA, 22 bp, Artificial Sequence
  chemically synthesized
atgactaaaagaaaaggattgg

SEQ ID NO: 47543 - DNA, 22 bp, Artificial Sequence
  chemically synthesized
aaagaaaaggattggtctaaaa

SEQ ID NO: 47544 - DNA, 22 bp, Artificial Sequence
  chemically synthesized
gtctaaaaattattttctgctt

SEQ ID NO: 47545 - DNA, 22 bp, Artificial Sequence
  chemically synthesized
aaaattattttctgcttgccaa

SEQ ID NO: 47546 - DNA, 22 bp, Artificial Sequence
  chemically synthesized
ttttctgcttgccaaaaaatat

SEQ ID NO: 47547 - DNA, 22 bp, Artificial Sequence
  chemically synthesized
tctgcttgccaaaaaatatttt

SEQ ID NO: 47548 - DNA, 22 bp, Artificial Sequence
  chemically synthesized
ctgcttgccaaaaaatattttc

SEQ ID NO: 47549 - DNA, 22 bp, Artificial Sequence
  chemically synthesized
tgcttgccaaaaaatattttca

SEQ ID NO: 47550 - DNA, 22 bp, Artificial Sequence
  chemically synthesized
cttgccaaaaaatattttcatt

SEQ ID NO: 47551 - DNA, 22 bp, Artificial Sequence
  chemically synthesized
gccaaaaaatattttcattcta

SEQ ID NO: 47552 - DNA, 22 bp, Artificial Sequence
  chemically synthesized
ccaaaaaatattttcattctaa

SEQ ID NO: 47553 - DNA, 22 bp, Artificial Sequence
  chemically synthesized
tcattctaaattcgattcccac

SEQ ID NO: 47554 - DNA, 22 bp, Artificial Sequence
  chemically synthesized
cattctaaattcgattcccaca

SEQ ID NO: 47555 - DNA, 22 bp, Artificial Sequence
  chemically synthesized
attctaaattcgattcccacaa

SEQ ID NO: 47556 - DNA, 22 bp, Artificial Sequence
  chemically synthesized
taaattcgattcccacaaaata

SEQ ID NO: 47557 - DNA, 22 bp, Artificial Sequence
  chemically synthesized
aattcgattcccacaaaataac

SEQ ID NO: 47558 - DNA, 22 bp, Artificial Sequence
  chemically synthesized
gattcccacaaaataaccattg

SEQ ID NO: 47559 - DNA, 22 bp, Artificial Sequence
  chemically synthesized
ccacaaaataaccattgaatga

SEQ ID NO: 47560 - DNA, 22 bp, Artificial Sequence
  chemically synthesized
aatgaatgaataaatgaacttg

SEQ ID NO: 47561 - DNA, 22 bp, Artificial Sequence
  chemically synthesized
gaggaggctcctgttccaaact

SEQ ID NO: 47562 - DNA, 22 bp, Artificial Sequence
  chemically synthesized
aggaggctcctgttccaaactt

SEQ ID NO: 47563 - DNA, 22 bp, Artificial Sequence
  chemically synthesized
ctgttccaaacttccaccagag

SEQ ID NO: 47564 - DNA, 22 bp, Artificial Sequence
  chemically synthesized
ttccaaacttccaccagagaag

SEQ ID NO: 47565 - DNA, 22 bp, Artificial Sequence
  chemically synthesized
caaacttccaccagagaagaaa

SEQ ID NO: 47566 - DNA, 22 bp, Artificial Sequence
  chemically synthesized
ccaccagagaagaaacatcctc

SEQ ID NO: 47567 - DNA, 22 bp, Artificial Sequence
  chemically synthesized
caccagagaagaaacatcctca

SEQ ID NO: 47568 - DNA, 22 bp, Artificial Sequence
  chemically synthesized
aagggcttggttcaggtggtca

SEQ ID NO: 47569 - DNA, 22 bp, Artificial Sequence
  chemically synthesized
ggttcaggtggtcatacagcct

SEQ ID NO: 47570 - DNA, 22 bp, Artificial Sequence
  chemically synthesized
gttcaggtggtcatacagcctc

SEQ ID NO: 47571 - DNA, 22 bp, Artificial Sequence
  chemically synthesized
aggtggtcatacagcctctgct

SEQ ID NO: 47572 - DNA, 22 bp, Artificial Sequence
  chemically synthesized
tgcttactcacctctcaggatg

SEQ ID NO: 47573 - DNA, 22 bp, Artificial Sequence
  chemically synthesized
cttactcacctctcaggatggg

SEQ ID NO: 47574 - DNA, 22 bp, Artificial Sequence
  chemically synthesized
actcacctctcaggatggggta

SEQ ID NO: 47575 - DNA, 22 bp, Artificial Sequence
  chemically synthesized
ctcacctctcaggatggggtac

SEQ ID NO: 47576 - DNA, 22 bp, Artificial Sequence
  chemically synthesized
acctctcaggatggggtactca

SEQ ID NO: 47577 - DNA, 22 bp, Artificial Sequence
  chemically synthesized
tcaggatggggtactcactatt

SEQ ID NO: 47578 - DNA, 22 bp, Artificial Sequence
  chemically synthesized
aggatggggtactcactatttc

SEQ ID NO: 47579 - DNA, 22 bp, Artificial Sequence
  chemically synthesized
actatttccagaacagttgttt

SEQ ID NO: 47580 - DNA, 22 bp, Artificial Sequence
  chemically synthesized
tttccagaacagttgttttgga

SEQ ID NO: 47581 - DNA, 22 bp, Artificial Sequence
  chemically synthesized
ccagaacagttgttttggagca

SEQ ID NO: 47582 - DNA, 22 bp, Artificial Sequence
  chemically synthesized
cagaacagttgttttggagcag

SEQ ID NO: 47583 - DNA, 22 bp, Artificial Sequence
  chemically synthesized
ttttggagcagtggtaacttga

SEQ ID NO: 47584 - DNA, 22 bp, Artificial Sequence
  chemically synthesized
tggagcagtggtaacttgaaat

SEQ ID NO: 47585 - DNA, 22 bp, Artificial Sequence
  chemically synthesized
ggagcagtggtaacttgaaatg

SEQ ID NO: 47586 - DNA, 22 bp, Artificial Sequence
  chemically synthesized
gagcagtggtaacttgaaatgc

SEQ ID NO: 47587 - DNA, 22 bp, Artificial Sequence
  chemically synthesized
gaaatgccctttcttatcctgg

SEQ ID NO: 47588 - DNA, 22 bp, Artificial Sequence
  chemically synthesized
aaatgccctttcttatcctggc

SEQ ID NO: 47589 - DNA, 22 bp, Artificial Sequence
  chemically synthesized
tcttatcctggccacaacccca

SEQ ID NO: 47590 - DNA, 22 bp, Artificial Sequence
  chemically synthesized
cttatcctggccacaaccccac

SEQ ID NO: 47591 - DNA, 22 bp, Artificial Sequence
  chemically synthesized
ttatcctggccacaaccccaca

SEQ ID NO: 47592 - DNA, 22 bp, Artificial Sequence
  chemically synthesized
atcctggccacaaccccacaac

SEQ ID NO: 47593 - DNA, 22 bp, Artificial Sequence
  chemically synthesized
tcctggccacaaccccacaaca

SEQ ID NO: 47594 - DNA, 22 bp, Artificial Sequence
  chemically synthesized
gccacaaccccacaacatccct

SEQ ID NO: 47595 - DNA, 22 bp, Artificial Sequence
  chemically synthesized
gagaaagtcaaaggctcaggga

SEQ ID NO: 47596 - DNA, 22 bp, Artificial Sequence
  chemically synthesized
agggaacaaggaagagggctat

SEQ ID NO: 47597 - DNA, 22 bp, Artificial Sequence
  chemically synthesized
tactgagctgagtaaggacttg

SEQ ID NO: 47598 - DNA, 22 bp, Artificial Sequence
  chemically synthesized
agctgagtaaggacttgccatc

SEQ ID NO: 47599 - DNA, 22 bp, Artificial Sequence
  chemically synthesized
agtaaggacttgccatcctgcc

SEQ ID NO: 47600 - DNA, 22 bp, Artificial Sequence
  chemically synthesized
gccatcctgccacccagcacac

SEQ ID NO: 47601 - DNA, 22 bp, Artificial Sequence
  chemically synthesized
ccatcctgccacccagcacact

SEQ ID NO: 47602 - DNA, 22 bp, Artificial Sequence
  chemically synthesized
ccacccagcacactcagacaga

SEQ ID NO: 47603 - DNA, 22 bp, Artificial Sequence
  chemically synthesized
agacagaagcgtgggcaggcag

SEQ ID NO: 47604 - DNA, 22 bp, Artificial Sequence
  chemically synthesized
tgagtggcagaattttcccctc

SEQ ID NO: 47605 - DNA, 22 bp, Artificial Sequence
  chemically synthesized
tcccctctgccccaggagctgt

SEQ ID NO: 47606 - DNA, 22 bp, Artificial Sequence
  chemically synthesized
cccctctgccccaggagctgtg

SEQ ID NO: 47607 - DNA, 22 bp, Artificial Sequence
  chemically synthesized
ccctctgccccaggagctgtgg

SEQ ID NO: 47608 - DNA, 22 bp, Artificial Sequence
  chemically synthesized
tgccccaggagctgtggtttgg

SEQ ID NO: 47609 - DNA, 22 bp, Artificial Sequence
  chemically synthesized
ccccaggagctgtggtttggag

SEQ ID NO: 47610 - DNA, 22 bp, Artificial Sequence
  chemically synthesized
tggtttggagcaaagacaatgt

SEQ ID NO: 47611 - DNA, 22 bp, Artificial Sequence
  chemically synthesized
ggagcaaagacaatgtcaccaa

SEQ ID NO: 47612 - DNA, 22 bp, Artificial Sequence
  chemically synthesized
gagcaaagacaatgtcaccaac

SEQ ID NO: 47613 - DNA, 22 bp, Artificial Sequence
  chemically synthesized
cagacagggacaaaactgcaag

SEQ ID NO: 47614 - DNA, 22 bp, Artificial Sequence
  chemically synthesized
caagtgatccccccggggcttg

SEQ ID NO: 47615 - DNA, 22 bp, Artificial Sequence
  chemically synthesized
gcattgtaagttcactcatggt

SEQ ID NO: 47616 - DNA, 22 bp, Artificial Sequence
  chemically synthesized
cattgtaagttcactcatggtc

SEQ ID NO: 47617 - DNA, 22 bp, Artificial Sequence
  chemically synthesized
taagttcactcatggtcaacag

SEQ ID NO: 47618 - DNA, 22 bp, Artificial Sequence
  chemically synthesized
actcatggtcaacagaactttc

SEQ ID NO: 47619 - DNA, 22 bp, Artificial Sequence
  chemically synthesized
atggtcaacagaactttccctt

SEQ ID NO: 47620 - DNA, 22 bp, Artificial Sequence
  chemically synthesized
tcccttcatctccccatctgct

SEQ ID NO: 47621 - DNA, 22 bp, Artificial Sequence
  chemically synthesized
cccttcatctccccatctgctg

SEQ ID NO: 47622 - DNA, 22 bp, Artificial Sequence
  chemically synthesized
ccttcatctccccatctgctgc

SEQ ID NO: 47623 - DNA, 22 bp, Artificial Sequence
  chemically synthesized
catctccccatctgctgccact

SEQ ID NO: 47624 - DNA, 22 bp, Artificial Sequence
  chemically synthesized
atctccccatctgctgccactg

SEQ ID NO: 47625 - DNA, 22 bp, Artificial Sequence
  chemically synthesized
cccatctgctgccactgagccg

SEQ ID NO: 47626 - DNA, 22 bp, Artificial Sequence
  chemically synthesized
ctgccactgagccgtagggacg

SEQ ID NO: 47627 - DNA, 22 bp, Artificial Sequence
  chemically synthesized
ccactgagccgtagggacgatt

SEQ ID NO: 47628 - DNA, 22 bp, Artificial Sequence
  chemically synthesized
agccgtagggacgattgtcacc

SEQ ID NO: 47629 - DNA, 22 bp, Artificial Sequence
  chemically synthesized
tcacctcccttttaaagattag

SEQ ID NO: 47630 - DNA, 22 bp, Artificial Sequence
  chemically synthesized
ccttttaaagattaggcaatgg

SEQ ID NO: 47631 - DNA, 22 bp, Artificial Sequence
  chemically synthesized
ttaaagattaggcaatggaggc

SEQ ID NO: 47632 - DNA, 22 bp, Artificial Sequence
  chemically synthesized
taaagattaggcaatggaggct

SEQ ID NO: 47633 - DNA, 22 bp, Artificial Sequence
  chemically synthesized
aaagattaggcaatggaggctc

SEQ ID NO: 47634 - DNA, 22 bp, Artificial Sequence
  chemically synthesized
aagattaggcaatggaggctca

SEQ ID NO: 47635 - DNA, 22 bp, Artificial Sequence
  chemically synthesized
ggcaatggaggctcaaggataa

SEQ ID NO: 47636 - DNA, 22 bp, Artificial Sequence
  chemically synthesized
aaggataagtgacttgtcaagc

SEQ ID NO: 47637 - DNA, 22 bp, Artificial Sequence
  chemically synthesized
gtcaagcaccacagctagtgag

SEQ ID NO: 47638 - DNA, 22 bp, Artificial Sequence
  chemically synthesized
tcaagcaccacagctagtgaga

SEQ ID NO: 47639 - DNA, 22 bp, Artificial Sequence
  chemically synthesized
gtgagaggaagccaagattcaa

SEQ ID NO: 47640 - DNA, 22 bp, Artificial Sequence
  chemically synthesized
aaccccacatctgactccaagc

SEQ ID NO: 47641 - DNA, 22 bp, Artificial Sequence
  chemically synthesized
actccaagctgggggacacaga

SEQ ID NO: 47642 - DNA, 22 bp, Artificial Sequence
  chemically synthesized
caagctgggggacacagaacct

SEQ ID NO: 47643 - DNA, 22 bp, Artificial Sequence
  chemically synthesized
ggggacacagaacctcagccaa

SEQ ID NO: 47644 - DNA, 22 bp, Artificial Sequence
  chemically synthesized
agccaagtcctgggctggtaat

SEQ ID NO: 47645 - DNA, 22 bp, Artificial Sequence
  chemically synthesized
ggctggtaatacttagaaaaag

SEQ ID NO: 47646 - DNA, 22 bp, Artificial Sequence
  chemically synthesized
gtaatacttagaaaaagctagt

SEQ ID NO: 47647 - DNA, 22 bp, Artificial Sequence
  chemically synthesized
agaaaaagctagtggtctcgcc

SEQ ID NO: 47648 - DNA, 22 bp, Artificial Sequence
  chemically synthesized
gaaaaagctagtggtctcgccc

SEQ ID NO: 47649 - DNA, 22 bp, Artificial Sequence
  chemically synthesized
gtggtctcgccccgggaagaag

SEQ ID NO: 47650 - DNA, 22 bp, Artificial Sequence
  chemically synthesized
gccccgggaagaagcttcccac

SEQ ID NO: 47651 - DNA, 22 bp, Artificial Sequence
  chemically synthesized
cccacagcctgagggccagaag

SEQ ID NO: 47652 - DNA, 22 bp, Artificial Sequence
  chemically synthesized
ccacagcctgagggccagaagc

SEQ ID NO: 47653 - DNA, 22 bp, Artificial Sequence
  chemically synthesized
agggccagaagctggcagagtt

SEQ ID NO: 47654 - DNA, 22 bp, Artificial Sequence
  chemically synthesized
gcagagttgttgagcaaactcg

SEQ ID NO: 47655 - DNA, 22 bp, Artificial Sequence
  chemically synthesized
ttgagcaaactcgccccgcaca

SEQ ID NO: 47656 - DNA, 22 bp, Artificial Sequence
  chemically synthesized
agcaaactcgccccgcacacgg

SEQ ID NO: 47657 - DNA, 22 bp, Artificial Sequence
  chemically synthesized
gccccgcacacggtcggcagac

SEQ ID NO: 47658 - DNA, 22 bp, Artificial Sequence
  chemically synthesized
aggcgccgggctcagctccggg

SEQ ID NO: 47659 - DNA, 22 bp, Artificial Sequence
  chemically synthesized
agctccggggtcccagtaccag

SEQ ID NO: 47660 - DNA, 22 bp, Artificial Sequence
  chemically synthesized
cggggtcccagtaccaggcgca

SEQ ID NO: 47661 - DNA, 22 bp, Artificial Sequence
  chemically synthesized
cggctccagagcaccaagggcc

SEQ ID NO: 47662 - DNA, 22 bp, Artificial Sequence
  chemically synthesized
cagagcaccaagggcccttccc

SEQ ID NO: 47663 - DNA, 22 bp, Artificial Sequence
  chemically synthesized
ccctgcctgagtcctaaaggac

SEQ ID NO: 47664 - DNA, 22 bp, Artificial Sequence
  chemically synthesized
cctgcctgagtcctaaaggacg

SEQ ID NO: 47665 - DNA, 22 bp, Artificial Sequence
  chemically synthesized
cctgagtcctaaaggacgccaa

SEQ ID NO: 47666 - DNA, 22 bp, Artificial Sequence
  chemically synthesized
agtcctaaaggacgccaatggg

SEQ ID NO: 47667 - DNA, 22 bp, Artificial Sequence
  chemically synthesized
aaggacgccaatgggcctcgag

SEQ ID NO: 47668 - DNA, 22 bp, Artificial Sequence
  chemically synthesized
gagaatacctccgccccttctc

SEQ ID NO: 47669 - DNA, 22 bp, Artificial Sequence
  chemically synthesized
cgccccttctcccctgcccctt

SEQ ID NO: 47670 - DNA, 22 bp, Artificial Sequence
  chemically synthesized
ctcccctgccccttcagctggt

SEQ ID NO: 47671 - DNA, 22 bp, Artificial Sequence
  chemically synthesized
tcccctgccccttcagctggtt

SEQ ID NO: 47672 - DNA, 22 bp, Artificial Sequence
  chemically synthesized
ccctgccccttcagctggttct

SEQ ID NO: 47673 - DNA, 22 bp, Artificial Sequence
  chemically synthesized
ccccttcagctggttcttttct

SEQ ID NO: 47674 - DNA, 22 bp, Artificial Sequence
  chemically synthesized
cagctggttcttttcttcggct

SEQ ID NO: 47675 - DNA, 22 bp, Artificial Sequence
  chemically synthesized
agctggttcttttcttcggctg

SEQ ID NO: 47676 - DNA, 22 bp, Artificial Sequence
  chemically synthesized
gttcttttcttcggctgaaaca

SEQ ID NO: 47677 - DNA, 22 bp, Artificial Sequence
  chemically synthesized
ttttcttcggctgaaacagatg

SEQ ID NO: 47678 - DNA, 22 bp, Artificial Sequence
  chemically synthesized
ttcttcggctgaaacagatgga

SEQ ID NO: 47679 - DNA, 22 bp, Artificial Sequence
  chemically synthesized
tcttcggctgaaacagatggaa

SEQ ID NO: 47680 - DNA, 22 bp, Artificial Sequence
  chemically synthesized
cttcggctgaaacagatggaat

SEQ ID NO: 47681 - DNA, 22 bp, Artificial Sequence
  chemically synthesized
ttcggctgaaacagatggaata

SEQ ID NO: 47682 - DNA, 22 bp, Artificial Sequence
  chemically synthesized
cggctgaaacagatggaatact

SEQ ID NO: 47683 - DNA, 22 bp, Artificial Sequence
  chemically synthesized
ggctgaaacagatggaatacta

SEQ ID NO: 47684 - DNA, 22 bp, Artificial Sequence
  chemically synthesized
aaacagatggaatactagagca

SEQ ID NO: 47685 - DNA, 22 bp, Artificial Sequence
  chemically synthesized
gagcatgagttctgtgtcataa

SEQ ID NO: 47686 - DNA, 22 bp, Artificial Sequence
  chemically synthesized
tgtgtcataaagaaattgcctc

SEQ ID NO: 47687 - DNA, 22 bp, Artificial Sequence
  chemically synthesized
tgtcataaagaaattgcctcgt

SEQ ID NO: 47688 - DNA, 22 bp, Artificial Sequence
  chemically synthesized
cctcgtgctcccagcatctgcc

SEQ ID NO: 47689 - DNA, 22 bp, Artificial Sequence
  chemically synthesized
gtgctcccagcatctgccgtcc

SEQ ID NO: 47690 - DNA, 22 bp, Artificial Sequence
  chemically synthesized
ccagcatctgccgtccttccca

SEQ ID NO: 47691 - DNA, 22 bp, Artificial Sequence
  chemically synthesized
ccgtccttcccaccccgcccct

SEQ ID NO: 47692 - DNA, 22 bp, Artificial Sequence
  chemically synthesized
cccaccccgcccctgtctcggg

SEQ ID NO: 47693 - DNA, 22 bp, Artificial Sequence
  chemically synthesized
ccaccccgcccctgtctcgggt

SEQ ID NO: 47694 - DNA, 22 bp, Artificial Sequence
  chemically synthesized
tctcgggtagggccttctctcc

SEQ ID NO: 47695 - DNA, 22 bp, Artificial Sequence
  chemically synthesized
gggtagggccttctctccaggc

SEQ ID NO: 47696 - DNA, 22 bp, Artificial Sequence
  chemically synthesized
ctctccaggccctccaccctcc

SEQ ID NO: 47697 - DNA, 22 bp, Artificial Sequence
  chemically synthesized
tctccaggccctccaccctccg

SEQ ID NO: 47698 - DNA, 22 bp, Artificial Sequence
  chemically synthesized
tccaggccctccaccctccgct

SEQ ID NO: 47699 - DNA, 22 bp, Artificial Sequence
  chemically synthesized
caggccctccaccctccgctgc

SEQ ID NO: 47700 - DNA, 22 bp, Artificial Sequence
  chemically synthesized
caccctccgctgcccatgtttt

SEQ ID NO: 47701 - DNA, 22 bp, Artificial Sequence
  chemically synthesized
cgctgcccatgttttccaaacc

SEQ ID NO: 47702 - DNA, 22 bp, Artificial Sequence
  chemically synthesized
cccatgttttccaaaccaaatc

SEQ ID NO: 47703 - DNA, 22 bp, Artificial Sequence
  chemically synthesized
tccaaaccaaatcggaacccac

SEQ ID NO: 47704 - DNA, 22 bp, Artificial Sequence
  chemically synthesized
ccaaaccaaatcggaacccact

SEQ ID NO: 47705 - DNA, 22 bp, Artificial Sequence
  chemically synthesized
caaaccaaatcggaacccacta

SEQ ID NO: 47706 - DNA, 22 bp, Artificial Sequence
  chemically synthesized
taatggcaagcccgctttctct

SEQ ID NO: 47707 - DNA, 22 bp, Artificial Sequence
  chemically synthesized
tctctgtgcctggtgcagttcc

SEQ ID NO: 47708 - DNA, 22 bp, Artificial Sequence
  chemically synthesized
ctctgtgcctggtgcagttccc

SEQ ID NO: 47709 - DNA, 22 bp, Artificial Sequence
  chemically synthesized
tctgtgcctggtgcagttccca

SEQ ID NO: 47710 - DNA, 22 bp, Artificial Sequence
  chemically synthesized
tgtgcctggtgcagttcccagt

SEQ ID NO: 47711 - DNA, 22 bp, Artificial Sequence
  chemically synthesized
tgcctggtgcagttcccagtac

SEQ ID NO: 47712 - DNA, 22 bp, Artificial Sequence
  chemically synthesized
gtgcagttcccagtacgttcca

SEQ ID NO: 47713 - DNA, 22 bp, Artificial Sequence
  chemically synthesized
ccagtacgttccaggcattcac

SEQ ID NO: 47714 - DNA, 22 bp, Artificial Sequence
  chemically synthesized
caggcattcactccttcaccca

SEQ ID NO: 47715 - DNA, 22 bp, Artificial Sequence
  chemically synthesized
actccttcacccacctgtgccg

SEQ ID NO: 47716 - DNA, 22 bp, Artificial Sequence
  chemically synthesized
cttcacccacctgtgccgcggc

SEQ ID NO: 47717 - DNA, 22 bp, Artificial Sequence
  chemically synthesized
cacccacctgtgccgcggcgag

SEQ ID NO: 47718 - DNA, 22 bp, Artificial Sequence
  chemically synthesized
acccacctgtgccgcggcgagg

SEQ ID NO: 47719 - DNA, 22 bp, Artificial Sequence
  chemically synthesized
tgccgcggcgaggcagaaactg

SEQ ID NO: 47720 - DNA, 22 bp, Artificial Sequence
  chemically synthesized
ggaaatctgggcaggatatcct

SEQ ID NO: 47721 - DNA, 22 bp, Artificial Sequence
  chemically synthesized
ggcaggatatcctggcagtgct

SEQ ID NO: 47722 - DNA, 22 bp, Artificial Sequence
  chemically synthesized
gcagtgctctgctcgcccttcc

SEQ ID NO: 47723 - DNA, 22 bp, Artificial Sequence
  chemically synthesized
tgctcgcccttcctcggcctcc

SEQ ID NO: 47724 - DNA, 22 bp, Artificial Sequence
  chemically synthesized
ctcgcccttcctcggcctccgg

SEQ ID NO: 47725 - DNA, 22 bp, Artificial Sequence
  chemically synthesized
gcccttcctcggcctccgggtc

SEQ ID NO: 47726 - DNA, 22 bp, Artificial Sequence
  chemically synthesized
cctcggcctccgggtctcccaa

SEQ ID NO: 47727 - DNA, 22 bp, Artificial Sequence
  chemically synthesized
ctcggcctccgggtctcccaac

SEQ ID NO: 47728 - DNA, 22 bp, Artificial Sequence
  chemically synthesized
ggcctccgggtctcccaacccc

SEQ ID NO: 47729 - DNA, 22 bp, Artificial Sequence
  chemically synthesized
cgggtctcccaaccccgcgaac

SEQ ID NO: 47730 - DNA, 22 bp, Artificial Sequence
  chemically synthesized
ccaaccccgcgaaccttcccac

SEQ ID NO: 47731 - DNA, 22 bp, Artificial Sequence
  chemically synthesized
cccactgaatagcgcagccgca

SEQ ID NO: 47732 - DNA, 22 bp, Artificial Sequence
  chemically synthesized
ccactgaatagcgcagccgcac

SEQ ID NO: 47733 - DNA, 22 bp, Artificial Sequence
  chemically synthesized
aatagcgcagccgcacgcccca

SEQ ID NO: 47734 - DNA, 22 bp, Artificial Sequence
  chemically synthesized
tccaccgtgctccccactaccc

SEQ ID NO: 47735 - DNA, 22 bp, Artificial Sequence
  chemically synthesized
caccgtgctccccactacccgt

SEQ ID NO: 47736 - DNA, 22 bp, Artificial Sequence
  chemically synthesized
cccactacccgtcctcccccgc

SEQ ID NO: 47737 - DNA, 22 bp, Artificial Sequence
  chemically synthesized
cccgtcctcccccgccgccttg

SEQ ID NO: 47738 - DNA, 22 bp, Artificial Sequence
  chemically synthesized
ccccgccgccttgcctgcagtc

SEQ ID NO: 47739 - DNA, 22 bp, Artificial Sequence
  chemically synthesized
gcctgcagtccccaagatcgtg

SEQ ID NO: 47740 - DNA, 22 bp, Artificial Sequence
  chemically synthesized
cctgcagtccccaagatcgtgc

SEQ ID NO: 47741 - DNA, 22 bp, Artificial Sequence
  chemically synthesized
cagtccccaagatcgtgccaag

SEQ ID NO: 47742 - DNA, 22 bp, Artificial Sequence
  chemically synthesized
ggcgacctgcactccacttcct

SEQ ID NO: 47743 - DNA, 22 bp, Artificial Sequence
  chemically synthesized
cactccacttcctctcttacat

SEQ ID NO: 47744 - DNA, 22 bp, Artificial Sequence
  chemically synthesized
cacttcctctcttacatggggg

SEQ ID NO: 47745 - DNA, 22 bp, Artificial Sequence
  chemically synthesized
cctctcttacatggggggaaac

SEQ ID NO: 47746 - DNA, 22 bp, Artificial Sequence
  chemically synthesized
ctctcttacatggggggaaact

SEQ ID NO: 47747 - DNA, 22 bp, Artificial Sequence
  chemically synthesized
tcttacatggggggaaactgag

SEQ ID NO: 47748 - DNA, 22 bp, Artificial Sequence
  chemically synthesized
ttacatggggggaaactgaggc

SEQ ID NO: 47749 - DNA, 22 bp, Artificial Sequence
  chemically synthesized
acatggggggaaactgaggccc

SEQ ID NO: 47750 - DNA, 22 bp, Artificial Sequence
  chemically synthesized
catggggggaaactgaggcccg

SEQ ID NO: 47751 - DNA, 22 bp, Artificial Sequence
  chemically synthesized
aggcccgagaggaaacagcacc

SEQ ID NO: 47752 - DNA, 22 bp, Artificial Sequence
  chemically synthesized
cgggttcgccccggcctcccat

SEQ ID NO: 47753 - DNA, 22 bp, Artificial Sequence
  chemically synthesized
gccccggcctcccatccctaca

SEQ ID NO: 47754 - DNA, 22 bp, Artificial Sequence
  chemically synthesized
ccatccctacacccgcaccttg

SEQ ID NO: 47755 - DNA, 22 bp, Artificial Sequence
  chemically synthesized
cacccgcaccttggcgcagcgg

SEQ ID NO: 47756 - DNA, 22 bp, Artificial Sequence
  chemically synthesized
ggcgcagcggtggaaggtggct

SEQ ID NO: 47757 - DNA, 22 bp, Artificial Sequence
  chemically synthesized
gcgcagcggtggaaggtggctg

SEQ ID NO: 47758 - DNA, 22 bp, Artificial Sequence
  chemically synthesized
tggttccgtgctcgggtgcttc

SEQ ID NO: 47759 - DNA, 22 bp, Artificial Sequence
  chemically synthesized
cgtgctcgggtgcttcggccag

SEQ ID NO: 47760 - DNA, 22 bp, Artificial Sequence
  chemically synthesized
gggtgcttcggccaggccgtcc

SEQ ID NO: 47761 - DNA, 22 bp, Artificial Sequence
  chemically synthesized
cggccaggccgtcctcctcgga

SEQ ID NO: 47762 - DNA, 22 bp, Artificial Sequence
  chemically synthesized
ggccaggccgtcctcctcggaa

SEQ ID NO: 47763 - DNA, 22 bp, Artificial Sequence
  chemically synthesized
ctcggaacgcaaggctagcacc

SEQ ID NO: 47764 - DNA, 22 bp, Artificial Sequence
  chemically synthesized
ggaacgcaaggctagcaccagc

SEQ ID NO: 47765 - DNA, 22 bp, Artificial Sequence
  chemically synthesized
gcaccagctcctcgtagtcgcc

SEQ ID NO: 47766 - DNA, 22 bp, Artificial Sequence
  chemically synthesized
ctcgtagtcgccgtcctcgtcc

SEQ ID NO: 47767 - DNA, 22 bp, Artificial Sequence
  chemically synthesized
gtagtcgccgtcctcgtcctcc

SEQ ID NO: 47768 - DNA, 22 bp, Artificial Sequence
  chemically synthesized
gtcctcctgcgcacgggcgccc

SEQ ID NO: 47769 - DNA, 22 bp, Artificial Sequence
  chemically synthesized
ctgcgcacgggcgcccgcggga

SEQ ID NO: 47770 - DNA, 22 bp, Artificial Sequence
  chemically synthesized
cgcacgggcgcccgcgggaccc

SEQ ID NO: 47771 - DNA, 22 bp, Artificial Sequence
  chemically synthesized
gagctgacggtgcccatgaggg

SEQ ID NO: 47772 - DNA, 22 bp, Artificial Sequence
  chemically synthesized
acggtgcccatgagggccaggg

SEQ ID NO: 47773 - DNA, 22 bp, Artificial Sequence
  chemically synthesized
ctgtcctggcgaggagacctag

SEQ ID NO: 47774 - DNA, 22 bp, Artificial Sequence
  chemically synthesized
tcctggcgaggagacctagagg

SEQ ID NO: 47775 - DNA, 22 bp, Artificial Sequence
  chemically synthesized
gcgaggagacctagaggccgtg

SEQ ID NO: 47776 - DNA, 22 bp, Artificial Sequence
  chemically synthesized
gaggccgtgcgcggtccacgcc

SEQ ID NO: 47777 - DNA, 22 bp, Artificial Sequence
  chemically synthesized
gagccttgcggtggggaggact

SEQ ID NO: 47778 - DNA, 22 bp, Artificial Sequence
  chemically synthesized
agccttgcggtggggaggactg

SEQ ID NO: 47779 - DNA, 22 bp, Artificial Sequence
  chemically synthesized
gcggtggggaggactgtgcagg

SEQ ID NO: 47780 - DNA, 22 bp, Artificial Sequence
  chemically synthesized
cggtggggaggactgtgcagga

SEQ ID NO: 47781 - DNA, 22 bp, Artificial Sequence
  chemically synthesized
tgcaggagctgaagttcaggag

SEQ ID NO: 47782 - DNA, 22 bp, Artificial Sequence
  chemically synthesized
aagttcaggagcagggcgcgtg

SEQ ID NO: 47783 - DNA, 22 bp, Artificial Sequence
  chemically synthesized
aggagcagggcgcgtgaagggg

SEQ ID NO: 47784 - DNA, 22 bp, Artificial Sequence
  chemically synthesized
gctgggagctgggagccgctgc

SEQ ID NO: 47785 - DNA, 22 bp, Artificial Sequence
  chemically synthesized
ggagctgggagccgctgctgca

SEQ ID NO: 47786 - DNA, 22 bp, Artificial Sequence
  chemically synthesized
ggagccgctgctgcaacgacgc

SEQ ID NO: 47787 - DNA, 22 bp, Artificial Sequence
  chemically synthesized
ctgcaacgacgcgtcccggccc

SEQ ID NO: 47788 - DNA, 22 bp, Artificial Sequence
  chemically synthesized
caacgacgcgtcccggcccgcc

SEQ ID NO: 47789 - DNA, 22 bp, Artificial Sequence
  chemically synthesized
actgcctggctcactcctccag

SEQ ID NO: 47790 - DNA, 22 bp, Artificial Sequence
  chemically synthesized
cctggctcactcctccaggctc

SEQ ID NO: 47791 - DNA, 22 bp, Artificial Sequence
  chemically synthesized
gctcactcctccaggctcagac

SEQ ID NO: 47792 - DNA, 22 bp, Artificial Sequence
  chemically synthesized
actcctccaggctcagaccctg

SEQ ID NO: 47793 - DNA, 22 bp, Artificial Sequence
  chemically synthesized
ctccaggctcagaccctgaact

SEQ ID NO: 47794 - DNA, 22 bp, Artificial Sequence
  chemically synthesized
caggctcagaccctgaactgaa

SEQ ID NO: 47795 - DNA, 22 bp, Artificial Sequence
  chemically synthesized
agaccctgaactgaacggcggc

SEQ ID NO: 47796 - DNA, 22 bp, Artificial Sequence
  chemically synthesized
aactgaacggcggcgcccgcct

SEQ ID NO: 47797 - DNA, 22 bp, Artificial Sequence
  chemically synthesized
aacggcggcgcccgcctgcaac

SEQ ID NO: 47798 - DNA, 22 bp, Artificial Sequence
  chemically synthesized
caaccatgagcgcctcgacgtc

SEQ ID NO: 47799 - DNA, 22 bp, Artificial Sequence
  chemically synthesized
gacgtcgctgcggaaaccttct

SEQ ID NO: 47800 - DNA, 22 bp, Artificial Sequence
  chemically synthesized
cggaaaccttctagggtgtggg

SEQ ID NO: 47801 - DNA, 22 bp, Artificial Sequence
  chemically synthesized
ctagggtgtgggtgcttgacgc

SEQ ID NO: 47802 - DNA, 22 bp, Artificial Sequence
  chemically synthesized
tagggtgtgggtgcttgacgcc

SEQ ID NO: 47803 - DNA, 22 bp, Artificial Sequence
  chemically synthesized
gggtgtgggtgcttgacgcctg

SEQ ID NO: 47804 - DNA, 22 bp, Artificial Sequence
  chemically synthesized
gacgcctggggcgcgcagatca

SEQ ID NO: 47805 - DNA, 22 bp, Artificial Sequence
  chemically synthesized
acgcctggggcgcgcagatcac

SEQ ID NO: 47806 - DNA, 22 bp, Artificial Sequence
  chemically synthesized
gggcgcgcagatcacgccacca

SEQ ID NO: 47807 - DNA, 22 bp, Artificial Sequence
  chemically synthesized
tctgattaaacattaacggaac

SEQ ID NO: 47808 - DNA, 22 bp, Artificial Sequence
  chemically synthesized
attaaacattaacggaaccccc

SEQ ID NO: 47809 - DNA, 22 bp, Artificial Sequence
  chemically synthesized
aacattaacggaacccccggac

SEQ ID NO: 47810 - DNA, 22 bp, Artificial Sequence
  chemically synthesized
acggaacccccggactggagga

SEQ ID NO: 47811 - DNA, 22 bp, Artificial Sequence
  chemically synthesized
gaggatcaggtttcggcctcgc

SEQ ID NO: 47812 - DNA, 22 bp, Artificial Sequence
  chemically synthesized
cggcctcgccctccccaaacag

SEQ ID NO: 47813 - DNA, 22 bp, Artificial Sequence
  chemically synthesized
ggcctcgccctccccaaacagc

SEQ ID NO: 47814 - DNA, 22 bp, Artificial Sequence
  chemically synthesized
gccctccccaaacagcgtcaga

SEQ ID NO: 47815 - DNA, 22 bp, Artificial Sequence
  chemically synthesized
cccaaacagcgtcagattacgc

SEQ ID NO: 47816 - DNA, 22 bp, Artificial Sequence
  chemically synthesized
cgcgcagagggaagaaaaaact

SEQ ID NO: 47817 - DNA, 22 bp, Artificial Sequence
  chemically synthesized
ccaaatcctaactgggctggaa

SEQ ID NO: 47818 - DNA, 22 bp, Artificial Sequence
  chemically synthesized
actgggctggaaggcaggccgg

SEQ ID NO: 47819 - DNA, 22 bp, Artificial Sequence
  chemically synthesized
ggctggaaggcaggccggcgcc

SEQ ID NO: 47820 - DNA, 22 bp, Artificial Sequence
  chemically synthesized
gaaggcaggccggcgccctagg

SEQ ID NO: 47821 - DNA, 22 bp, Artificial Sequence
  chemically synthesized
ggggctcctcctctcccgcctc

SEQ ID NO: 47822 - DNA, 22 bp, Artificial Sequence
  chemically synthesized
ctcctctcccgcctctcaccct

SEQ ID NO: 47823 - DNA, 22 bp, Artificial Sequence
  chemically synthesized
ctctcccgcctctcaccctgcg

SEQ ID NO: 47824 - DNA, 22 bp, Artificial Sequence
  chemically synthesized
tcccgcctctcaccctgcgtgg

SEQ ID NO: 47825 - DNA, 22 bp, Artificial Sequence
  chemically synthesized
ccgcctctcaccctgcgtggga

SEQ ID NO: 47826 - DNA, 22 bp, Artificial Sequence
  chemically synthesized
tcaccctgcgtgggatgccaga

SEQ ID NO: 47827 - DNA, 22 bp, Artificial Sequence
  chemically synthesized
accctgcgtgggatgccagact

SEQ ID NO: 47828 - DNA, 22 bp, Artificial Sequence
  chemically synthesized
cgtgggatgccagactccaagt

SEQ ID NO: 47829 - DNA, 22 bp, Artificial Sequence
  chemically synthesized
caagttctgccgggcccacctt

SEQ ID NO: 47830 - DNA, 22 bp, Artificial Sequence
  chemically synthesized
tgccgggcccaccttttcagtg

SEQ ID NO: 47831 - DNA, 22 bp, Artificial Sequence
  chemically synthesized
ccgggcccaccttttcagtgtt

SEQ ID NO: 47832 - DNA, 22 bp, Artificial Sequence
  chemically synthesized
ttcagtgtttcctgggtccacc

SEQ ID NO: 47833 - DNA, 22 bp, Artificial Sequence
  chemically synthesized
tcagtgtttcctgggtccacct

SEQ ID NO: 47834 - DNA, 22 bp, Artificial Sequence
  chemically synthesized
cagtgtttcctgggtccacctt

SEQ ID NO: 47835 - DNA, 22 bp, Artificial Sequence
  chemically synthesized
agtgtttcctgggtccaccttg

SEQ ID NO: 47836 - DNA, 22 bp, Artificial Sequence
  chemically synthesized
cctgggtccaccttgtctcctg

SEQ ID NO: 47837 - DNA, 22 bp, Artificial Sequence
  chemically synthesized
ctgggtccaccttgtctcctgc

SEQ ID NO: 47838 - DNA, 22 bp, Artificial Sequence
  chemically synthesized
ggtccaccttgtctcctgctga

SEQ ID NO: 47839 - DNA, 22 bp, Artificial Sequence
  chemically synthesized
gtctcctgctgaccagtgagac

SEQ ID NO: 47840 - DNA, 22 bp, Artificial Sequence
  chemically synthesized
tctcctgctgaccagtgagact

SEQ ID NO: 47841 - DNA, 22 bp, Artificial Sequence
  chemically synthesized
ctgctgaccagtgagacttctg

SEQ ID NO: 47842 - DNA, 22 bp, Artificial Sequence
  chemically synthesized
ctgaccagtgagacttctgaat

SEQ ID NO: 47843 - DNA, 22 bp, Artificial Sequence
  chemically synthesized
accagtgagacttctgaatcaa

SEQ ID NO: 47844 - DNA, 22 bp, Artificial Sequence
  chemically synthesized
ctgaatcaatcctactgtggac

SEQ ID NO: 47845 - DNA, 22 bp, Artificial Sequence
  chemically synthesized
tgaatcaatcctactgtggact

SEQ ID NO: 47846 - DNA, 22 bp, Artificial Sequence
  chemically synthesized
aatcaatcctactgtggactcc

SEQ ID NO: 47847 - DNA, 22 bp, Artificial Sequence
  chemically synthesized
ctgtggactcctcgctgcccac

SEQ ID NO: 47848 - DNA, 22 bp, Artificial Sequence
  chemically synthesized
tggactcctcgctgcccaccga

SEQ ID NO: 47849 - DNA, 22 bp, Artificial Sequence
  chemically synthesized
ctcgctgcccaccgaattcttt

SEQ ID NO: 47850 - DNA, 22 bp, Artificial Sequence
  chemically synthesized
gctgcccaccgaattctttcca

SEQ ID NO: 47851 - DNA, 22 bp, Artificial Sequence
  chemically synthesized
cccaccgaattctttccactgg

SEQ ID NO: 47852 - DNA, 22 bp, Artificial Sequence
  chemically synthesized
tttccactggccttaacctggc

SEQ ID NO: 47853 - DNA, 22 bp, Artificial Sequence
  chemically synthesized
tccactggccttaacctggcag

SEQ ID NO: 47854 - DNA, 22 bp, Artificial Sequence
  chemically synthesized
ccactggccttaacctggcagc

SEQ ID NO: 47855 - DNA, 22 bp, Artificial Sequence
  chemically synthesized
cactggccttaacctggcagcc

SEQ ID NO: 47856 - DNA, 22 bp, Artificial Sequence
  chemically synthesized
gccttaacctggcagccttcta

SEQ ID NO: 47857 - DNA, 22 bp, Artificial Sequence
  chemically synthesized
aacctggcagccttctaaactt

SEQ ID NO: 47858 - DNA, 22 bp, Artificial Sequence
  chemically synthesized
acctggcagccttctaaactta

SEQ ID NO: 47859 - DNA, 22 bp, Artificial Sequence
  chemically synthesized
gcagccttctaaacttagcctg

SEQ ID NO: 47860 - DNA, 22 bp, Artificial Sequence
  chemically synthesized
ctaaacttagcctggaccccct

SEQ ID NO: 47861 - DNA, 22 bp, Artificial Sequence
  chemically synthesized
taaacttagcctggaccccctc

SEQ ID NO: 47862 - DNA, 22 bp, Artificial Sequence
  chemically synthesized
aacttagcctggaccccctccg

SEQ ID NO: 47863 - DNA, 22 bp, Artificial Sequence
  chemically synthesized
agcctggaccccctccggcctc

SEQ ID NO: 47864 - DNA, 22 bp, Artificial Sequence
  chemically synthesized
gcctggaccccctccggcctct

SEQ ID NO: 47865 - DNA, 22 bp, Artificial Sequence
  chemically synthesized
gaccccctccggcctctgccct

SEQ ID NO: 47866 - DNA, 22 bp, Artificial Sequence
  chemically synthesized
cggcctctgccctttatgcacc

SEQ ID NO: 47867 - DNA, 22 bp, Artificial Sequence
  chemically synthesized
tgccctttatgcaccctgcaca

SEQ ID NO: 47868 - DNA, 22 bp, Artificial Sequence
  chemically synthesized
ccctttatgcaccctgcacact

SEQ ID NO: 47869 - DNA, 22 bp, Artificial Sequence
  chemically synthesized
tatgcaccctgcacactgacct

SEQ ID NO: 47870 - DNA, 22 bp, Artificial Sequence
  chemically synthesized
atgcaccctgcacactgacctt

SEQ ID NO: 47871 - DNA, 22 bp, Artificial Sequence
  chemically synthesized
tgcaccctgcacactgacctta

SEQ ID NO: 47872 - DNA, 22 bp, Artificial Sequence
  chemically synthesized
cacactgaccttaccaactagc

SEQ ID NO: 47873 - DNA, 22 bp, Artificial Sequence
  chemically synthesized
accttaccaactagctgctcct

SEQ ID NO: 47874 - DNA, 22 bp, Artificial Sequence
  chemically synthesized
accaactagctgctccttgaag

SEQ ID NO: 47875 - DNA, 22 bp, Artificial Sequence
  chemically synthesized
ccaactagctgctccttgaaga

SEQ ID NO: 47876 - DNA, 22 bp, Artificial Sequence
  chemically synthesized
gctgctccttgaagagattgct

SEQ ID NO: 47877 - DNA, 22 bp, Artificial Sequence
  chemically synthesized
ctccttgaagagattgcttgct

SEQ ID NO: 47878 - DNA, 22 bp, Artificial Sequence
  chemically synthesized
cttgaagagattgcttgctttt

SEQ ID NO: 47879 - DNA, 22 bp, Artificial Sequence
  chemically synthesized
gaagagattgcttgcttttgat

SEQ ID NO: 47880 - DNA, 22 bp, Artificial Sequence
  chemically synthesized
aagagattgcttgcttttgatg

SEQ ID NO: 47881 - DNA, 22 bp, Artificial Sequence
  chemically synthesized
cttgcttttgatgtccagccta

SEQ ID NO: 47882 - DNA, 22 bp, Artificial Sequence
  chemically synthesized
gcttttgatgtccagcctacat

SEQ ID NO: 47883 - DNA, 22 bp, Artificial Sequence
  chemically synthesized
cttttgatgtccagcctacatg

SEQ ID NO: 47884 - DNA, 22 bp, Artificial Sequence
  chemically synthesized
ttgatgtccagcctacatgcat

SEQ ID NO: 47885 - DNA, 22 bp, Artificial Sequence
  chemically synthesized
tgatgtccagcctacatgcatt

SEQ ID NO: 47886 - DNA, 22 bp, Artificial Sequence
  chemically synthesized
gatgtccagcctacatgcattt

SEQ ID NO: 47887 - DNA, 22 bp, Artificial Sequence
  chemically synthesized
atgtccagcctacatgcatttc

SEQ ID NO: 47888 - DNA, 22 bp, Artificial Sequence
  chemically synthesized
catgcatttcaagggatttata

SEQ ID NO: 47889 - DNA, 22 bp, Artificial Sequence
  chemically synthesized
caagggatttatactacaaaga

SEQ ID NO: 47890 - DNA, 22 bp, Artificial Sequence
  chemically synthesized
aagggatttatactacaaagat

SEQ ID NO: 47891 - DNA, 22 bp, Artificial Sequence
  chemically synthesized
atactacaaagattcaggtttt

SEQ ID NO: 47892 - DNA, 22 bp, Artificial Sequence
  chemically synthesized
tactacaaagattcaggtttta

SEQ ID NO: 47893 - DNA, 22 bp, Artificial Sequence
  chemically synthesized
caaagattcaggttttaagttt

SEQ ID NO: 47894 - DNA, 22 bp, Artificial Sequence
  chemically synthesized
aggttttaagtttgcaaagacg

SEQ ID NO: 47895 - DNA, 22 bp, Artificial Sequence
  chemically synthesized
taagtttgcaaagacgtcatat

SEQ ID NO: 47896 - DNA, 22 bp, Artificial Sequence
  chemically synthesized
aagtttgcaaagacgtcatata

SEQ ID NO: 47897 - DNA, 22 bp, Artificial Sequence
  chemically synthesized
agtttgcaaagacgtcatatag

SEQ ID NO: 47898 - DNA, 22 bp, Artificial Sequence
  chemically synthesized
gcaaagacgtcatataggtaca

SEQ ID NO: 47899 - DNA, 22 bp, Artificial Sequence
  chemically synthesized
caaagacgtcatataggtacat

SEQ ID NO: 47900 - DNA, 22 bp, Artificial Sequence
  chemically synthesized
agaattctatggtaggcacaag

SEQ ID NO: 47901 - DNA, 22 bp, Artificial Sequence
  chemically synthesized
tatggtaggcacaagctcagct

SEQ ID NO: 47902 - DNA, 22 bp, Artificial Sequence
  chemically synthesized
tggtaggcacaagctcagcttt

SEQ ID NO: 47903 - DNA, 22 bp, Artificial Sequence
  chemically synthesized
agctttccagaagattcaattt

SEQ ID NO: 47904 - DNA, 22 bp, Artificial Sequence
  chemically synthesized
tccagaagattcaatttgcaaa

SEQ ID NO: 47905 - DNA, 22 bp, Artificial Sequence
  chemically synthesized
ccagaagattcaatttgcaaag

SEQ ID NO: 47906 - DNA, 22 bp, Artificial Sequence
  chemically synthesized
cagaagattcaatttgcaaaga

SEQ ID NO: 47907 - DNA, 22 bp, Artificial Sequence
  chemically synthesized
aatttgcaaagattccttttac

SEQ ID NO: 47908 - DNA, 22 bp, Artificial Sequence
  chemically synthesized
gcaaagattccttttacacacc

SEQ ID NO: 47909 - DNA, 22 bp, Artificial Sequence
  chemically synthesized
caaagattccttttacacacca

SEQ ID NO: 47910 - DNA, 22 bp, Artificial Sequence
  chemically synthesized
cttttacacaccatgttcaaga

SEQ ID NO: 47911 - DNA, 22 bp, Artificial Sequence
  chemically synthesized
ttacacaccatgttcaagaaat

SEQ ID NO: 47912 - DNA, 22 bp, Artificial Sequence
  chemically synthesized
tacacaccatgttcaagaaatc

SEQ ID NO: 47913 - DNA, 22 bp, Artificial Sequence
  chemically synthesized
acacaccatgttcaagaaatca

SEQ ID NO: 47914 - DNA, 22 bp, Artificial Sequence
  chemically synthesized
cacaccatgttcaagaaatcaa

SEQ ID NO: 47915 - DNA, 22 bp, Artificial Sequence
  chemically synthesized
aagaaatcaactggacaagcat

SEQ ID NO: 47916 - DNA, 22 bp, Artificial Sequence
  chemically synthesized
gacaagcatccagtaaacacct

SEQ ID NO: 47917 - DNA, 22 bp, Artificial Sequence
  chemically synthesized
ttgtgtaccaggcaggaggatg

SEQ ID NO: 47918 - DNA, 22 bp, Artificial Sequence
  chemically synthesized
tgtaccaggcaggaggatgaaa

SEQ ID NO: 47919 - DNA, 22 bp, Artificial Sequence
  chemically synthesized
ctggcctcagattgtacatgtg

SEQ ID NO: 47920 - DNA, 22 bp, Artificial Sequence
  chemically synthesized
gcctcagattgtacatgtggca

SEQ ID NO: 47921 - DNA, 22 bp, Artificial Sequence
  chemically synthesized
agattgtacatgtggcatgaca

SEQ ID NO: 47922 - DNA, 22 bp, Artificial Sequence
  chemically synthesized
tacatgtggcatgacatgaggc

SEQ ID NO: 47923 - DNA, 22 bp, Artificial Sequence
  chemically synthesized
gctctttctggaagggctgtcg

SEQ ID NO: 47924 - DNA, 22 bp, Artificial Sequence
  chemically synthesized
ctctttctggaagggctgtcga

SEQ ID NO: 47925 - DNA, 22 bp, Artificial Sequence
  chemically synthesized
tttctggaagggctgtcgatac

SEQ ID NO: 47926 - DNA, 22 bp, Artificial Sequence
  chemically synthesized
tctggaagggctgtcgatactg

SEQ ID NO: 47927 - DNA, 22 bp, Artificial Sequence
  chemically synthesized
ctggaagggctgtcgatactgg

SEQ ID NO: 47928 - DNA, 22 bp, Artificial Sequence
  chemically synthesized
tggaagggctgtcgatactggg

SEQ ID NO: 47929 - DNA, 22 bp, Artificial Sequence
  chemically synthesized
gaagggctgtcgatactgggaa

SEQ ID NO: 47930 - DNA, 22 bp, Artificial Sequence
  chemically synthesized
tcgatactgggaagaaacaaag

SEQ ID NO: 47931 - DNA, 22 bp, Artificial Sequence
  chemically synthesized
ggaagaaacaaaggcgaattta

SEQ ID NO: 47932 - DNA, 22 bp, Artificial Sequence
  chemically synthesized
atgatcctcccttgcagatgca

SEQ ID NO: 47933 - DNA, 22 bp, Artificial Sequence
  chemically synthesized
tgatcctcccttgcagatgcac

SEQ ID NO: 47934 - DNA, 22 bp, Artificial Sequence
  chemically synthesized
ccttgcagatgcacagcagatt

SEQ ID NO: 47935 - DNA, 22 bp, Artificial Sequence
  chemically synthesized
gcagatgcacagcagattccga

SEQ ID NO: 47936 - DNA, 22 bp, Artificial Sequence
  chemically synthesized
cagatgcacagcagattccgag

SEQ ID NO: 47937 - DNA, 22 bp, Artificial Sequence
  chemically synthesized
cgagtgaaatggcctgctctga

SEQ ID NO: 47938 - DNA, 22 bp, Artificial Sequence
  chemically synthesized
ctctgaatctaggtgctggagt

SEQ ID NO: 47939 - DNA, 22 bp, Artificial Sequence
  chemically synthesized
tgaatctaggtgctggagtcca

SEQ ID NO: 47940 - DNA, 22 bp, Artificial Sequence
  chemically synthesized
aatctaggtgctggagtccaaa

SEQ ID NO: 47941 - DNA, 22 bp, Artificial Sequence
  chemically synthesized
ggtgctggagtccaaagttgat

SEQ ID NO: 47942 - DNA, 22 bp, Artificial Sequence
  chemically synthesized
gagtccaaagttgatgctcttt

SEQ ID NO: 47943 - DNA, 22 bp, Artificial Sequence
  chemically synthesized
atgctctttccactttgtttgc

SEQ ID NO: 47944 - DNA, 22 bp, Artificial Sequence
  chemically synthesized
tttccactttgtttgcaaagac

SEQ ID NO: 47945 - DNA, 22 bp, Artificial Sequence
  chemically synthesized
tccactttgtttgcaaagacct

SEQ ID NO: 47946 - DNA, 22 bp, Artificial Sequence
  chemically synthesized
ccactttgtttgcaaagacctc

SEQ ID NO: 47947 - DNA, 22 bp, Artificial Sequence
  chemically synthesized
cactttgtttgcaaagacctca

SEQ ID NO: 47948 - DNA, 22 bp, Artificial Sequence
  chemically synthesized
tgtttgcaaagacctcactcca

SEQ ID NO: 47949 - DNA, 22 bp, Artificial Sequence
  chemically synthesized
gtttgcaaagacctcactccag

SEQ ID NO: 47950 - DNA, 22 bp, Artificial Sequence
  chemically synthesized
tttgcaaagacctcactccaga

SEQ ID NO: 47951 - DNA, 22 bp, Artificial Sequence
  chemically synthesized
gcaaagacctcactccagagag

SEQ ID NO: 47952 - DNA, 22 bp, Artificial Sequence
  chemically synthesized
caaagacctcactccagagagc

SEQ ID NO: 47953 - DNA, 22 bp, Artificial Sequence
  chemically synthesized
actccagagagccagtgcacaa

SEQ ID NO: 47954 - DNA, 22 bp, Artificial Sequence
  chemically synthesized
cagagagccagtgcacaaagac

SEQ ID NO: 47955 - DNA, 22 bp, Artificial Sequence
  chemically synthesized
acagtgactccatgaggtaagg

SEQ ID NO: 47956 - DNA, 22 bp, Artificial Sequence
  chemically synthesized
catgaggtaaggtcagagttat

SEQ ID NO: 47957 - DNA, 22 bp, Artificial Sequence
  chemically synthesized
tccccatcgagcccgccatcgc

SEQ ID NO: 47958 - DNA, 22 bp, Artificial Sequence
  chemically synthesized
atggtttgctgacagaggtggc

SEQ ID NO: 47959 - DNA, 22 bp, Artificial Sequence
  chemically synthesized
gctgacagaggtggcagaggtg

SEQ ID NO: 47960 - DNA, 22 bp, Artificial Sequence
  chemically synthesized
ctgacagaggtggcagaggtgg

SEQ ID NO: 47961 - DNA, 22 bp, Artificial Sequence
  chemically synthesized
acagaggtggcagaggtggttc

SEQ ID NO: 47962 - DNA, 22 bp, Artificial Sequence
  chemically synthesized
tccttcctgttgcctgtaattg

SEQ ID NO: 47963 - DNA, 22 bp, Artificial Sequence
  chemically synthesized
cttcctgttgcctgtaattgga

SEQ ID NO: 47964 - DNA, 22 bp, Artificial Sequence
  chemically synthesized
cctgttgcctgtaattggaatt

SEQ ID NO: 47965 - DNA, 22 bp, Artificial Sequence
  chemically synthesized
ctgttgcctgtaattggaattg

SEQ ID NO: 47966 - DNA, 22 bp, Artificial Sequence
  chemically synthesized
ttgcctgtaattggaattgtat

SEQ ID NO: 47967 - DNA, 22 bp, Artificial Sequence
  chemically synthesized
cctgtaattggaattgtatttg

SEQ ID NO: 47968 - DNA, 22 bp, Artificial Sequence
  chemically synthesized
taattggaattgtatttgcaat

SEQ ID NO: 47969 - DNA, 22 bp, Artificial Sequence
  chemically synthesized
gaattgtatttgcaatgtgctt

SEQ ID NO: 47970 - DNA, 22 bp, Artificial Sequence
  chemically synthesized
tatttgcaatgtgcttttggca

SEQ ID NO: 47971 - DNA, 22 bp, Artificial Sequence
  chemically synthesized
gcaatgtgcttttggcagcttc

SEQ ID NO: 47972 - DNA, 22 bp, Artificial Sequence
  chemically synthesized
caatgtgcttttggcagcttcc

SEQ ID NO: 47973 - DNA, 22 bp, Artificial Sequence
  chemically synthesized
ttggcagcttcctcatcaaagg

SEQ ID NO: 47974 - DNA, 22 bp, Artificial Sequence
  chemically synthesized
tggcagcttcctcatcaaaggc

SEQ ID NO: 47975 - DNA, 22 bp, Artificial Sequence
  chemically synthesized
ggcagcttcctcatcaaaggcc

SEQ ID NO: 47976 - DNA, 22 bp, Artificial Sequence
  chemically synthesized
gcagcttcctcatcaaaggcct

SEQ ID NO: 47977 - DNA, 22 bp, Artificial Sequence
  chemically synthesized
cctcatcaaaggcctcccctgg

SEQ ID NO: 47978 - DNA, 22 bp, Artificial Sequence
  chemically synthesized
ctcatcaaaggcctcccctgga

SEQ ID NO: 47979 - DNA, 22 bp, Artificial Sequence
  chemically synthesized
atcaaaggcctcccctggagca

SEQ ID NO: 47980 - DNA, 22 bp, Artificial Sequence
  chemically synthesized
ccctggagcaagaatagatggg

SEQ ID NO: 47981 - DNA, 22 bp, Artificial Sequence
  chemically synthesized
gagcaagaatagatgggagcta

SEQ ID NO: 47982 - DNA, 22 bp, Artificial Sequence
  chemically synthesized
actttccctgctgctccccttt

SEQ ID NO: 47983 - DNA, 22 bp, Artificial Sequence
  chemically synthesized
tccctgctgctcccctttggga

SEQ ID NO: 47984 - DNA, 22 bp, Artificial Sequence
  chemically synthesized
ccctgctgctcccctttgggac

SEQ ID NO: 47985 - DNA, 22 bp, Artificial Sequence
  chemically synthesized
cctgctgctcccctttgggacc

SEQ ID NO: 47986 - DNA, 22 bp, Artificial Sequence
  chemically synthesized
ctgctcccctttgggaccttgg

SEQ ID NO: 47987 - DNA, 22 bp, Artificial Sequence
  chemically synthesized
ctcccctttgggaccttggcct

SEQ ID NO: 47988 - DNA, 22 bp, Artificial Sequence
  chemically synthesized
ccctttgggaccttggcctctc

SEQ ID NO: 47989 - DNA, 22 bp, Artificial Sequence
  chemically synthesized
tgggaccttggcctctcaccta

SEQ ID NO: 47990 - DNA, 22 bp, Artificial Sequence
  chemically synthesized
gggaccttggcctctcacctac

SEQ ID NO: 47991 - DNA, 22 bp, Artificial Sequence
  chemically synthesized
ggaccttggcctctcacctacc

SEQ ID NO: 47992 - DNA, 22 bp, Artificial Sequence
  chemically synthesized
ggcctctcacctaccggggtcg

SEQ ID NO: 47993 - DNA, 22 bp, Artificial Sequence
  chemically synthesized
gcctctcacctaccggggtcgt

SEQ ID NO: 47994 - DNA, 20 bp, Artificial Sequence
  chemically synthesized
gtaaggctgaggcctggcac

SEQ ID NO: 47995 - DNA, 20 bp, Artificial Sequence
  chemically synthesized
gcctggcacaggtctgttcc

SEQ ID NO: 47996 - DNA, 20 bp, Artificial Sequence
  chemically synthesized
ggtctgttcctggtcatatc

SEQ ID NO: 47997 - DNA, 20 bp, Artificial Sequence
  chemically synthesized
tctgttcctggtcatatctg

SEQ ID NO: 47998 - DNA, 20 bp, Artificial Sequence
  chemically synthesized
ctgttcctggtcatatctgg

SEQ ID NO: 47999 - DNA, 20 bp, Artificial Sequence
  chemically synthesized
tgttcctggtcatatctgga

SEQ ID NO: 48000 - DNA, 20 bp, Artificial Sequence
  chemically synthesized
gttcctggtcatatctggag

SEQ ID NO: 48001 - DNA, 20 bp, Artificial Sequence
  chemically synthesized
ctggtcatatctggagggga

SEQ ID NO: 48002 - DNA, 20 bp, Artificial Sequence
  chemically synthesized
ggtcatatctggaggggatg

SEQ ID NO: 48003 - DNA, 20 bp, Artificial Sequence
  chemically synthesized
ctggaggggatggagaatgt

SEQ ID NO: 48004 - DNA, 20 bp, Artificial Sequence
  chemically synthesized
aggggatggagaatgtgagc

SEQ ID NO: 48005 - DNA, 20 bp, Artificial Sequence
  chemically synthesized
cgttcctccccacccctctc

SEQ ID NO: 48006 - DNA, 20 bp, Artificial Sequence
  chemically synthesized
gaccttaacctcctcatcta

SEQ ID NO: 48007 - DNA, 20 bp, Artificial Sequence
  chemically synthesized
cttaacctcctcatctatag

SEQ ID NO: 48008 - DNA, 20 bp, Artificial Sequence
  chemically synthesized
ttaacctcctcatctataga

SEQ ID NO: 48009 - DNA, 20 bp, Artificial Sequence
  chemically synthesized
taacctcctcatctatagaa

SEQ ID NO: 48010 - DNA, 20 bp, Artificial Sequence
  chemically synthesized
aacctcctcatctatagaag

SEQ ID NO: 48011 - DNA, 20 bp, Artificial Sequence
  chemically synthesized
cctcctcatctatagaaggg

SEQ ID NO: 48012 - DNA, 20 bp, Artificial Sequence
  chemically synthesized
ctcatctatagaaggggaga

SEQ ID NO: 48013 - DNA, 20 bp, Artificial Sequence
  chemically synthesized
ggggagaaagatgcatgccc

SEQ ID NO: 48014 - DNA, 20 bp, Artificial Sequence
  chemically synthesized
gagaaagatgcatgcccaag

SEQ ID NO: 48015 - DNA, 20 bp, Artificial Sequence
  chemically synthesized
aaagatgcatgcccaagcag

SEQ ID NO: 48016 - DNA, 20 bp, Artificial Sequence
  chemically synthesized
aagatgcatgcccaagcagt

SEQ ID NO: 48017 - DNA, 20 bp, Artificial Sequence
  chemically synthesized
gatgcatgcccaagcagtag

SEQ ID NO: 48018 - DNA, 20 bp, Artificial Sequence
  chemically synthesized
tgcatgcccaagcagtagga

SEQ ID NO: 48019 - DNA, 20 bp, Artificial Sequence
  chemically synthesized
gcatgcccaagcagtaggag

SEQ ID NO: 48020 - DNA, 20 bp, Artificial Sequence
  chemically synthesized
tgcccaagcagtaggagagg

SEQ ID NO: 48021 - DNA, 20 bp, Artificial Sequence
  chemically synthesized
caagcagtaggagaggtggt

SEQ ID NO: 48022 - DNA, 20 bp, Artificial Sequence
  chemically synthesized
aagcagtaggagaggtggtg

SEQ ID NO: 48023 - DNA, 20 bp, Artificial Sequence
  chemically synthesized
aggagaggtggtgaggctta

SEQ ID NO: 48024 - DNA, 20 bp, Artificial Sequence
  chemically synthesized
ggagaggtggtgaggcttat

SEQ ID NO: 48025 - DNA, 20 bp, Artificial Sequence
  chemically synthesized
agaggtggtgaggcttatag

SEQ ID NO: 48026 - DNA, 20 bp, Artificial Sequence
  chemically synthesized
gtgaggcttataggagacaa

SEQ ID NO: 48027 - DNA, 20 bp, Artificial Sequence
  chemically synthesized
ggcttataggagacaacaga

SEQ ID NO: 48028 - DNA, 20 bp, Artificial Sequence
  chemically synthesized
gcttataggagacaacagac

SEQ ID NO: 48029 - DNA, 20 bp, Artificial Sequence
  chemically synthesized
ttataggagacaacagacag

SEQ ID NO: 48030 - DNA, 20 bp, Artificial Sequence
  chemically synthesized
caacagacaggagcccccga

SEQ ID NO: 48031 - DNA, 20 bp, Artificial Sequence
  chemically synthesized
agacaggagcccccgacaga

SEQ ID NO: 48032 - DNA, 20 bp, Artificial Sequence
  chemically synthesized
acaggagcccccgacagaca

SEQ ID NO: 48033 - DNA, 20 bp, Artificial Sequence
  chemically synthesized
caggagcccccgacagacag

SEQ ID NO: 48034 - DNA, 20 bp, Artificial Sequence
  chemically synthesized
ggagcccccgacagacagag

SEQ ID NO: 48035 - DNA, 20 bp, Artificial Sequence
  chemically synthesized
agacagaggagctgtgcaaa

SEQ ID NO: 48036 - DNA, 20 bp, Artificial Sequence
  chemically synthesized
agaggagctgtgcaaacaga

SEQ ID NO: 48037 - DNA, 20 bp, Artificial Sequence
  chemically synthesized
gctgtgcaaacagaaagaaa

SEQ ID NO: 48038 - DNA, 20 bp, Artificial Sequence
  chemically synthesized
ttgttgctgttgctgtatct

SEQ ID NO: 48039 - DNA, 20 bp, Artificial Sequence
  chemically synthesized
tgctgttgctgtatcttggc

SEQ ID NO: 48040 - DNA, 20 bp, Artificial Sequence
  chemically synthesized
ttggctggtgtcccccatcc

SEQ ID NO: 48041 - DNA, 20 bp, Artificial Sequence
  chemically synthesized
tggctggtgtcccccatcct

SEQ ID NO: 48042 - DNA, 20 bp, Artificial Sequence
  chemically synthesized
ggctggtgtcccccatcctg

SEQ ID NO: 48043 - DNA, 20 bp, Artificial Sequence
  chemically synthesized
tgtcccccatcctggggtgc

SEQ ID NO: 48044 - DNA, 20 bp, Artificial Sequence
  chemically synthesized
gtcccccatcctggggtgcc

SEQ ID NO: 48045 - DNA, 20 bp, Artificial Sequence
  chemically synthesized
atcctggggtgccaggactg

SEQ ID NO: 48046 - DNA, 20 bp, Artificial Sequence
  chemically synthesized
gggtgccaggactgcagacc

SEQ ID NO: 48047 - DNA, 20 bp, Artificial Sequence
  chemically synthesized
ccctcatccacttctgctta

SEQ ID NO: 48048 - DNA, 20 bp, Artificial Sequence
  chemically synthesized
cctcatccacttctgcttac

SEQ ID NO: 48049 - DNA, 20 bp, Artificial Sequence
  chemically synthesized
ccacttctgcttacaggaac

SEQ ID NO: 48050 - DNA, 20 bp, Artificial Sequence
  chemically synthesized
acaggaaccagtgtatccac

SEQ ID NO: 48051 - DNA, 20 bp, Artificial Sequence
  chemically synthesized
caggaaccagtgtatccacc

SEQ ID NO: 48052 - DNA, 20 bp, Artificial Sequence
  chemically synthesized
ggaaccagtgtatccaccag

SEQ ID NO: 48053 - DNA, 20 bp, Artificial Sequence
  chemically synthesized
gaaccagtgtatccaccagg

SEQ ID NO: 48054 - DNA, 20 bp, Artificial Sequence
  chemically synthesized
tgtatccaccaggaggtacc

SEQ ID NO: 48055 - DNA, 20 bp, Artificial Sequence
  chemically synthesized
gtatccaccaggaggtaccg

SEQ ID NO: 48056 - DNA, 20 bp, Artificial Sequence
  chemically synthesized
tatccaccaggaggtaccga

SEQ ID NO: 48057 - DNA, 20 bp, Artificial Sequence
  chemically synthesized
atccaccaggaggtaccgag

SEQ ID NO: 48058 - DNA, 20 bp, Artificial Sequence
  chemically synthesized
tccaccaggaggtaccgagg

SEQ ID NO: 48059 - DNA, 20 bp, Artificial Sequence
  chemically synthesized
ccaccaggaggtaccgaggg

SEQ ID NO: 48060 - DNA, 20 bp, Artificial Sequence
  chemically synthesized
aggaggtaccgaggggggac

SEQ ID NO: 48061 - DNA, 20 bp, Artificial Sequence
  chemically synthesized
ggaggtaccgaggggggacc

SEQ ID NO: 48062 - DNA, 20 bp, Artificial Sequence
  chemically synthesized
ggtaccgaggggggaccggg

SEQ ID NO: 48063 - DNA, 20 bp, Artificial Sequence
  chemically synthesized
gtaccgaggggggaccgggc

SEQ ID NO: 48064 - DNA, 20 bp, Artificial Sequence
  chemically synthesized
gaggggggaccgggcaggac

SEQ ID NO: 48065 - DNA, 20 bp, Artificial Sequence
  chemically synthesized
aggggggaccgggcaggact

SEQ ID NO: 48066 - DNA, 20 bp, Artificial Sequence
  chemically synthesized
gaccgggcaggactgggaaa

SEQ ID NO: 48067 - DNA, 20 bp, Artificial Sequence
  chemically synthesized
accgggcaggactgggaaac

SEQ ID NO: 48068 - DNA, 20 bp, Artificial Sequence
  chemically synthesized
gaaacaggacacaaccctca

SEQ ID NO: 48069 - DNA, 20 bp, Artificial Sequence
  chemically synthesized
ggctgctgttattatgaaaa

SEQ ID NO: 48070 - DNA, 20 bp, Artificial Sequence
  chemically synthesized
gctgctgttattatgaaaat

SEQ ID NO: 48071 - DNA, 20 bp, Artificial Sequence
  chemically synthesized
tgctgttattatgaaaatag

SEQ ID NO: 48072 - DNA, 20 bp, Artificial Sequence
  chemically synthesized
ttattatgaaaataggagct

SEQ ID NO: 48073 - DNA, 20 bp, Artificial Sequence
  chemically synthesized
tgaaaataggagctcagctg

SEQ ID NO: 48074 - DNA, 20 bp, Artificial Sequence
  chemically synthesized
tctccatctgccctgcacct

SEQ ID NO: 48075 - DNA, 20 bp, Artificial Sequence
  chemically synthesized
ccatctgccctgcacctcag

SEQ ID NO: 48076 - DNA, 20 bp, Artificial Sequence
  chemically synthesized
catctgccctgcacctcagc

SEQ ID NO: 48077 - DNA, 20 bp, Artificial Sequence
  chemically synthesized
ctgccctgcacctcagcagg

SEQ ID NO: 48078 - DNA, 20 bp, Artificial Sequence
  chemically synthesized
ccacaacccccctcctgccc

SEQ ID NO: 48079 - DNA, 20 bp, Artificial Sequence
  chemically synthesized
ccccagacctgctgcctgcc

SEQ ID NO: 48080 - DNA, 20 bp, Artificial Sequence
  chemically synthesized
cccagacctgctgcctgcct

SEQ ID NO: 48081 - DNA, 20 bp, Artificial Sequence
  chemically synthesized
cctgctgcctgcctgggcca

SEQ ID NO: 48082 - DNA, 20 bp, Artificial Sequence
  chemically synthesized
ctgctgcctgcctgggccat

SEQ ID NO: 48083 - DNA, 20 bp, Artificial Sequence
  chemically synthesized
tgctgcctgcctgggccatg

SEQ ID NO: 48084 - DNA, 20 bp, Artificial Sequence
  chemically synthesized
ctgcctgcctgggccatggg

SEQ ID NO: 48085 - DNA, 20 bp, Artificial Sequence
  chemically synthesized
tgcctgggccatggggagct

SEQ ID NO: 48086 - DNA, 20 bp, Artificial Sequence
  chemically synthesized
ctgggccatggggagctcag

SEQ ID NO: 48087 - DNA, 20 bp, Artificial Sequence
  chemically synthesized
ggggagctcagaagcctctc

SEQ ID NO: 48088 - DNA, 20 bp, Artificial Sequence
  chemically synthesized
agcctctccagaacctctcg

SEQ ID NO: 48089 - DNA, 20 bp, Artificial Sequence
  chemically synthesized
tccagaacctctcgcagtga

SEQ ID NO: 48090 - DNA, 20 bp, Artificial Sequence
  chemically synthesized
ccagaacctctcgcagtgaa

SEQ ID NO: 48091 - DNA, 20 bp, Artificial Sequence
  chemically synthesized
atacttacgattcactgtcc

SEQ ID NO: 48092 - DNA, 20 bp, Artificial Sequence
  chemically synthesized
tacttacgattcactgtccc

SEQ ID NO: 48093 - DNA, 20 bp, Artificial Sequence
  chemically synthesized
tacgattcactgtcccaggt

SEQ ID NO: 48094 - DNA, 20 bp, Artificial Sequence
  chemically synthesized
gattcactgtcccaggtcag

SEQ ID NO: 48095 - DNA, 20 bp, Artificial Sequence
  chemically synthesized
tcactgtcccaggtcagtgg

SEQ ID NO: 48096 - DNA, 20 bp, Artificial Sequence
  chemically synthesized
caggtcagtggtggtgcctg

SEQ ID NO: 48097 - DNA, 20 bp, Artificial Sequence
  chemically synthesized
cagtggtggtgcctgaagct

SEQ ID NO: 48098 - DNA, 20 bp, Artificial Sequence
  chemically synthesized
agtggtggtgcctgaagctg

SEQ ID NO: 48099 - DNA, 20 bp, Artificial Sequence
  chemically synthesized
tggtggtgcctgaagctgag

SEQ ID NO: 48100 - DNA, 20 bp, Artificial Sequence
  chemically synthesized
ggtgcctgaagctgaggaga

SEQ ID NO: 48101 - DNA, 20 bp, Artificial Sequence
  chemically synthesized
gtgcctgaagctgaggagac

SEQ ID NO: 48102 - DNA, 20 bp, Artificial Sequence
  chemically synthesized
tgcctgaagctgaggagaca

SEQ ID NO: 48103 - DNA, 20 bp, Artificial Sequence
  chemically synthesized
ccctgtcctcgtccgtattt

SEQ ID NO: 48104 - DNA, 20 bp, Artificial Sequence
  chemically synthesized
tgtcctcgtccgtatttaag

SEQ ID NO: 48105 - DNA, 20 bp, Artificial Sequence
  chemically synthesized
cctcgtccgtatttaagcag

SEQ ID NO: 48106 - DNA, 20 bp, Artificial Sequence
  chemically synthesized
ccgtatttaagcagtggatc

SEQ ID NO: 48107 - DNA, 20 bp, Artificial Sequence
  chemically synthesized
gtatttaagcagtggatcca

SEQ ID NO: 48108 - DNA, 20 bp, Artificial Sequence
  chemically synthesized
tatttaagcagtggatccag

SEQ ID NO: 48109 - DNA, 20 bp, Artificial Sequence
  chemically synthesized
atttaagcagtggatccaga

SEQ ID NO: 48110 - DNA, 20 bp, Artificial Sequence
  chemically synthesized
tttaagcagtggatccagag

SEQ ID NO: 48111 - DNA, 20 bp, Artificial Sequence
  chemically synthesized
cagtggatccagaggggcaa

SEQ ID NO: 48112 - DNA, 20 bp, Artificial Sequence
  chemically synthesized
agtggatccagaggggcaac

SEQ ID NO: 48113 - DNA, 20 bp, Artificial Sequence
  chemically synthesized
gtggatccagaggggcaacg

SEQ ID NO: 48114 - DNA, 20 bp, Artificial Sequence
  chemically synthesized
tggatccagaggggcaacgg

SEQ ID NO: 48115 - DNA, 20 bp, Artificial Sequence
  chemically synthesized
gatccagaggggcaacgggg

SEQ ID NO: 48116 - DNA, 20 bp, Artificial Sequence
  chemically synthesized
atccagaggggcaacggggg

SEQ ID NO: 48117 - DNA, 20 bp, Artificial Sequence
  chemically synthesized
ggggcaacgggggaggctgc

SEQ ID NO: 48118 - DNA, 20 bp, Artificial Sequence
  chemically synthesized
gctgctggtgaatattaacc

SEQ ID NO: 48119 - DNA, 20 bp, Artificial Sequence
  chemically synthesized
ctgctggtgaatattaacca

SEQ ID NO: 48120 - DNA, 20 bp, Artificial Sequence
  chemically synthesized
aatattaaccaaggtcaccc

SEQ ID NO: 48121 - DNA, 20 bp, Artificial Sequence
  chemically synthesized
accaaggtcaccccagttat

SEQ ID NO: 48122 - DNA, 20 bp, Artificial Sequence
  chemically synthesized
caaggtcaccccagttatcg

SEQ ID NO: 48123 - DNA, 20 bp, Artificial Sequence
  chemically synthesized
aaggtcaccccagttatcgg

SEQ ID NO: 48124 - DNA, 20 bp, Artificial Sequence
  chemically synthesized
ggtcaccccagttatcggag

SEQ ID NO: 48125 - DNA, 20 bp, Artificial Sequence
  chemically synthesized
ccagttatcggaggagcaaa

SEQ ID NO: 48126 - DNA, 20 bp, Artificial Sequence
  chemically synthesized
cagttatcggaggagcaaac

SEQ ID NO: 48127 - DNA, 20 bp, Artificial Sequence
  chemically synthesized
agttatcggaggagcaaaca

SEQ ID NO: 48128 - DNA, 20 bp, Artificial Sequence
  chemically synthesized
gttatcggaggagcaaacag

SEQ ID NO: 48129 - DNA, 20 bp, Artificial Sequence
  chemically synthesized
cggaggagcaaacaggggct

SEQ ID NO: 48130 - DNA, 20 bp, Artificial Sequence
  chemically synthesized
caaacaggggctaagtccac

SEQ ID NO: 48131 - DNA, 20 bp, Artificial Sequence
  chemically synthesized
caggggctaagtccactggc

SEQ ID NO: 48132 - DNA, 20 bp, Artificial Sequence
  chemically synthesized
aggggctaagtccactggct

SEQ ID NO: 48133 - DNA, 20 bp, Artificial Sequence
  chemically synthesized
aagtccactggctgggatct

SEQ ID NO: 48134 - DNA, 20 bp, Artificial Sequence
  chemically synthesized
agtcgcccgcctacgctgcc

SEQ ID NO: 48135 - DNA, 20 bp, Artificial Sequence
  chemically synthesized
cgctgcccggacgctttgcc

SEQ ID NO: 48136 - DNA, 20 bp, Artificial Sequence
  chemically synthesized
gctgcccggacgctttgcct

SEQ ID NO: 48137 - DNA, 20 bp, Artificial Sequence
  chemically synthesized
gcccggacgctttgcctggg

SEQ ID NO: 48138 - DNA, 20 bp, Artificial Sequence
  chemically synthesized
cgctttgcctgggcagtgta

SEQ ID NO: 48139 - DNA, 20 bp, Artificial Sequence
  chemically synthesized
gcttccactgcacttaccga

SEQ ID NO: 48140 - DNA, 20 bp, Artificial Sequence
  chemically synthesized
cttccactgcacttaccgaa

SEQ ID NO: 48141 - DNA, 20 bp, Artificial Sequence
  chemically synthesized
tccactgcacttaccgaaag

SEQ ID NO: 48142 - DNA, 20 bp, Artificial Sequence
  chemically synthesized
ccgaaaggagtcattgtacc

SEQ ID NO: 48143 - DNA, 20 bp, Artificial Sequence
  chemically synthesized
aggagtcattgtacctggct

SEQ ID NO: 48144 - DNA, 20 bp, Artificial Sequence
  chemically synthesized
tgtacctggctcagaaacca

SEQ ID NO: 48145 - DNA, 20 bp, Artificial Sequence
  chemically synthesized
aaccacagcgtcctgtgtcc

SEQ ID NO: 48146 - DNA, 20 bp, Artificial Sequence
  chemically synthesized
accacagcgtcctgtgtcca

SEQ ID NO: 48147 - DNA, 20 bp, Artificial Sequence
  chemically synthesized
acagcgtcctgtgtccaagg

SEQ ID NO: 48148 - DNA, 20 bp, Artificial Sequence
  chemically synthesized
agcgtcctgtgtccaaggtg

SEQ ID NO: 48149 - DNA, 20 bp, Artificial Sequence
  chemically synthesized
gcgtcctgtgtccaaggtgg

SEQ ID NO: 48150 - DNA, 20 bp, Artificial Sequence
  chemically synthesized
cgtcctgtgtccaaggtgga

SEQ ID NO: 48151 - DNA, 20 bp, Artificial Sequence
  chemically synthesized
gtcctgtgtccaaggtggag

SEQ ID NO: 48152 - DNA, 20 bp, Artificial Sequence
  chemically synthesized
tcctgtgtccaaggtggagg

SEQ ID NO: 48153 - DNA, 20 bp, Artificial Sequence
  chemically synthesized
tgtgtccaaggtggaggggg

SEQ ID NO: 48154 - DNA, 20 bp, Artificial Sequence
  chemically synthesized
caaggtggagggggtggcgt

SEQ ID NO: 48155 - DNA, 20 bp, Artificial Sequence
  chemically synthesized
gtggagggggtggcgtgagt

SEQ ID NO: 48156 - DNA, 20 bp, Artificial Sequence
  chemically synthesized
agggggtggcgtgagtcaga

SEQ ID NO: 48157 - DNA, 20 bp, Artificial Sequence
  chemically synthesized
ggcgtgagtcagacagtctc

SEQ ID NO: 48158 - DNA, 20 bp, Artificial Sequence
  chemically synthesized
gcgtgagtcagacagtctct

SEQ ID NO: 48159 - DNA, 20 bp, Artificial Sequence
  chemically synthesized
gtgagtcagacagtctctgg

SEQ ID NO: 48160 - DNA, 20 bp, Artificial Sequence
  chemically synthesized
gagtcagacagtctctggga

SEQ ID NO: 48161 - DNA, 20 bp, Artificial Sequence
  chemically synthesized
gtctctgggagagtaccact

SEQ ID NO: 48162 - DNA, 20 bp, Artificial Sequence
  chemically synthesized
ctgggagagtaccacttagc

SEQ ID NO: 48163 - DNA, 20 bp, Artificial Sequence
  chemically synthesized
ctggccctctgctctcactg

SEQ ID NO: 48164 - DNA, 20 bp, Artificial Sequence
  chemically synthesized
tgctctcactgcagaatcct

SEQ ID NO: 48165 - DNA, 20 bp, Artificial Sequence
  chemically synthesized
tctcactgcagaatccttag

SEQ ID NO: 48166 - DNA, 20 bp, Artificial Sequence
  chemically synthesized
atccttagtggctgttccac

SEQ ID NO: 48167 - DNA, 20 bp, Artificial Sequence
  chemically synthesized
cttagtggctgttccactgg

SEQ ID NO: 48168 - DNA, 20 bp, Artificial Sequence
  chemically synthesized
gtggctgttccactggtagc

SEQ ID NO: 48169 - DNA, 20 bp, Artificial Sequence
  chemically synthesized
agcaagatctaccatttact

SEQ ID NO: 48170 - DNA, 20 bp, Artificial Sequence
  chemically synthesized
ccccaaaatgcctgatgctg

SEQ ID NO: 48171 - DNA, 20 bp, Artificial Sequence
  chemically synthesized
ctgaagacttactgccgccc

SEQ ID NO: 48172 - DNA, 20 bp, Artificial Sequence
  chemically synthesized
tgaagacttactgccgccct

SEQ ID NO: 48173 - DNA, 20 bp, Artificial Sequence
  chemically synthesized
aagacttactgccgccctgg

SEQ ID NO: 48174 - DNA, 20 bp, Artificial Sequence
  chemically synthesized
ttactgccgccctgggagat

SEQ ID NO: 48175 - DNA, 20 bp, Artificial Sequence
  chemically synthesized
actgccgccctgggagatca

SEQ ID NO: 48176 - DNA, 20 bp, Artificial Sequence
  chemically synthesized
gccgccctgggagatcagag

SEQ ID NO: 48177 - DNA, 20 bp, Artificial Sequence
  chemically synthesized
ccgccctgggagatcagagt

SEQ ID NO: 48178 - DNA, 20 bp, Artificial Sequence
  chemically synthesized
cctgggagatcagagtgggt

SEQ ID NO: 48179 - DNA, 20 bp, Artificial Sequence
  chemically synthesized
tgggagatcagagtgggtta

SEQ ID NO: 48180 - DNA, 20 bp, Artificial Sequence
  chemically synthesized
gtgggttagagcccatttga

SEQ ID NO: 48181 - DNA, 20 bp, Artificial Sequence
  chemically synthesized
ttagagcccatttgacagat

SEQ ID NO: 48182 - DNA, 20 bp, Artificial Sequence
  chemically synthesized
tagagcccatttgacagatg

SEQ ID NO: 48183 - DNA, 20 bp, Artificial Sequence
  chemically synthesized
ccatttgacagatgaggaaa

SEQ ID NO: 48184 - DNA, 20 bp, Artificial Sequence
  chemically synthesized
catttgacagatgaggaaac

SEQ ID NO: 48185 - DNA, 20 bp, Artificial Sequence
  chemically synthesized
gacagatgaggaaacaggct

SEQ ID NO: 48186 - DNA, 20 bp, Artificial Sequence
  chemically synthesized
cagatgaggaaacaggctca

SEQ ID NO: 48187 - DNA, 20 bp, Artificial Sequence
  chemically synthesized
atgaggaaacaggctcagag

SEQ ID NO: 48188 - DNA, 20 bp, Artificial Sequence
  chemically synthesized
gaggaaacaggctcagagcg

SEQ ID NO: 48189 - DNA, 20 bp, Artificial Sequence
  chemically synthesized
ggaaacaggctcagagcgga

SEQ ID NO: 48190 - DNA, 20 bp, Artificial Sequence
  chemically synthesized
gcggagagaccgctcatcca

SEQ ID NO: 48191 - DNA, 20 bp, Artificial Sequence
  chemically synthesized
accgctcatccaaagttacc

SEQ ID NO: 48192 - DNA, 20 bp, Artificial Sequence
  chemically synthesized
ctcatccaaagttacccagt

SEQ ID NO: 48193 - DNA, 20 bp, Artificial Sequence
  chemically synthesized
caaagttacccagtcagcct

SEQ ID NO: 48194 - DNA, 20 bp, Artificial Sequence
  chemically synthesized
agacacaaacaccctcttga

SEQ ID NO: 48195 - DNA, 20 bp, Artificial Sequence
  chemically synthesized
caccctcttgatggtcccga

SEQ ID NO: 48196 - DNA, 20 bp, Artificial Sequence
  chemically synthesized
tgatggtcccgatggaaaaa

SEQ ID NO: 48197 - DNA, 20 bp, Artificial Sequence
  chemically synthesized
atggtcccgatggaaaaatg

SEQ ID NO: 48198 - DNA, 20 bp, Artificial Sequence
  chemically synthesized
tggaaaaatggagcatgact

SEQ ID NO: 48199 - DNA, 20 bp, Artificial Sequence
  chemically synthesized
ggaaaaatggagcatgactg

SEQ ID NO: 48200 - DNA, 20 bp, Artificial Sequence
  chemically synthesized
aaaatggagcatgactgagg

SEQ ID NO: 48201 - DNA, 20 bp, Artificial Sequence
  chemically synthesized
actgaggcagacacaaccgt

SEQ ID NO: 48202 - DNA, 20 bp, Artificial Sequence
  chemically synthesized
ctgaggcagacacaaccgtc

SEQ ID NO: 48203 - DNA, 20 bp, Artificial Sequence
  chemically synthesized
ggcagacacaaccgtcaggc

SEQ ID NO: 48204 - DNA, 20 bp, Artificial Sequence
  chemically synthesized
acacaaccgtcaggctggca

SEQ ID NO: 48205 - DNA, 20 bp, Artificial Sequence
  chemically synthesized
cacaaccgtcaggctggcat

SEQ ID NO: 48206 - DNA, 20 bp, Artificial Sequence
  chemically synthesized
acaaccgtcaggctggcatg

SEQ ID NO: 48207 - DNA, 20 bp, Artificial Sequence
  chemically synthesized
caaccgtcaggctggcatgg

SEQ ID NO: 48208 - DNA, 20 bp, Artificial Sequence
  chemically synthesized
aaccgtcaggctggcatggg

SEQ ID NO: 48209 - DNA, 20 bp, Artificial Sequence
  chemically synthesized
aggctggcatggggggccgt

SEQ ID NO: 48210 - DNA, 20 bp, Artificial Sequence
  chemically synthesized
tggcatggggggccgtgaga

SEQ ID NO: 48211 - DNA, 20 bp, Artificial Sequence
  chemically synthesized
ggcatggggggccgtgagac

SEQ ID NO: 48212 - DNA, 20 bp, Artificial Sequence
  chemically synthesized
gcatggggggccgtgagaca

SEQ ID NO: 48213 - DNA, 20 bp, Artificial Sequence
  chemically synthesized
tggggggccgtgagacaggg

SEQ ID NO: 48214 - DNA, 20 bp, Artificial Sequence
  chemically synthesized
gggggccgtgagacagggta

SEQ ID NO: 48215 - DNA, 20 bp, Artificial Sequence
  chemically synthesized
ggggccgtgagacagggtag

SEQ ID NO: 48216 - DNA, 20 bp, Artificial Sequence
  chemically synthesized
gccgtgagacagggtagagg

SEQ ID NO: 48217 - DNA, 20 bp, Artificial Sequence
  chemically synthesized
ccgtgagacagggtagaggt

SEQ ID NO: 48218 - DNA, 20 bp, Artificial Sequence
  chemically synthesized
cgtgagacagggtagaggtg

SEQ ID NO: 48219 - DNA, 20 bp, Artificial Sequence
  chemically synthesized
gagacagggtagaggtgggg

SEQ ID NO: 48220 - DNA, 20 bp, Artificial Sequence
  chemically synthesized
ggtggggaagcacatctgta

SEQ ID NO: 48221 - DNA, 20 bp, Artificial Sequence
  chemically synthesized
ggggaagcacatctgtaaag

SEQ ID NO: 48222 - DNA, 20 bp, Artificial Sequence
  chemically synthesized
ggaagcacatctgtaaagaa

SEQ ID NO: 48223 - DNA, 20 bp, Artificial Sequence
  chemically synthesized
aaagaagagctgtgctgcct

SEQ ID NO: 48224 - DNA, 20 bp, Artificial Sequence
  chemically synthesized
aagaagagctgtgctgcctc

SEQ ID NO: 48225 - DNA, 20 bp, Artificial Sequence
  chemically synthesized
aagagctgtgctgcctcagg

SEQ ID NO: 48226 - DNA, 20 bp, Artificial Sequence
  chemically synthesized
agagctgtgctgcctcaggc

SEQ ID NO: 48227 - DNA, 20 bp, Artificial Sequence
  chemically synthesized
gccgcttcacctctctgaac

SEQ ID NO: 48228 - DNA, 20 bp, Artificial Sequence
  chemically synthesized
ccgcttcacctctctgaacc

SEQ ID NO: 48229 - DNA, 20 bp, Artificial Sequence
  chemically synthesized
actgtttcacctgcatccca

SEQ ID NO: 48230 - DNA, 20 bp, Artificial Sequence
  chemically synthesized
tgtttcacctgcatcccaaa

SEQ ID NO: 48231 - DNA, 20 bp, Artificial Sequence
  chemically synthesized
tcacctgcatcccaaagagt

SEQ ID NO: 48232 - DNA, 20 bp, Artificial Sequence
  chemically synthesized
cctgcatcccaaagagttgg

SEQ ID NO: 48233 - DNA, 20 bp, Artificial Sequence
  chemically synthesized
gagttggaagtttcattccc

SEQ ID NO: 48234 - DNA, 20 bp, Artificial Sequence
  chemically synthesized
cattcccaagcatgcttgtg

SEQ ID NO: 48235 - DNA, 20 bp, Artificial Sequence
  chemically synthesized
agcatgcttgtgaagtgcct

SEQ ID NO: 48236 - DNA, 20 bp, Artificial Sequence
  chemically synthesized
gcatgcttgtgaagtgcctc

SEQ ID NO: 48237 - DNA, 20 bp, Artificial Sequence
  chemically synthesized
cttgtgaagtgcctcgggtg

SEQ ID NO: 48238 - DNA, 20 bp, Artificial Sequence
  chemically synthesized
agtgcctcgggtgaagtgcc

SEQ ID NO: 48239 - DNA, 20 bp, Artificial Sequence
  chemically synthesized
cgggtgaagtgcctggcaca

SEQ ID NO: 48240 - DNA, 20 bp, Artificial Sequence
  chemically synthesized
gtgaagtgcctggcacacag

SEQ ID NO: 48241 - DNA, 20 bp, Artificial Sequence
  chemically synthesized
tgaagtgcctggcacacagt

SEQ ID NO: 48242 - DNA, 20 bp, Artificial Sequence
  chemically synthesized
cacacagtaggctctttatg

SEQ ID NO: 48243 - DNA, 20 bp, Artificial Sequence
  chemically synthesized
acacagtaggctctttatgt

SEQ ID NO: 48244 - DNA, 20 bp, Artificial Sequence
  chemically synthesized
gctctttatgtgggtctgca

SEQ ID NO: 48245 - DNA, 20 bp, Artificial Sequence
  chemically synthesized
ggtctgcacagccctctgct

SEQ ID NO: 48246 - DNA, 20 bp, Artificial Sequence
  chemically synthesized
cctctgcttagtctgccccc

SEQ ID NO: 48247 - DNA, 20 bp, Artificial Sequence
  chemically synthesized
ctctgcttagtctgcccccc

SEQ ID NO: 48248 - DNA, 20 bp, Artificial Sequence
  chemically synthesized
agtctgccccccaggctgct

SEQ ID NO: 48249 - DNA, 20 bp, Artificial Sequence
  chemically synthesized
tctgccccccaggctgctca

SEQ ID NO: 48250 - DNA, 20 bp, Artificial Sequence
  chemically synthesized
gccccccaggctgctcagag

SEQ ID NO: 48251 - DNA, 20 bp, Artificial Sequence
  chemically synthesized
ccccccaggctgctcagagc

SEQ ID NO: 48252 - DNA, 20 bp, Artificial Sequence
  chemically synthesized
ccccaggctgctcagagcag

SEQ ID NO: 48253 - DNA, 20 bp, Artificial Sequence
  chemically synthesized
cccaggctgctcagagcagg

SEQ ID NO: 48254 - DNA, 20 bp, Artificial Sequence
  chemically synthesized
caggctgctcagagcaggag

SEQ ID NO: 48255 - DNA, 20 bp, Artificial Sequence
  chemically synthesized
aggctgctcagagcaggagg

SEQ ID NO: 48256 - DNA, 20 bp, Artificial Sequence
  chemically synthesized
ggaggaggttcaattttgac

SEQ ID NO: 48257 - DNA, 20 bp, Artificial Sequence
  chemically synthesized
ggttcaattttgaccagcct

SEQ ID NO: 48258 - DNA, 20 bp, Artificial Sequence
  chemically synthesized
gttcaattttgaccagcctc

SEQ ID NO: 48259 - DNA, 20 bp, Artificial Sequence
  chemically synthesized
cctgtttctgtttttgctcc

SEQ ID NO: 48260 - DNA, 20 bp, Artificial Sequence
  chemically synthesized
tgtttttgctcctggaaaac

SEQ ID NO: 48261 - DNA, 20 bp, Artificial Sequence
  chemically synthesized
aaaccagtgtgatccgtata

SEQ ID NO: 48262 - DNA, 20 bp, Artificial Sequence
  chemically synthesized
agtgtgatccgtatacagct

SEQ ID NO: 48263 - DNA, 20 bp, Artificial Sequence
  chemically synthesized
tgtgatccgtatacagcttg

SEQ ID NO: 48264 - DNA, 20 bp, Artificial Sequence
  chemically synthesized
tatacagcttggagtttctt

SEQ ID NO: 48265 - DNA, 20 bp, Artificial Sequence
  chemically synthesized
ttggagtttctttggataca

SEQ ID NO: 48266 - DNA, 20 bp, Artificial Sequence
  chemically synthesized
tggatacatggcccccactc

SEQ ID NO: 48267 - DNA, 20 bp, Artificial Sequence
  chemically synthesized
ggatacatggcccccactct

SEQ ID NO: 48268 - DNA, 20 bp, Artificial Sequence
  chemically synthesized
gatacatggcccccactctg

SEQ ID NO: 48269 - DNA, 20 bp, Artificial Sequence
  chemically synthesized
ggcccccactctggggttgt

SEQ ID NO: 48270 - DNA, 20 bp, Artificial Sequence
  chemically synthesized
cccccactctggggttgttg

SEQ ID NO: 48271 - DNA, 20 bp, Artificial Sequence
  chemically synthesized
ccccactctggggttgttgg

SEQ ID NO: 48272 - DNA, 20 bp, Artificial Sequence
  chemically synthesized
ctggggttgttggaggcctt

SEQ ID NO: 48273 - DNA, 20 bp, Artificial Sequence
  chemically synthesized
ggggttgttggaggcctttg

SEQ ID NO: 48274 - DNA, 20 bp, Artificial Sequence
  chemically synthesized
tggaggcctttggagactgc

SEQ ID NO: 48275 - DNA, 20 bp, Artificial Sequence
  chemically synthesized
ggaggcctttggagactgct

SEQ ID NO: 48276 - DNA, 20 bp, Artificial Sequence
  chemically synthesized
gaggcctttggagactgctg

SEQ ID NO: 48277 - DNA, 20 bp, Artificial Sequence
  chemically synthesized
aggcctttggagactgctgg

SEQ ID NO: 48278 - DNA, 20 bp, Artificial Sequence
  chemically synthesized
cctttggagactgctggggg

SEQ ID NO: 48279 - DNA, 20 bp, Artificial Sequence
  chemically synthesized
tttggagactgctgggggtg

SEQ ID NO: 48280 - DNA, 20 bp, Artificial Sequence
  chemically synthesized
ttggagactgctgggggtgg

SEQ ID NO: 48281 - DNA, 20 bp, Artificial Sequence
  chemically synthesized
tggagactgctgggggtgga

SEQ ID NO: 48282 - DNA, 20 bp, Artificial Sequence
  chemically synthesized
ggagactgctgggggtggag

SEQ ID NO: 48283 - DNA, 20 bp, Artificial Sequence
  chemically synthesized
agactgctgggggtggaggg

SEQ ID NO: 48284 - DNA, 20 bp, Artificial Sequence
  chemically synthesized
gactgctgggggtggagggg

SEQ ID NO: 48285 - DNA, 20 bp, Artificial Sequence
  chemically synthesized
actgctgggggtggagggga

SEQ ID NO: 48286 - DNA, 20 bp, Artificial Sequence
  chemically synthesized
ctgctgggggtggaggggag

SEQ ID NO: 48287 - DNA, 20 bp, Artificial Sequence
  chemically synthesized
gctgggggtggaggggaggg

SEQ ID NO: 48288 - DNA, 20 bp, Artificial Sequence
  chemically synthesized
ctgggggtggaggggagggg

SEQ ID NO: 48289 - DNA, 20 bp, Artificial Sequence
  chemically synthesized
ggtggaggggaggggaggta

SEQ ID NO: 48290 - DNA, 20 bp, Artificial Sequence
  chemically synthesized
gtggaggggaggggaggtac

SEQ ID NO: 48291 - DNA, 20 bp, Artificial Sequence
  chemically synthesized
tggaggggaggggaggtaca

SEQ ID NO: 48292 - DNA, 20 bp, Artificial Sequence
  chemically synthesized
gggaggggaggtacagggtt

SEQ ID NO: 48293 - DNA, 20 bp, Artificial Sequence
  chemically synthesized
ggaggggaggtacagggttg

SEQ ID NO: 48294 - DNA, 20 bp, Artificial Sequence
  chemically synthesized
gggaggtacagggttgaggc

SEQ ID NO: 48295 - DNA, 20 bp, Artificial Sequence
  chemically synthesized
aggtacagggttgaggctag

SEQ ID NO: 48296 - DNA, 20 bp, Artificial Sequence
  chemically synthesized
ggtacagggttgaggctagt

SEQ ID NO: 48297 - DNA, 20 bp, Artificial Sequence
  chemically synthesized
gtacagggttgaggctagtg

SEQ ID NO: 48298 - DNA, 20 bp, Artificial Sequence
  chemically synthesized
cttgattgcaatccctttaa

SEQ ID NO: 48299 - DNA, 20 bp, Artificial Sequence
  chemically synthesized
atccctttaaaagcctaaat

SEQ ID NO: 48300 - DNA, 20 bp, Artificial Sequence
  chemically synthesized
gtgcaacccgcaaacctgct

SEQ ID NO: 48301 - DNA, 20 bp, Artificial Sequence
  chemically synthesized
tgcaacccgcaaacctgctt

SEQ ID NO: 48302 - DNA, 20 bp, Artificial Sequence
  chemically synthesized
caacccgcaaacctgcttgg

SEQ ID NO: 48303 - DNA, 20 bp, Artificial Sequence
  chemically synthesized
ccgcaaacctgcttgggagc

SEQ ID NO: 48304 - DNA, 20 bp, Artificial Sequence
  chemically synthesized
gggagctggcgtacgtgccg

SEQ ID NO: 48305 - DNA, 20 bp, Artificial Sequence
  chemically synthesized
gtacgtgccgtagatacttg

SEQ ID NO: 48306 - DNA, 20 bp, Artificial Sequence
  chemically synthesized
acgtgccgtagatacttgca

SEQ ID NO: 48307 - DNA, 20 bp, Artificial Sequence
  chemically synthesized
gtagatacttgcagagtgaa

SEQ ID NO: 48308 - DNA, 20 bp, Artificial Sequence
  chemically synthesized
tacttgcagagtgaatggat

SEQ ID NO: 48309 - DNA, 20 bp, Artificial Sequence
  chemically synthesized
ttgccccttctgtcattcac

SEQ ID NO: 48310 - DNA, 20 bp, Artificial Sequence
  chemically synthesized
tcccatttatgcctccacct

SEQ ID NO: 48311 - DNA, 20 bp, Artificial Sequence
  chemically synthesized
cccatttatgcctccacctt

SEQ ID NO: 48312 - DNA, 20 bp, Artificial Sequence
  chemically synthesized
ccatttatgcctccaccttg

SEQ ID NO: 48313 - DNA, 20 bp, Artificial Sequence
  chemically synthesized
cctccaccttggggctctac

SEQ ID NO: 48314 - DNA, 20 bp, Artificial Sequence
  chemically synthesized
ctccaccttggggctctacc

SEQ ID NO: 48315 - DNA, 20 bp, Artificial Sequence
  chemically synthesized
accttggggctctaccaggc

SEQ ID NO: 48316 - DNA, 20 bp, Artificial Sequence
  chemically synthesized
tctaccaggcgagtgaccca

SEQ ID NO: 48317 - DNA, 20 bp, Artificial Sequence
  chemically synthesized
ctaccaggcgagtgacccac

SEQ ID NO: 48318 - DNA, 20 bp, Artificial Sequence
  chemically synthesized
gagtgacccacaggatcctc

SEQ ID NO: 48319 - DNA, 20 bp, Artificial Sequence
  chemically synthesized
gatcctccagcacacacatt

SEQ ID NO: 48320 - DNA, 20 bp, Artificial Sequence
  chemically synthesized
tccagcacacacattcagac

SEQ ID NO: 48321 - DNA, 20 bp, Artificial Sequence
  chemically synthesized
ccagcacacacattcagacc

SEQ ID NO: 48322 - DNA, 20 bp, Artificial Sequence
  chemically synthesized
cagcacacacattcagacca

SEQ ID NO: 48323 - DNA, 20 bp, Artificial Sequence
  chemically synthesized
agaccagggaacccacttac

SEQ ID NO: 48324 - DNA, 20 bp, Artificial Sequence
  chemically synthesized
ggaacccacttactggctgt

SEQ ID NO: 48325 - DNA, 20 bp, Artificial Sequence
  chemically synthesized
gaacccacttactggctgtg

SEQ ID NO: 48326 - DNA, 20 bp, Artificial Sequence
  chemically synthesized
acttactggctgtgaggcct

SEQ ID NO: 48327 - DNA, 20 bp, Artificial Sequence
  chemically synthesized
cttactggctgtgaggcctc

SEQ ID NO: 48328 - DNA, 20 bp, Artificial Sequence
  chemically synthesized
ctggctgtgaggcctcaggt

SEQ ID NO: 48329 - DNA, 20 bp, Artificial Sequence
  chemically synthesized
gtgagttgtttaaccgctcc

SEQ ID NO: 48330 - DNA, 20 bp, Artificial Sequence
  chemically synthesized
caatttccctatctgtaaaa

SEQ ID NO: 48331 - DNA, 20 bp, Artificial Sequence
  chemically synthesized
aatttccctatctgtaaaat

SEQ ID NO: 48332 - DNA, 20 bp, Artificial Sequence
  chemically synthesized
atttccctatctgtaaaatg

SEQ ID NO: 48333 - DNA, 20 bp, Artificial Sequence
  chemically synthesized
ccctatctgtaaaatgggga

SEQ ID NO: 48334 - DNA, 20 bp, Artificial Sequence
  chemically synthesized
ctgtaaaatggggatggtga

SEQ ID NO: 48335 - DNA, 20 bp, Artificial Sequence
  chemically synthesized
gtgacggtatgtaccttgtt

SEQ ID NO: 48336 - DNA, 20 bp, Artificial Sequence
  chemically synthesized
gtaccttgttgagctgctgt

SEQ ID NO: 48337 - DNA, 20 bp, Artificial Sequence
  chemically synthesized
taccttgttgagctgctgtg

SEQ ID NO: 48338 - DNA, 20 bp, Artificial Sequence
  chemically synthesized
ctgtgaggattaaaatgcaa

SEQ ID NO: 48339 - DNA, 20 bp, Artificial Sequence
  chemically synthesized
ggattaaaatgcaacagttc

SEQ ID NO: 48340 - DNA, 20 bp, Artificial Sequence
  chemically synthesized
gattaaaatgcaacagttca

SEQ ID NO: 48341 - DNA, 20 bp, Artificial Sequence
  chemically synthesized
aaaatgcaacagttcaagga

SEQ ID NO: 48342 - DNA, 20 bp, Artificial Sequence
  chemically synthesized
gcaacagttcaaggaaagct

SEQ ID NO: 48343 - DNA, 20 bp, Artificial Sequence
  chemically synthesized
aacagttcaaggaaagctca

SEQ ID NO: 48344 - DNA, 20 bp, Artificial Sequence
  chemically synthesized
gttcaaggaaagctcagaga

SEQ ID NO: 48345 - DNA, 20 bp, Artificial Sequence
  chemically synthesized
ttcaaggaaagctcagagac

SEQ ID NO: 48346 - DNA, 20 bp, Artificial Sequence
  chemically synthesized
gaaagctcagagacgggtac

SEQ ID NO: 48347 - DNA, 20 bp, Artificial Sequence
  chemically synthesized
aaagctcagagacgggtact

SEQ ID NO: 48348 - DNA, 20 bp, Artificial Sequence
  chemically synthesized
agacgggtactgggtgtgcc

SEQ ID NO: 48349 - DNA, 20 bp, Artificial Sequence
  chemically synthesized
gggtactgggtgtgcccaga

SEQ ID NO: 48350 - DNA, 20 bp, Artificial Sequence
  chemically synthesized
ctgccctccctcccccgtgt

SEQ ID NO: 48351 - DNA, 20 bp, Artificial Sequence
  chemically synthesized
tgccctccctcccccgtgtc

SEQ ID NO: 48352 - DNA, 20 bp, Artificial Sequence
  chemically synthesized
gccctccctcccccgtgtca

SEQ ID NO: 48353 - DNA, 20 bp, Artificial Sequence
  chemically synthesized
ccctccctcccccgtgtcag

SEQ ID NO: 48354 - DNA, 20 bp, Artificial Sequence
  chemically synthesized
ccctcccccgtgtcaggggc

SEQ ID NO: 48355 - DNA, 20 bp, Artificial Sequence
  chemically synthesized
gtgtcaggggctggtgtcac

SEQ ID NO: 48356 - DNA, 20 bp, Artificial Sequence
  chemically synthesized
tgtcaggggctggtgtcact

SEQ ID NO: 48357 - DNA, 20 bp, Artificial Sequence
  chemically synthesized
gtcaggggctggtgtcactg

SEQ ID NO: 48358 - DNA, 20 bp, Artificial Sequence
  chemically synthesized
aggggctggtgtcactgggg

SEQ ID NO: 48359 - DNA, 20 bp, Artificial Sequence
  chemically synthesized
ggggctggtgtcactggggt

SEQ ID NO: 48360 - DNA, 20 bp, Artificial Sequence
  chemically synthesized
gggctggtgtcactggggtg

SEQ ID NO: 48361 - DNA, 20 bp, Artificial Sequence
  chemically synthesized
ctggtgtcactggggtgggg

SEQ ID NO: 48362 - DNA, 20 bp, Artificial Sequence
  chemically synthesized
tggtgtcactggggtggggt

SEQ ID NO: 48363 - DNA, 20 bp, Artificial Sequence
  chemically synthesized
ggtggggtgggccacacttg

SEQ ID NO: 48364 - DNA, 20 bp, Artificial Sequence
  chemically synthesized
tggggtgggccacacttgaa

SEQ ID NO: 48365 - DNA, 20 bp, Artificial Sequence
  chemically synthesized
acacttgaagagctttcctc

SEQ ID NO: 48366 - DNA, 20 bp, Artificial Sequence
  chemically synthesized
cacttgaagagctttcctcc

SEQ ID NO: 48367 - DNA, 20 bp, Artificial Sequence
  chemically synthesized
ttgaagagctttcctccagg

SEQ ID NO: 48368 - DNA, 20 bp, Artificial Sequence
  chemically synthesized
cctccaggcagtctctcatt

SEQ ID NO: 48369 - DNA, 20 bp, Artificial Sequence
  chemically synthesized
tctcattcagttaccctgtg

SEQ ID NO: 48370 - DNA, 20 bp, Artificial Sequence
  chemically synthesized
ctcattcagttaccctgtga

SEQ ID NO: 48371 - DNA, 20 bp, Artificial Sequence
  chemically synthesized
tcattcagttaccctgtgaa

SEQ ID NO: 48372 - DNA, 20 bp, Artificial Sequence
  chemically synthesized
attcagttaccctgtgaagg

SEQ ID NO: 48373 - DNA, 20 bp, Artificial Sequence
  chemically synthesized
cagttaccctgtgaagggag

SEQ ID NO: 48374 - DNA, 20 bp, Artificial Sequence
  chemically synthesized
agttaccctgtgaagggagt

SEQ ID NO: 48375 - DNA, 20 bp, Artificial Sequence
  chemically synthesized
agtaggtaccaccctccttt

SEQ ID NO: 48376 - DNA, 20 bp, Artificial Sequence
  chemically synthesized
gtaggtaccaccctcctttc

SEQ ID NO: 48377 - DNA, 20 bp, Artificial Sequence
  chemically synthesized
ggtaccaccctcctttcagg

SEQ ID NO: 48378 - DNA, 20 bp, Artificial Sequence
  chemically synthesized
accaccctcctttcaggcag

SEQ ID NO: 48379 - DNA, 20 bp, Artificial Sequence
  chemically synthesized
ccaccctcctttcaggcagc

SEQ ID NO: 48380 - DNA, 20 bp, Artificial Sequence
  chemically synthesized
ctttcaggcagcgggaaact

SEQ ID NO: 48381 - DNA, 20 bp, Artificial Sequence
  chemically synthesized
aggcagcgggaaactgagct

SEQ ID NO: 48382 - DNA, 20 bp, Artificial Sequence
  chemically synthesized
actcccctccccttctctct

SEQ ID NO: 48383 - DNA, 20 bp, Artificial Sequence
  chemically synthesized
tctctgagctcccttccctg

SEQ ID NO: 48384 - DNA, 20 bp, Artificial Sequence
  chemically synthesized
ttccctgcagctccatcccc

SEQ ID NO: 48385 - DNA, 20 bp, Artificial Sequence
  chemically synthesized
gcagctccatcccctggctt

SEQ ID NO: 48386 - DNA, 20 bp, Artificial Sequence
  chemically synthesized
cagctccatcccctggcttc

SEQ ID NO: 48387 - DNA, 20 bp, Artificial Sequence
  chemically synthesized
agctccatcccctggcttca

SEQ ID NO: 48388 - DNA, 20 bp, Artificial Sequence
  chemically synthesized
agggcccctgtccttcccct

SEQ ID NO: 48389 - DNA, 20 bp, Artificial Sequence
  chemically synthesized
cccctgtccttcccctgagc

SEQ ID NO: 48390 - DNA, 20 bp, Artificial Sequence
  chemically synthesized
cttcccctgagctggctgaa

SEQ ID NO: 48391 - DNA, 20 bp, Artificial Sequence
  chemically synthesized
cgctgctctacatccactca

SEQ ID NO: 48392 - DNA, 20 bp, Artificial Sequence
  chemically synthesized
tctacatccactcacagctc

SEQ ID NO: 48393 - DNA, 20 bp, Artificial Sequence
  chemically synthesized
tccactcacagctccagcac

SEQ ID NO: 48394 - DNA, 20 bp, Artificial Sequence
  chemically synthesized
ccactcacagctccagcact

SEQ ID NO: 48395 - DNA, 20 bp, Artificial Sequence
  chemically synthesized
acagctccagcactgggctg

SEQ ID NO: 48396 - DNA, 20 bp, Artificial Sequence
  chemically synthesized
tccagcactgggctgtggtt

SEQ ID NO: 48397 - DNA, 20 bp, Artificial Sequence
  chemically synthesized
ccagcactgggctgtggttg

SEQ ID NO: 48398 - DNA, 20 bp, Artificial Sequence
  chemically synthesized
tggttgaggtcgcctgccct

SEQ ID NO: 48399 - DNA, 20 bp, Artificial Sequence
  chemically synthesized
ttgaggtcgcctgccctcgg

SEQ ID NO: 48400 - DNA, 20 bp, Artificial Sequence
  chemically synthesized
cgcctgccctcggtagctcc

SEQ ID NO: 48401 - DNA, 20 bp, Artificial Sequence
  chemically synthesized
gcctgccctcggtagctcct

SEQ ID NO: 48402 - DNA, 20 bp, Artificial Sequence
  chemically synthesized
tgggcatttcttcccctctc

SEQ ID NO: 48403 - DNA, 20 bp, Artificial Sequence
  chemically synthesized
gggcatttcttcccctctct

SEQ ID NO: 48404 - DNA, 20 bp, Artificial Sequence
  chemically synthesized
tgcacaatgacccccactct

SEQ ID NO: 48405 - DNA, 20 bp, Artificial Sequence
  chemically synthesized
cctgctgtccctcccacctg

SEQ ID NO: 48406 - DNA, 20 bp, Artificial Sequence
  chemically synthesized
tccctcccacctgtggaact

SEQ ID NO: 48407 - DNA, 20 bp, Artificial Sequence
  chemically synthesized
tcccacctgtggaactgagt

SEQ ID NO: 48408 - DNA, 20 bp, Artificial Sequence
  chemically synthesized
cacctgtggaactgagtgag

SEQ ID NO: 48409 - DNA, 20 bp, Artificial Sequence
  chemically synthesized
ctgtggaactgagtgagcag

SEQ ID NO: 48410 - DNA, 20 bp, Artificial Sequence
  chemically synthesized
tggaactgagtgagcagcag

SEQ ID NO: 48411 - DNA, 20 bp, Artificial Sequence
  chemically synthesized
ccacctttcctgctctcctc

SEQ ID NO: 48412 - DNA, 20 bp, Artificial Sequence
  chemically synthesized
gctctcctcaagctctcctc

SEQ ID NO: 48413 - DNA, 20 bp, Artificial Sequence
  chemically synthesized
tcctcaagctctgtctcttc

SEQ ID NO: 48414 - DNA, 20 bp, Artificial Sequence
  chemically synthesized
tcaagctctgtctcttctgg

SEQ ID NO: 48415 - DNA, 20 bp, Artificial Sequence
  chemically synthesized
caagctctgtctcttctggc

SEQ ID NO: 48416 - DNA, 20 bp, Artificial Sequence
  chemically synthesized
tctgtctcttctggcaggca

SEQ ID NO: 48417 - DNA, 20 bp, Artificial Sequence
  chemically synthesized
ctgtctcttctggcaggcac

SEQ ID NO: 48418 - DNA, 20 bp, Artificial Sequence
  chemically synthesized
gtctcttctggcaggcacag

SEQ ID NO: 48419 - DNA, 20 bp, Artificial Sequence
  chemically synthesized
ctcttctggcaggcacagga

SEQ ID NO: 48420 - DNA, 20 bp, Artificial Sequence
  chemically synthesized
ttctggcaggcacaggagag

SEQ ID NO: 48421 - DNA, 20 bp, Artificial Sequence
  chemically synthesized
aggcacaggagagtggcctg

SEQ ID NO: 48422 - DNA, 20 bp, Artificial Sequence
  chemically synthesized
ggcacaggagagtggcctga

SEQ ID NO: 48423 - DNA, 20 bp, Artificial Sequence
  chemically synthesized
caggagagtggcctgaaggc

SEQ ID NO: 48424 - DNA, 20 bp, Artificial Sequence
  chemically synthesized
gagagtggcctgaaggctgg

SEQ ID NO: 48425 - DNA, 20 bp, Artificial Sequence
  chemically synthesized
agagtggcctgaaggctggc

SEQ ID NO: 48426 - DNA, 20 bp, Artificial Sequence
  chemically synthesized
agtggcctgaaggctggcag

SEQ ID NO: 48427 - DNA, 20 bp, Artificial Sequence
  chemically synthesized
gtggcctgaaggctggcagg

SEQ ID NO: 48428 - DNA, 20 bp, Artificial Sequence
  chemically synthesized
aggttgccgcccctccaacc

SEQ ID NO: 48429 - DNA, 20 bp, Artificial Sequence
  chemically synthesized
cccctccaacctggaattcc

SEQ ID NO: 48430 - DNA, 20 bp, Artificial Sequence
  chemically synthesized
ctccaacctggaattcctgg

SEQ ID NO: 48431 - DNA, 20 bp, Artificial Sequence
  chemically synthesized
caacctggaattcctggcag

SEQ ID NO: 48432 - DNA, 20 bp, Artificial Sequence
  chemically synthesized
cctggaattcctggcagcag

SEQ ID NO: 48433 - DNA, 20 bp, Artificial Sequence
  chemically synthesized
ggaattcctggcagcagcag

SEQ ID NO: 48434 - DNA, 20 bp, Artificial Sequence
  chemically synthesized
ttcctggcagcagcagcggc

SEQ ID NO: 48435 - DNA, 20 bp, Artificial Sequence
  chemically synthesized
tcctggcagcagcagcggct

SEQ ID NO: 48436 - DNA, 20 bp, Artificial Sequence
  chemically synthesized
agcagcggctaggccttcct

SEQ ID NO: 48437 - DNA, 20 bp, Artificial Sequence
  chemically synthesized
cagcggctaggccttcctcg

SEQ ID NO: 48438 - DNA, 20 bp, Artificial Sequence
  chemically synthesized
agcggctaggccttcctcgg

SEQ ID NO: 48439 - DNA, 20 bp, Artificial Sequence
  chemically synthesized
cccgaccccctcctccttct

SEQ ID NO: 48440 - DNA, 20 bp, Artificial Sequence
  chemically synthesized
ccccctcctccttcttggtt

SEQ ID NO: 48441 - DNA, 20 bp, Artificial Sequence
  chemically synthesized
tcctccttcttggttcagct

SEQ ID NO: 48442 - DNA, 20 bp, Artificial Sequence
  chemically synthesized
cctccttcttggttcagctc

SEQ ID NO: 48443 - DNA, 20 bp, Artificial Sequence
  chemically synthesized
ttggttcagctcaggactct

SEQ ID NO: 48444 - DNA, 20 bp, Artificial Sequence
  chemically synthesized
tggttcagctcaggactctg

SEQ ID NO: 48445 - DNA, 20 bp, Artificial Sequence
  chemically synthesized
ggttcagctcaggactctga

SEQ ID NO: 48446 - DNA, 20 bp, Artificial Sequence
  chemically synthesized
ggactctgagggttgctgcg

SEQ ID NO: 48447 - DNA, 20 bp, Artificial Sequence
  chemically synthesized
actctgagggttgctgcgtg

SEQ ID NO: 48448 - DNA, 20 bp, Artificial Sequence
  chemically synthesized
ctctgagggttgctgcgtgg

SEQ ID NO: 48449 - DNA, 20 bp, Artificial Sequence
  chemically synthesized
tgagggttgctgcgtggagg

SEQ ID NO: 48450 - DNA, 20 bp, Artificial Sequence
  chemically synthesized
cgtggaggcagtgcatgccc

SEQ ID NO: 48451 - DNA, 20 bp, Artificial Sequence
  chemically synthesized
gtggaggcagtgcatgccct

SEQ ID NO: 48452 - DNA, 20 bp, Artificial Sequence
  chemically synthesized
ggcagtgcatgccctgggca

SEQ ID NO: 48453 - DNA, 20 bp, Artificial Sequence
  chemically synthesized
catgccctgggcacagtgcc

SEQ ID NO: 48454 - DNA, 20 bp, Artificial Sequence
  chemically synthesized
gtgcccagttcctgcccacc

SEQ ID NO: 48455 - DNA, 20 bp, Artificial Sequence
  chemically synthesized
tgcccagttcctgcccaccc

SEQ ID NO: 48456 - DNA, 20 bp, Artificial Sequence
  chemically synthesized
ccagttcctgcccacccagg

SEQ ID NO: 48457 - DNA, 20 bp, Artificial Sequence
  chemically synthesized
gttcctgcccacccaggaag

SEQ ID NO: 48458 - DNA, 20 bp, Artificial Sequence
  chemically synthesized
cccacccaggaagtagactt

SEQ ID NO: 48459 - DNA, 20 bp, Artificial Sequence
  chemically synthesized
ccacccaggaagtagacttc

SEQ ID NO: 48460 - DNA, 20 bp, Artificial Sequence
  chemically synthesized
cccaggaagtagacttcggg

SEQ ID NO: 48461 - DNA, 20 bp, Artificial Sequence
  chemically synthesized
caggaagtagacttcgggtg

SEQ ID NO: 48462 - DNA, 20 bp, Artificial Sequence
  chemically synthesized
aggaagtagacttcgggtgg

SEQ ID NO: 48463 - DNA, 20 bp, Artificial Sequence
  chemically synthesized
aagtagacttcgggtggagg

SEQ ID NO: 48464 - DNA, 20 bp, Artificial Sequence
  chemically synthesized
tagacttcgggtggaggcag

SEQ ID NO: 48465 - DNA, 20 bp, Artificial Sequence
  chemically synthesized
agacttcgggtggaggcagt

SEQ ID NO: 48466 - DNA, 20 bp, Artificial Sequence
  chemically synthesized
ttcgggtggaggcagtaggc

SEQ ID NO: 48467 - DNA, 20 bp, Artificial Sequence
  chemically synthesized
tcgggtggaggcagtaggct

SEQ ID NO: 48468 - DNA, 20 bp, Artificial Sequence
  chemically synthesized
cgggtggaggcagtaggctg

SEQ ID NO: 48469 - DNA, 20 bp, Artificial Sequence
  chemically synthesized
ggtggaggcagtaggctggg

SEQ ID NO: 48470 - DNA, 20 bp, Artificial Sequence
  chemically synthesized
gtggaggcagtaggctgggg

SEQ ID NO: 48471 - DNA, 20 bp, Artificial Sequence
  chemically synthesized
tggaggcagtaggctgggga

SEQ ID NO: 48472 - DNA, 20 bp, Artificial Sequence
  chemically synthesized
ggaggcagtaggctggggag

SEQ ID NO: 48473 - DNA, 20 bp, Artificial Sequence
  chemically synthesized
ggcagtaggctggggagggg

SEQ ID NO: 48474 - DNA, 20 bp, Artificial Sequence
  chemically synthesized
gcagtaggctggggaggggc

SEQ ID NO: 48475 - DNA, 20 bp, Artificial Sequence
  chemically synthesized
cagtaggctggggaggggcg

SEQ ID NO: 48476 - DNA, 20 bp, Artificial Sequence
  chemically synthesized
gtaggctggggaggggcggg

SEQ ID NO: 48477 - DNA, 20 bp, Artificial Sequence
  chemically synthesized
ctggggaggggcggggagct

SEQ ID NO: 48478 - DNA, 20 bp, Artificial Sequence
  chemically synthesized
ggaggggcggggagcttgga

SEQ ID NO: 48479 - DNA, 20 bp, Artificial Sequence
  chemically synthesized
gaggggcggggagcttggac

SEQ ID NO: 48480 - DNA, 20 bp, Artificial Sequence
  chemically synthesized
gggcggggagcttggacagg

SEQ ID NO: 48481 - DNA, 20 bp, Artificial Sequence
  chemically synthesized
ggcggggagcttggacagga

SEQ ID NO: 48482 - DNA, 20 bp, Artificial Sequence
  chemically synthesized
cggggagcttggacaggaag

SEQ ID NO: 48483 - DNA, 20 bp, Artificial Sequence
  chemically synthesized
aaggagccttgctcattgcc

SEQ ID NO: 48484 - DNA, 20 bp, Artificial Sequence
  chemically synthesized
gagccttgctcattgcccgg

SEQ ID NO: 48485 - DNA, 20 bp, Artificial Sequence
  chemically synthesized
gctcattgcccggcagacac

SEQ ID NO: 48486 - DNA, 20 bp, Artificial Sequence
  chemically synthesized
ttgcccggcagacacaagac

SEQ ID NO: 48487 - DNA, 20 bp, Artificial Sequence
  chemically synthesized
tgcccggcagacacaagact

SEQ ID NO: 48488 - DNA, 20 bp, Artificial Sequence
  chemically synthesized
agactgggccctcataaact

SEQ ID NO: 48489 - DNA, 20 bp, Artificial Sequence
  chemically synthesized
tgggccctcataaactcaga

SEQ ID NO: 48490 - DNA, 20 bp, Artificial Sequence
  chemically synthesized
cctcataaactcagacagcc

SEQ ID NO: 48491 - DNA, 20 bp, Artificial Sequence
  chemically synthesized
acctgttgtacctgcccttt

SEQ ID NO: 48492 - DNA, 20 bp, Artificial Sequence
  chemically synthesized
gccctttcagctctgtgacc

SEQ ID NO: 48493 - DNA, 20 bp, Artificial Sequence
  chemically synthesized
ccctttcagctctgtgaccc

SEQ ID NO: 48494 - DNA, 20 bp, Artificial Sequence
  chemically synthesized
tcagctctgtgacccgggac

SEQ ID NO: 48495 - DNA, 20 bp, Artificial Sequence
  chemically synthesized
acaagtcaccctctcccttt

SEQ ID NO: 48496 - DNA, 20 bp, Artificial Sequence
  chemically synthesized
ctctccctttgagttgccgc

SEQ ID NO: 48497 - DNA, 20 bp, Artificial Sequence
  chemically synthesized
ctccctttgagttgccgcaa

SEQ ID NO: 48498 - DNA, 20 bp, Artificial Sequence
  chemically synthesized
tccctttgagttgccgcaag

SEQ ID NO: 48499 - DNA, 20 bp, Artificial Sequence
  chemically synthesized
ttgagttgccgcaagaggta

SEQ ID NO: 48500 - DNA, 20 bp, Artificial Sequence
  chemically synthesized
agaggtacagtcacactgcc

SEQ ID NO: 48501 - DNA, 20 bp, Artificial Sequence
  chemically synthesized
aggtacagtcacactgccca

SEQ ID NO: 48502 - DNA, 20 bp, Artificial Sequence
  chemically synthesized
ggtacagtcacactgcccag

SEQ ID NO: 48503 - DNA, 20 bp, Artificial Sequence
  chemically synthesized
cacactgcccagaggattac

SEQ ID NO: 48504 - DNA, 20 bp, Artificial Sequence
  chemically synthesized
cagaggattactagaaatga

SEQ ID NO: 48505 - DNA, 20 bp, Artificial Sequence
  chemically synthesized
agaggattactagaaatgac

SEQ ID NO: 48506 - DNA, 20 bp, Artificial Sequence
  chemically synthesized
aatgacaggcctcgccctcc

SEQ ID NO: 48507 - DNA, 20 bp, Artificial Sequence
  chemically synthesized
caggcctcgccctcctggca

SEQ ID NO: 48508 - DNA, 20 bp, Artificial Sequence
  chemically synthesized
tcgccctcctggcacagacc

SEQ ID NO: 48509 - DNA, 20 bp, Artificial Sequence
  chemically synthesized
acagacctggcaccaataac

SEQ ID NO: 48510 - DNA, 20 bp, Artificial Sequence
  chemically synthesized
gacctggcaccaataactgg

SEQ ID NO: 48511 - DNA, 20 bp, Artificial Sequence
  chemically synthesized
acctggcaccaataactggc

SEQ ID NO: 48512 - DNA, 20 bp, Artificial Sequence
  chemically synthesized
accaataactggcaggtttc

SEQ ID NO: 48513 - DNA, 20 bp, Artificial Sequence
  chemically synthesized
ccaataactggcaggtttct

SEQ ID NO: 48514 - DNA, 20 bp, Artificial Sequence
  chemically synthesized
caataactggcaggtttctg

SEQ ID NO: 48515 - DNA, 20 bp, Artificial Sequence
  chemically synthesized
aactggcaggtttctggggc

SEQ ID NO: 48516 - DNA, 20 bp, Artificial Sequence
  chemically synthesized
caggtttctggggccagctg

SEQ ID NO: 48517 - DNA, 20 bp, Artificial Sequence
  chemically synthesized
ggtttctggggccagctgca

SEQ ID NO: 48518 - DNA, 20 bp, Artificial Sequence
  chemically synthesized
gtttctggggccagctgcag

SEQ ID NO: 48519 - DNA, 20 bp, Artificial Sequence
  chemically synthesized
tttctggggccagctgcaga

SEQ ID NO: 48520 - DNA, 20 bp, Artificial Sequence
  chemically synthesized
ctggggccagctgcagaggg

SEQ ID NO: 48521 - DNA, 20 bp, Artificial Sequence
  chemically synthesized
ggggccagctgcagagggaa

SEQ ID NO: 48522 - DNA, 20 bp, Artificial Sequence
  chemically synthesized
gggccagctgcagagggaag

SEQ ID NO: 48523 - DNA, 20 bp, Artificial Sequence
  chemically synthesized
gctgcagagggaagaggact

SEQ ID NO: 48524 - DNA, 20 bp, Artificial Sequence
  chemically synthesized
tgagccacctatgaaatgcc

SEQ ID NO: 48525 - DNA, 20 bp, Artificial Sequence
  chemically synthesized
gccacctatgaaatgcccag

SEQ ID NO: 48526 - DNA, 20 bp, Artificial Sequence
  chemically synthesized
ccacctatgaaatgcccagt

SEQ ID NO: 48527 - DNA, 20 bp, Artificial Sequence
  chemically synthesized
cctatgaaatgcccagtggg

SEQ ID NO: 48528 - DNA, 20 bp, Artificial Sequence
  chemically synthesized
atgcccagtgggcagcccca

SEQ ID NO: 48529 - DNA, 20 bp, Artificial Sequence
  chemically synthesized
ccagtgggcagccccacagt

SEQ ID NO: 48530 - DNA, 20 bp, Artificial Sequence
  chemically synthesized
cagtgggcagccccacagtt

SEQ ID NO: 48531 - DNA, 20 bp, Artificial Sequence
  chemically synthesized
tgggcagccccacagttggg

SEQ ID NO: 48532 - DNA, 20 bp, Artificial Sequence
  chemically synthesized
gggcagccccacagttgggc

SEQ ID NO: 48533 - DNA, 20 bp, Artificial Sequence
  chemically synthesized
ttgggcaggtctgtgtgcac

SEQ ID NO: 48534 - DNA, 20 bp, Artificial Sequence
  chemically synthesized
tgggcaggtctgtgtgcact

SEQ ID NO: 48535 - DNA, 20 bp, Artificial Sequence
  chemically synthesized
gggcaggtctgtgtgcactg

SEQ ID NO: 48536 - DNA, 20 bp, Artificial Sequence
  chemically synthesized
gcaggtctgtgtgcactggg

SEQ ID NO: 48537 - DNA, 20 bp, Artificial Sequence
  chemically synthesized
caggtctgtgtgcactgggg

SEQ ID NO: 48538 - DNA, 20 bp, Artificial Sequence
  chemically synthesized
cactggggaggtgtgtgtca

SEQ ID NO: 48539 - DNA, 20 bp, Artificial Sequence
  chemically synthesized
actggggaggtgtgtgtcat

SEQ ID NO: 48540 - DNA, 20 bp, Artificial Sequence
  chemically synthesized
gaggtgtgtgtcataggacc

SEQ ID NO: 48541 - DNA, 20 bp, Artificial Sequence
  chemically synthesized
tcctatgacacacacctccc

SEQ ID NO: 48542 - DNA, 20 bp, Artificial Sequence
  chemically synthesized
acacacctccccagtgcaca

SEQ ID NO: 48543 - DNA, 20 bp, Artificial Sequence
  chemically synthesized
cacacagacctgcccaactg

SEQ ID NO: 48544 - DNA, 20 bp, Artificial Sequence
  chemically synthesized
acacagacctgcccaactgt

SEQ ID NO: 48545 - DNA, 20 bp, Artificial Sequence
  chemically synthesized
cacagacctgcccaactgtg

SEQ ID NO: 48546 - DNA, 20 bp, Artificial Sequence
  chemically synthesized
ccaactgtggggctgcccac

SEQ ID NO: 48547 - DNA, 20 bp, Artificial Sequence
  chemically synthesized
caactgtggggctgcccact

SEQ ID NO: 48548 - DNA, 20 bp, Artificial Sequence
  chemically synthesized
gctgcccactgggcatttca

SEQ ID NO: 48549 - DNA, 20 bp, Artificial Sequence
  chemically synthesized
ctgcccactgggcatttcat

SEQ ID NO: 48550 - DNA, 20 bp, Artificial Sequence
  chemically synthesized
cccactgggcatttcatagg

SEQ ID NO: 48551 - DNA, 20 bp, Artificial Sequence
  chemically synthesized
tgggcatttcataggtggct

SEQ ID NO: 48552 - DNA, 20 bp, Artificial Sequence
  chemically synthesized
gctcagtcctcttccctctg

SEQ ID NO: 48553 - DNA, 20 bp, Artificial Sequence
  chemically synthesized
agtcctcttccctctgcagc

SEQ ID NO: 48554 - DNA, 20 bp, Artificial Sequence
  chemically synthesized
cttccctctgcagctggccc

SEQ ID NO: 48555 - DNA, 20 bp, Artificial Sequence
  chemically synthesized
agctggccccagaaacctgc

SEQ ID NO: 48556 - DNA, 20 bp, Artificial Sequence
  chemically synthesized
cccagaaacctgccagttat

SEQ ID NO: 48557 - DNA, 20 bp, Artificial Sequence
  chemically synthesized
aacctgccagttattggtgc

SEQ ID NO: 48558 - DNA, 20 bp, Artificial Sequence
  chemically synthesized
acctgccagttattggtgcc

SEQ ID NO: 48559 - DNA, 20 bp, Artificial Sequence
  chemically synthesized
tattggtgccaggtctgtgc

SEQ ID NO: 48560 - DNA, 20 bp, Artificial Sequence
  chemically synthesized
attggtgccaggtctgtgcc

SEQ ID NO: 48561 - DNA, 20 bp, Artificial Sequence
  chemically synthesized
tggtgccaggtctgtgccag

SEQ ID NO: 48562 - DNA, 20 bp, Artificial Sequence
  chemically synthesized
ggtgccaggtctgtgccagg

SEQ ID NO: 48563 - DNA, 20 bp, Artificial Sequence
  chemically synthesized
gtgccaggtctgtgccagga

SEQ ID NO: 48564 - DNA, 20 bp, Artificial Sequence
  chemically synthesized
caggtctgtgccaggagggc

SEQ ID NO: 48565 - DNA, 20 bp, Artificial Sequence
  chemically synthesized
aggtctgtgccaggagggcg

SEQ ID NO: 48566 - DNA, 20 bp, Artificial Sequence
  chemically synthesized
agggcgaggcctgtcatttc

SEQ ID NO: 48567 - DNA, 20 bp, Artificial Sequence
  chemically synthesized
tgtcatttctagtaatcctc

SEQ ID NO: 48568 - DNA, 20 bp, Artificial Sequence
  chemically synthesized
gtcatttctagtaatcctct

SEQ ID NO: 48569 - DNA, 20 bp, Artificial Sequence
  chemically synthesized
atttctagtaatcctctggg

SEQ ID NO: 48570 - DNA, 20 bp, Artificial Sequence
  chemically synthesized
cagtgtgactgtacctcttg

SEQ ID NO: 48571 - DNA, 20 bp, Artificial Sequence
  chemically synthesized
gtacctcttgcggcaactca

SEQ ID NO: 48572 - DNA, 20 bp, Artificial Sequence
  chemically synthesized
tacctcttgcggcaactcaa

SEQ ID NO: 48573 - DNA, 20 bp, Artificial Sequence
  chemically synthesized
acctcttgcggcaactcaaa

SEQ ID NO: 48574 - DNA, 20 bp, Artificial Sequence
  chemically synthesized
ctcttgcggcaactcaaagg

SEQ ID NO: 48575 - DNA, 20 bp, Artificial Sequence
  chemically synthesized
cttgcggcaactcaaaggga

SEQ ID NO: 48576 - DNA, 20 bp, Artificial Sequence
  chemically synthesized
ttgcggcaactcaaagggag

SEQ ID NO: 48577 - DNA, 20 bp, Artificial Sequence
  chemically synthesized
tgcggcaactcaaagggaga

SEQ ID NO: 48578 - DNA, 20 bp, Artificial Sequence
  chemically synthesized
agggagagggtgacttgtcc

SEQ ID NO: 48579 - DNA, 20 bp, Artificial Sequence
  chemically synthesized
gggagagggtgacttgtccc

SEQ ID NO: 48580 - DNA, 20 bp, Artificial Sequence
  chemically synthesized
gggtgacttgtcccgggtca

SEQ ID NO: 48581 - DNA, 20 bp, Artificial Sequence
  chemically synthesized
gtgacttgtcccgggtcaca

SEQ ID NO: 48582 - DNA, 20 bp, Artificial Sequence
  chemically synthesized
gtcccgggtcacagagctga

SEQ ID NO: 48583 - DNA, 20 bp, Artificial Sequence
  chemically synthesized
tcccgggtcacagagctgaa

SEQ ID NO: 48584 - DNA, 20 bp, Artificial Sequence
  chemically synthesized
cccgggtcacagagctgaaa

SEQ ID NO: 48585 - DNA, 20 bp, Artificial Sequence
  chemically synthesized
gggtcacagagctgaaaggg

SEQ ID NO: 48586 - DNA, 20 bp, Artificial Sequence
  chemically synthesized
ggtcacagagctgaaagggc

SEQ ID NO: 48587 - DNA, 20 bp, Artificial Sequence
  chemically synthesized
agctgaaagggcaggtacaa

SEQ ID NO: 48588 - DNA, 20 bp, Artificial Sequence
  chemically synthesized
gctgaaagggcaggtacaac

SEQ ID NO: 48589 - DNA, 20 bp, Artificial Sequence
  chemically synthesized
aggtacaacaggtgacatgc

SEQ ID NO: 48590 - DNA, 20 bp, Artificial Sequence
  chemically synthesized
ggtacaacaggtgacatgcc

SEQ ID NO: 48591 - DNA, 20 bp, Artificial Sequence
  chemically synthesized
ggtgacatgccgggctgtct

SEQ ID NO: 48592 - DNA, 20 bp, Artificial Sequence
  chemically synthesized
gccgggctgtctgagtttat

SEQ ID NO: 48593 - DNA, 20 bp, Artificial Sequence
  chemically synthesized
ccgggctgtctgagtttatg

SEQ ID NO: 48594 - DNA, 20 bp, Artificial Sequence
  chemically synthesized
cgggctgtctgagtttatga

SEQ ID NO: 48595 - DNA, 20 bp, Artificial Sequence
  chemically synthesized
tgtctgagtttatgagggcc

SEQ ID NO: 48596 - DNA, 20 bp, Artificial Sequence
  chemically synthesized
gggcccagtcttgtgtctgc

SEQ ID NO: 48597 - DNA, 20 bp, Artificial Sequence
  chemically synthesized
ggcccagtcttgtgtctgcc

SEQ ID NO: 48598 - DNA, 20 bp, Artificial Sequence
  chemically synthesized
tcttgtgtctgccgggcaat

SEQ ID NO: 48599 - DNA, 20 bp, Artificial Sequence
  chemically synthesized
gtgtctgccgggcaatgagc

SEQ ID NO: 48600 - DNA, 20 bp, Artificial Sequence
  chemically synthesized
tgtctgccgggcaatgagca

SEQ ID NO: 48601 - DNA, 20 bp, Artificial Sequence
  chemically synthesized
agcaaggctccttcctgtcc

SEQ ID NO: 48602 - DNA, 20 bp, Artificial Sequence
  chemically synthesized
ccaagctccccgcccctccc

SEQ ID NO: 48603 - DNA, 20 bp, Artificial Sequence
  chemically synthesized
cagcctactgcctccacccg

SEQ ID NO: 48604 - DNA, 20 bp, Artificial Sequence
  chemically synthesized
tccacccgaagtctacttcc

SEQ ID NO: 48605 - DNA, 20 bp, Artificial Sequence
  chemically synthesized
ccacccgaagtctacttcct

SEQ ID NO: 48606 - DNA, 20 bp, Artificial Sequence
  chemically synthesized
cccgaagtctacttcctggg

SEQ ID NO: 48607 - DNA, 20 bp, Artificial Sequence
  chemically synthesized
ccgaagtctacttcctgggt

SEQ ID NO: 48608 - DNA, 20 bp, Artificial Sequence
  chemically synthesized
aagtctacttcctgggtggg

SEQ ID NO: 48609 - DNA, 20 bp, Artificial Sequence
  chemically synthesized
agtctacttcctgggtgggc

SEQ ID NO: 48610 - DNA, 20 bp, Artificial Sequence
  chemically synthesized
cttcctgggtgggcaggaac

SEQ ID NO: 48611 - DNA, 20 bp, Artificial Sequence
  chemically synthesized
ttcctgggtgggcaggaact

SEQ ID NO: 48612 - DNA, 20 bp, Artificial Sequence
  chemically synthesized
caggaactgggcactgtgcc

SEQ ID NO: 48613 - DNA, 20 bp, Artificial Sequence
  chemically synthesized
aggaactgggcactgtgccc

SEQ ID NO: 48614 - DNA, 20 bp, Artificial Sequence
  chemically synthesized
ggaactgggcactgtgccca

SEQ ID NO: 48615 - DNA, 20 bp, Artificial Sequence
  chemically synthesized
gggcatgcactgcctccacg

SEQ ID NO: 48616 - DNA, 20 bp, Artificial Sequence
  chemically synthesized
tgcctccacgcagcaaccct

SEQ ID NO: 48617 - DNA, 20 bp, Artificial Sequence
  chemically synthesized
cctccacgcagcaaccctca

SEQ ID NO: 48618 - DNA, 20 bp, Artificial Sequence
  chemically synthesized
gcagcaaccctcagagtcct

SEQ ID NO: 48619 - DNA, 20 bp, Artificial Sequence
  chemically synthesized
tcagagtcctgagctgaacc

SEQ ID NO: 48620 - DNA, 20 bp, Artificial Sequence
  chemically synthesized
gagtcctgagctgaaccaag

SEQ ID NO: 48621 - DNA, 20 bp, Artificial Sequence
  chemically synthesized
agtcctgagctgaaccaaga

SEQ ID NO: 48622 - DNA, 20 bp, Artificial Sequence
  chemically synthesized
tcctgagctgaaccaagaag

SEQ ID NO: 48623 - DNA, 20 bp, Artificial Sequence
  chemically synthesized
cctgagctgaaccaagaagg

SEQ ID NO: 48624 - DNA, 20 bp, Artificial Sequence
  chemically synthesized
tgagctgaaccaagaaggag

SEQ ID NO: 48625 - DNA, 20 bp, Artificial Sequence
  chemically synthesized
gagctgaaccaagaaggagg

SEQ ID NO: 48626 - DNA, 20 bp, Artificial Sequence
  chemically synthesized
agctgaaccaagaaggagga

SEQ ID NO: 48627 - DNA, 20 bp, Artificial Sequence
  chemically synthesized
gctgaaccaagaaggaggag

SEQ ID NO: 48628 - DNA, 20 bp, Artificial Sequence
  chemically synthesized
ctgaaccaagaaggaggagg

SEQ ID NO: 48629 - DNA, 20 bp, Artificial Sequence
  chemically synthesized
accaagaaggaggagggggt

SEQ ID NO: 48630 - DNA, 20 bp, Artificial Sequence
  chemically synthesized
ccaagaaggaggagggggtc

SEQ ID NO: 48631 - DNA, 20 bp, Artificial Sequence
  chemically synthesized
gaggagggggtcgggcctcc

SEQ ID NO: 48632 - DNA, 20 bp, Artificial Sequence
  chemically synthesized
aggagggggtcgggcctccg

SEQ ID NO: 48633 - DNA, 20 bp, Artificial Sequence
  chemically synthesized
agggggtcgggcctccgagg

SEQ ID NO: 48634 - DNA, 20 bp, Artificial Sequence
  chemically synthesized
gggggtcgggcctccgagga

SEQ ID NO: 48635 - DNA, 20 bp, Artificial Sequence
  chemically synthesized
tcgggcctccgaggaaggcc

SEQ ID NO: 48636 - DNA, 20 bp, Artificial Sequence
  chemically synthesized
ggcctagccgctgctgctgc

SEQ ID NO: 48637 - DNA, 20 bp, Artificial Sequence
  chemically synthesized
gcctagccgctgctgctgcc

SEQ ID NO: 48638 - DNA, 20 bp, Artificial Sequence
  chemically synthesized
gctgctgctgccaggaattc

SEQ ID NO: 48639 - DNA, 20 bp, Artificial Sequence
  chemically synthesized
ctgctgctgccaggaattcc

SEQ ID NO: 48640 - DNA, 20 bp, Artificial Sequence
  chemically synthesized
tgctgccaggaattccaggt

SEQ ID NO: 48641 - DNA, 20 bp, Artificial Sequence
  chemically synthesized
ctgccaggaattccaggttg

SEQ ID NO: 48642 - DNA, 20 bp, Artificial Sequence
  chemically synthesized
tgccaggaattccaggttgg

SEQ ID NO: 48643 - DNA, 20 bp, Artificial Sequence
  chemically synthesized
gccaggaattccaggttgga

SEQ ID NO: 48644 - DNA, 20 bp, Artificial Sequence
  chemically synthesized
ccaggaattccaggttggag

SEQ ID NO: 48645 - DNA, 20 bp, Artificial Sequence
  chemically synthesized
ggaattccaggttggagggg

SEQ ID NO: 48646 - DNA, 20 bp, Artificial Sequence
  chemically synthesized
gaggggcggcaacctcctgc

SEQ ID NO: 48647 - DNA, 20 bp, Artificial Sequence
  chemically synthesized
ggcaacctcctgccagcctt

SEQ ID NO: 48648 - DNA, 20 bp, Artificial Sequence
  chemically synthesized
gcaacctcctgccagccttc

SEQ ID NO: 48649 - DNA, 20 bp, Artificial Sequence
  chemically synthesized
ggccactctcctgtgcctgc

SEQ ID NO: 48650 - DNA, 20 bp, Artificial Sequence
  chemically synthesized
cactctcctgtgcctgccag

SEQ ID NO: 48651 - DNA, 20 bp, Artificial Sequence
  chemically synthesized
ctctcctgtgcctgccagaa

SEQ ID NO: 48652 - DNA, 20 bp, Artificial Sequence
  chemically synthesized
cctgtgcctgccagaagaga

SEQ ID NO: 48653 - DNA, 20 bp, Artificial Sequence
  chemically synthesized
tgtgcctgccagaagagaca

SEQ ID NO: 48654 - DNA, 20 bp, Artificial Sequence
  chemically synthesized
tgccagaagagacagagctt

SEQ ID NO: 48655 - DNA, 20 bp, Artificial Sequence
  chemically synthesized
gccagaagagacagagcttg

SEQ ID NO: 48656 - DNA, 20 bp, Artificial Sequence
  chemically synthesized
cagaagagacagagcttgag

SEQ ID NO: 48657 - DNA, 20 bp, Artificial Sequence
  chemically synthesized
gaagagacagagcttgagga

SEQ ID NO: 48658 - DNA, 20 bp, Artificial Sequence
  chemically synthesized
acagagcttgaggagagctt

SEQ ID NO: 48659 - DNA, 20 bp, Artificial Sequence
  chemically synthesized
cagagcttgaggagagcttg

SEQ ID NO: 48660 - DNA, 20 bp, Artificial Sequence
  chemically synthesized
gagcttgaggagagcttgag

SEQ ID NO: 48661 - DNA, 20 bp, Artificial Sequence
  chemically synthesized
gcttgaggagagcttgagga

SEQ ID NO: 48662 - DNA, 20 bp, Artificial Sequence
  chemically synthesized
tgaggagagcttgaggagag

SEQ ID NO: 48663 - DNA, 20 bp, Artificial Sequence
  chemically synthesized
gaggagagcttgaggagagc

SEQ ID NO: 48664 - DNA, 20 bp, Artificial Sequence
  chemically synthesized
agagcttgaggagagcagga

SEQ ID NO: 48665 - DNA, 20 bp, Artificial Sequence
  chemically synthesized
gagcttgaggagagcaggaa

SEQ ID NO: 48666 - DNA, 20 bp, Artificial Sequence
  chemically synthesized
cttgaggagagcaggaaagg

SEQ ID NO: 48667 - DNA, 20 bp, Artificial Sequence
  chemically synthesized
ttgaggagagcaggaaaggt

SEQ ID NO: 48668 - DNA, 20 bp, Artificial Sequence
  chemically synthesized
cattgctgctgctgctcact

SEQ ID NO: 48669 - DNA, 20 bp, Artificial Sequence
  chemically synthesized
ctgctgctcactcagttcca

SEQ ID NO: 48670 - DNA, 20 bp, Artificial Sequence
  chemically synthesized
tgctgctcactcagttccac

SEQ ID NO: 48671 - DNA, 20 bp, Artificial Sequence
  chemically synthesized
tgctcactcagttccacagg

SEQ ID NO: 48672 - DNA, 20 bp, Artificial Sequence
  chemically synthesized
gctcactcagttccacaggt

SEQ ID NO: 48673 - DNA, 20 bp, Artificial Sequence
  chemically synthesized
tcactcagttccacaggtgg

SEQ ID NO: 48674 - DNA, 20 bp, Artificial Sequence
  chemically synthesized
cactcagttccacaggtggg

SEQ ID NO: 48675 - DNA, 20 bp, Artificial Sequence
  chemically synthesized
actcagttccacaggtggga

SEQ ID NO: 48676 - DNA, 20 bp, Artificial Sequence
  chemically synthesized
agttccacaggtgggaggga

SEQ ID NO: 48677 - DNA, 20 bp, Artificial Sequence
  chemically synthesized
tccacaggtgggagggacag

SEQ ID NO: 48678 - DNA, 20 bp, Artificial Sequence
  chemically synthesized
ccacaggtgggagggacagc

SEQ ID NO: 48679 - DNA, 20 bp, Artificial Sequence
  chemically synthesized
cacaggtgggagggacagca

SEQ ID NO: 48680 - DNA, 20 bp, Artificial Sequence
  chemically synthesized
gtgggagggacagcagggct

SEQ ID NO: 48681 - DNA, 20 bp, Artificial Sequence
  chemically synthesized
gggagggacagcagggctta

SEQ ID NO: 48682 - DNA, 20 bp, Artificial Sequence
  chemically synthesized
agggacagcagggcttagag

SEQ ID NO: 48683 - DNA, 20 bp, Artificial Sequence
  chemically synthesized
gggacagcagggcttagagt

SEQ ID NO: 48684 - DNA, 20 bp, Artificial Sequence
  chemically synthesized
ggacagcagggcttagagtg

SEQ ID NO: 48685 - DNA, 20 bp, Artificial Sequence
  chemically synthesized
gacagcagggcttagagtgg

SEQ ID NO: 48686 - DNA, 20 bp, Artificial Sequence
  chemically synthesized
ttagagtgggggtcattgtg

SEQ ID NO: 48687 - DNA, 20 bp, Artificial Sequence
  chemically synthesized
agtgggggtcattgtgcaga

SEQ ID NO: 48688 - DNA, 20 bp, Artificial Sequence
  chemically synthesized
gtgggggtcattgtgcagat

SEQ ID NO: 48689 - DNA, 20 bp, Artificial Sequence
  chemically synthesized
attgtgcagatgggaaaaca

SEQ ID NO: 48690 - DNA, 20 bp, Artificial Sequence
  chemically synthesized
ttgtgcagatgggaaaacaa

SEQ ID NO: 48691 - DNA, 20 bp, Artificial Sequence
  chemically synthesized
cagatgggaaaacaaaggcc

SEQ ID NO: 48692 - DNA, 20 bp, Artificial Sequence
  chemically synthesized
gatgggaaaacaaaggccca

SEQ ID NO: 48693 - DNA, 20 bp, Artificial Sequence
  chemically synthesized
tgggaaaacaaaggcccaga

SEQ ID NO: 48694 - DNA, 20 bp, Artificial Sequence
  chemically synthesized
gggaaaacaaaggcccagag

SEQ ID NO: 48695 - DNA, 20 bp, Artificial Sequence
  chemically synthesized
ggaaaacaaaggcccagaga

SEQ ID NO: 48696 - DNA, 20 bp, Artificial Sequence
  chemically synthesized
gaaaacaaaggcccagagag

SEQ ID NO: 48697 - DNA, 20 bp, Artificial Sequence
  chemically synthesized
aacaaaggcccagagagggg

SEQ ID NO: 48698 - DNA, 20 bp, Artificial Sequence
  chemically synthesized
cagagaggggaagaaatgcc

SEQ ID NO: 48699 - DNA, 20 bp, Artificial Sequence
  chemically synthesized
agagaggggaagaaatgccc

SEQ ID NO: 48700 - DNA, 20 bp, Artificial Sequence
  chemically synthesized
agaggggaagaaatgcccag

SEQ ID NO: 48701 - DNA, 20 bp, Artificial Sequence
  chemically synthesized
agaaatgcccaggagctacc

SEQ ID NO: 48702 - DNA, 20 bp, Artificial Sequence
  chemically synthesized
gaaatgcccaggagctaccg

SEQ ID NO: 48703 - DNA, 20 bp, Artificial Sequence
  chemically synthesized
aaatgcccaggagctaccga

SEQ ID NO: 48704 - DNA, 20 bp, Artificial Sequence
  chemically synthesized
tgcccaggagctaccgaggg

SEQ ID NO: 48705 - DNA, 20 bp, Artificial Sequence
  chemically synthesized
gcccaggagctaccgagggc

SEQ ID NO: 48706 - DNA, 20 bp, Artificial Sequence
  chemically synthesized
agggcaggcgacctcaacca

SEQ ID NO: 48707 - DNA, 20 bp, Artificial Sequence
  chemically synthesized
aggcgacctcaaccacagcc

SEQ ID NO: 48708 - DNA, 20 bp, Artificial Sequence
  chemically synthesized
cctcaaccacagcccagtgc

SEQ ID NO: 48709 - DNA, 20 bp, Artificial Sequence
  chemically synthesized
tcaaccacagcccagtgctg

SEQ ID NO: 48710 - DNA, 20 bp, Artificial Sequence
  chemically synthesized
cagcccagtgctggagctgt

SEQ ID NO: 48711 - DNA, 20 bp, Artificial Sequence
  chemically synthesized
cccagtgctggagctgtgag

SEQ ID NO: 48712 - DNA, 20 bp, Artificial Sequence
  chemically synthesized
gctggagctgtgagtggatg

SEQ ID NO: 48713 - DNA, 20 bp, Artificial Sequence
  chemically synthesized
tggagctgtgagtggatgta

SEQ ID NO: 48714 - DNA, 20 bp, Artificial Sequence
  chemically synthesized
agctgtgagtggatgtagag

SEQ ID NO: 48715 - DNA, 20 bp, Artificial Sequence
  chemically synthesized
tgtgagtggatgtagagcag

SEQ ID NO: 48716 - DNA, 20 bp, Artificial Sequence
  chemically synthesized
agagcagcggaatatccatt

SEQ ID NO: 48717 - DNA, 20 bp, Artificial Sequence
  chemically synthesized
cagcggaatatccattcagc

SEQ ID NO: 48718 - DNA, 20 bp, Artificial Sequence
  chemically synthesized
gaatatccattcagccagct

SEQ ID NO: 48719 - DNA, 20 bp, Artificial Sequence
  chemically synthesized
aatatccattcagccagctc

SEQ ID NO: 48720 - DNA, 20 bp, Artificial Sequence
  chemically synthesized
atatccattcagccagctca

SEQ ID NO: 48721 - DNA, 20 bp, Artificial Sequence
  chemically synthesized
tatccattcagccagctcag

SEQ ID NO: 48722 - DNA, 20 bp, Artificial Sequence
  chemically synthesized
ccattcagccagctcagggg

SEQ ID NO: 48723 - DNA, 20 bp, Artificial Sequence
  chemically synthesized
cattcagccagctcagggga

SEQ ID NO: 48724 - DNA, 20 bp, Artificial Sequence
  chemically synthesized
cagccagctcaggggaagga

SEQ ID NO: 48725 - DNA, 20 bp, Artificial Sequence
  chemically synthesized
agccagctcaggggaaggac

SEQ ID NO: 48726 - DNA, 20 bp, Artificial Sequence
  chemically synthesized
gccagctcaggggaaggaca

SEQ ID NO: 48727 - DNA, 20 bp, Artificial Sequence
  chemically synthesized
ccagctcaggggaaggacag

SEQ ID NO: 48728 - DNA, 20 bp, Artificial Sequence
  chemically synthesized
ggggaaggacaggggccctg

SEQ ID NO: 48729 - DNA, 20 bp, Artificial Sequence
  chemically synthesized
aaggacaggggccctgaagc

SEQ ID NO: 48730 - DNA, 20 bp, Artificial Sequence
  chemically synthesized
aggacaggggccctgaagcc

SEQ ID NO: 48731 - DNA, 20 bp, Artificial Sequence
  chemically synthesized
ggacaggggccctgaagcca

SEQ ID NO: 48732 - DNA, 20 bp, Artificial Sequence
  chemically synthesized
gacaggggccctgaagccag

SEQ ID NO: 48733 - DNA, 20 bp, Artificial Sequence
  chemically synthesized
ggggccctgaagccagggga

SEQ ID NO: 48734 - DNA, 20 bp, Artificial Sequence
  chemically synthesized
ggccctgaagccaggggatg

SEQ ID NO: 48735 - DNA, 20 bp, Artificial Sequence
  chemically synthesized
gaagccaggggatggagctg

SEQ ID NO: 48736 - DNA, 20 bp, Artificial Sequence
  chemically synthesized
aagccaggggatggagctgc

SEQ ID NO: 48737 - DNA, 20 bp, Artificial Sequence
  chemically synthesized
agccaggggatggagctgca

SEQ ID NO: 48738 - DNA, 20 bp, Artificial Sequence
  chemically synthesized
caggggatggagctgcaggg

SEQ ID NO: 48739 - DNA, 20 bp, Artificial Sequence
  chemically synthesized
aggggatggagctgcaggga

SEQ ID NO: 48740 - DNA, 20 bp, Artificial Sequence
  chemically synthesized
ggggatggagctgcagggaa

SEQ ID NO: 48741 - DNA, 20 bp, Artificial Sequence
  chemically synthesized
ggatggagctgcagggaagg

SEQ ID NO: 48742 - DNA, 20 bp, Artificial Sequence
  chemically synthesized
gagctgcagggaagggagct

SEQ ID NO: 48743 - DNA, 20 bp, Artificial Sequence
  chemically synthesized
gctgcagggaagggagctca

SEQ ID NO: 48744 - DNA, 20 bp, Artificial Sequence
  chemically synthesized
tgcagggaagggagctcaga

SEQ ID NO: 48745 - DNA, 20 bp, Artificial Sequence
  chemically synthesized
agggaagggagctcagagag

SEQ ID NO: 48746 - DNA, 20 bp, Artificial Sequence
  chemically synthesized
gggaagggagctcagagaga

SEQ ID NO: 48747 - DNA, 20 bp, Artificial Sequence
  chemically synthesized
ggaagggagctcagagagaa

SEQ ID NO: 48748 - DNA, 20 bp, Artificial Sequence
  chemically synthesized
gaagggagctcagagagaag

SEQ ID NO: 48749 - DNA, 20 bp, Artificial Sequence
  chemically synthesized
agggagctcagagagaaggg

SEQ ID NO: 48750 - DNA, 20 bp, Artificial Sequence
  chemically synthesized
gggagctcagagagaagggg

SEQ ID NO: 48751 - DNA, 20 bp, Artificial Sequence
  chemically synthesized
ggagctcagagagaagggga

SEQ ID NO: 48752 - DNA, 20 bp, Artificial Sequence
  chemically synthesized
gagctcagagagaaggggag

SEQ ID NO: 48753 - DNA, 20 bp, Artificial Sequence
  chemically synthesized
gctcagagagaaggggaggg

SEQ ID NO: 48754 - DNA, 20 bp, Artificial Sequence
  chemically synthesized
agagaaggggaggggagtct

SEQ ID NO: 48755 - DNA, 20 bp, Artificial Sequence
  chemically synthesized
aggggaggggagtctgagct

SEQ ID NO: 48756 - DNA, 20 bp, Artificial Sequence
  chemically synthesized
ctcagtttcccgctgcctga

SEQ ID NO: 48757 - DNA, 20 bp, Artificial Sequence
  chemically synthesized
tcagtttcccgctgcctgaa

SEQ ID NO: 48758 - DNA, 20 bp, Artificial Sequence
  chemically synthesized
agtttcccgctgcctgaaag

SEQ ID NO: 48759 - DNA, 20 bp, Artificial Sequence
  chemically synthesized
gtttcccgctgcctgaaagg

SEQ ID NO: 48760 - DNA, 20 bp, Artificial Sequence
  chemically synthesized
tttcccgctgcctgaaagga

SEQ ID NO: 48761 - DNA, 20 bp, Artificial Sequence
  chemically synthesized
cccgctgcctgaaaggaggg

SEQ ID NO: 48762 - DNA, 20 bp, Artificial Sequence
  chemically synthesized
ggtggtacctactcccttca

SEQ ID NO: 48763 - DNA, 20 bp, Artificial Sequence
  chemically synthesized
gtggtacctactcccttcac

SEQ ID NO: 48764 - DNA, 20 bp, Artificial Sequence
  chemically synthesized
tggtacctactcccttcaca

SEQ ID NO: 48765 - DNA, 20 bp, Artificial Sequence
  chemically synthesized
ccttcacagggtaactgaat

SEQ ID NO: 48766 - DNA, 20 bp, Artificial Sequence
  chemically synthesized
ttcacagggtaactgaatga

SEQ ID NO: 48767 - DNA, 20 bp, Artificial Sequence
  chemically synthesized
taactgaatgagagactgcc

SEQ ID NO: 48768 - DNA, 20 bp, Artificial Sequence
  chemically synthesized
actgaatgagagactgcctg

SEQ ID NO: 48769 - DNA, 20 bp, Artificial Sequence
  chemically synthesized
ctgaatgagagactgcctgg

SEQ ID NO: 48770 - DNA, 20 bp, Artificial Sequence
  chemically synthesized
atgagagactgcctggagga

SEQ ID NO: 48771 - DNA, 20 bp, Artificial Sequence
  chemically synthesized
tgcctggaggaaagctcttc

SEQ ID NO: 48772 - DNA, 20 bp, Artificial Sequence
  chemically synthesized
ggaggaaagctcttcaagtg

SEQ ID NO: 48773 - DNA, 20 bp, Artificial Sequence
  chemically synthesized
aagtgtggcccaccccaccc

SEQ ID NO: 48774 - DNA, 20 bp, Artificial Sequence
  chemically synthesized
ccaccccaccccagtgacac

SEQ ID NO: 48775 - DNA, 20 bp, Artificial Sequence
  chemically synthesized
agtgacaccagcccctgaca

SEQ ID NO: 48776 - DNA, 20 bp, Artificial Sequence
  chemically synthesized
gtgacaccagcccctgacac

SEQ ID NO: 48777 - DNA, 20 bp, Artificial Sequence
  chemically synthesized
tgacaccagcccctgacacg

SEQ ID NO: 48778 - DNA, 20 bp, Artificial Sequence
  chemically synthesized
gacaccagcccctgacacgg

SEQ ID NO: 48779 - DNA, 20 bp, Artificial Sequence
  chemically synthesized
caccagcccctgacacgggg

SEQ ID NO: 48780 - DNA, 20 bp, Artificial Sequence
  chemically synthesized
accagcccctgacacggggg

SEQ ID NO: 48781 - DNA, 20 bp, Artificial Sequence
  chemically synthesized
ccagcccctgacacggggga

SEQ ID NO: 48782 - DNA, 20 bp, Artificial Sequence
  chemically synthesized
agcccctgacacgggggagg

SEQ ID NO: 48783 - DNA, 20 bp, Artificial Sequence
  chemically synthesized
gcccctgacacgggggaggg

SEQ ID NO: 48784 - DNA, 20 bp, Artificial Sequence
  chemically synthesized
cccctgacacgggggaggga

SEQ ID NO: 48785 - DNA, 20 bp, Artificial Sequence
  chemically synthesized
ctgacacgggggagggaggg

SEQ ID NO: 48786 - DNA, 20 bp, Artificial Sequence
  chemically synthesized
cgggggagggagggcagcat

SEQ ID NO: 48787 - DNA, 20 bp, Artificial Sequence
  chemically synthesized
gggggagggagggcagcatc

SEQ ID NO: 48788 - DNA, 20 bp, Artificial Sequence
  chemically synthesized
gggagggagggcagcatcag

SEQ ID NO: 48789 - DNA, 20 bp, Artificial Sequence
  chemically synthesized
ggagggagggcagcatcagg

SEQ ID NO: 48790 - DNA, 20 bp, Artificial Sequence
  chemically synthesized
gagggagggcagcatcagga

SEQ ID NO: 48791 - DNA, 20 bp, Artificial Sequence
  chemically synthesized
agggagggcagcatcaggag

SEQ ID NO: 48792 - DNA, 20 bp, Artificial Sequence
  chemically synthesized
cagcatcaggaggggctttc

SEQ ID NO: 48793 - DNA, 20 bp, Artificial Sequence
  chemically synthesized
agcatcaggaggggctttct

SEQ ID NO: 48794 - DNA, 20 bp, Artificial Sequence
  chemically synthesized
aggggctttctgggcacacc

SEQ ID NO: 48795 - DNA, 20 bp, Artificial Sequence
  chemically synthesized
cacacccagtacccgtctct

SEQ ID NO: 48796 - DNA, 20 bp, Artificial Sequence
  chemically synthesized
ctgttgcattttaatcctca

SEQ ID NO: 48797 - DNA, 20 bp, Artificial Sequence
  chemically synthesized
ttgcattttaatcctcacag

SEQ ID NO: 48798 - DNA, 20 bp, Artificial Sequence
  chemically synthesized
aatcctcacagcagctcaac

SEQ ID NO: 48799 - DNA, 20 bp, Artificial Sequence
  chemically synthesized
atcctcacagcagctcaaca

SEQ ID NO: 48800 - DNA, 20 bp, Artificial Sequence
  chemically synthesized
ccgtcaccatccccatttta

SEQ ID NO: 48801 - DNA, 20 bp, Artificial Sequence
  chemically synthesized
caccatccccattttacaga

SEQ ID NO: 48802 - DNA, 20 bp, Artificial Sequence
  chemically synthesized
accatccccattttacagat

SEQ ID NO: 48803 - DNA, 20 bp, Artificial Sequence
  chemically synthesized
ccatccccattttacagata

SEQ ID NO: 48804 - DNA, 20 bp, Artificial Sequence
  chemically synthesized
attttacagatagggaaatt

SEQ ID NO: 48805 - DNA, 20 bp, Artificial Sequence
  chemically synthesized
ttttacagatagggaaattg

SEQ ID NO: 48806 - DNA, 20 bp, Artificial Sequence
  chemically synthesized
cagatagggaaattgaggct

SEQ ID NO: 48807 - DNA, 20 bp, Artificial Sequence
  chemically synthesized
gatagggaaattgaggctcg

SEQ ID NO: 48808 - DNA, 20 bp, Artificial Sequence
  chemically synthesized
agggaaattgaggctcggag

SEQ ID NO: 48809 - DNA, 20 bp, Artificial Sequence
  chemically synthesized
agcggttaaacaactcacct

SEQ ID NO: 48810 - DNA, 20 bp, Artificial Sequence
  chemically synthesized
gcggttaaacaactcacctg

SEQ ID NO: 48811 - DNA, 20 bp, Artificial Sequence
  chemically synthesized
acaactcacctgaggcctca

SEQ ID NO: 48812 - DNA, 20 bp, Artificial Sequence
  chemically synthesized
ctcacctgaggcctcacagc

SEQ ID NO: 48813 - DNA, 20 bp, Artificial Sequence
  chemically synthesized
cctgaggcctcacagccagt

SEQ ID NO: 48814 - DNA, 20 bp, Artificial Sequence
  chemically synthesized
gaggcctcacagccagtaag

SEQ ID NO: 48815 - DNA, 20 bp, Artificial Sequence
  chemically synthesized
aggcctcacagccagtaagt

SEQ ID NO: 48816 - DNA, 20 bp, Artificial Sequence
  chemically synthesized
cagccagtaagtgggttccc

SEQ ID NO: 48817 - DNA, 20 bp, Artificial Sequence
  chemically synthesized
cctggtctgaatgtgtgtgc

SEQ ID NO: 48818 - DNA, 20 bp, Artificial Sequence
  chemically synthesized
tggtctgaatgtgtgtgctg

SEQ ID NO: 48819 - DNA, 20 bp, Artificial Sequence
  chemically synthesized
ggtctgaatgtgtgtgctgg

SEQ ID NO: 48820 - DNA, 20 bp, Artificial Sequence
  chemically synthesized
gtgtgtgctggaggatcctg

SEQ ID NO: 48821 - DNA, 20 bp, Artificial Sequence
  chemically synthesized
tgtgtgctggaggatcctgt

SEQ ID NO: 48822 - DNA, 20 bp, Artificial Sequence
  chemically synthesized
gatcctgtgggtcactcgcc

SEQ ID NO: 48823 - DNA, 20 bp, Artificial Sequence
  chemically synthesized
cctgtgggtcactcgcctgg

SEQ ID NO: 48824 - DNA, 20 bp, Artificial Sequence
  chemically synthesized
tgtgggtcactcgcctggta

SEQ ID NO: 48825 - DNA, 20 bp, Artificial Sequence
  chemically synthesized
cactcgcctggtagagcccc

SEQ ID NO: 48826 - DNA, 20 bp, Artificial Sequence
  chemically synthesized
actcgcctggtagagcccca

SEQ ID NO: 48827 - DNA, 20 bp, Artificial Sequence
  chemically synthesized
cgcctggtagagccccaagg

SEQ ID NO: 48828 - DNA, 20 bp, Artificial Sequence
  chemically synthesized
cctggtagagccccaaggtg

SEQ ID NO: 48829 - DNA, 20 bp, Artificial Sequence
  chemically synthesized
ctggtagagccccaaggtgg

SEQ ID NO: 48830 - DNA, 20 bp, Artificial Sequence
  chemically synthesized
ccccaaggtggaggcataaa

SEQ ID NO: 48831 - DNA, 20 bp, Artificial Sequence
  chemically synthesized
cccaaggtggaggcataaat

SEQ ID NO: 48832 - DNA, 20 bp, Artificial Sequence
  chemically synthesized
ggtggaggcataaatgggac

SEQ ID NO: 48833 - DNA, 20 bp, Artificial Sequence
  chemically synthesized
taaatgggactggtgaatga

SEQ ID NO: 48834 - DNA, 20 bp, Artificial Sequence
  chemically synthesized
atgggactggtgaatgacag

SEQ ID NO: 48835 - DNA, 20 bp, Artificial Sequence
  chemically synthesized
tgggactggtgaatgacaga

SEQ ID NO: 48836 - DNA, 20 bp, Artificial Sequence
  chemically synthesized
gggactggtgaatgacagaa

SEQ ID NO: 48837 - DNA, 20 bp, Artificial Sequence
  chemically synthesized
ggactggtgaatgacagaag

SEQ ID NO: 48838 - DNA, 20 bp, Artificial Sequence
  chemically synthesized
cactcatccattcactctgc

SEQ ID NO: 48839 - DNA, 20 bp, Artificial Sequence
  chemically synthesized
attcactctgcaagtatcta

SEQ ID NO: 48840 - DNA, 20 bp, Artificial Sequence
  chemically synthesized
agtatctacggcacgtacgc

SEQ ID NO: 48841 - DNA, 20 bp, Artificial Sequence
  chemically synthesized
cggcacgtacgccagctccc

SEQ ID NO: 48842 - DNA, 20 bp, Artificial Sequence
  chemically synthesized
cacgtacgccagctcccaag

SEQ ID NO: 48843 - DNA, 20 bp, Artificial Sequence
  chemically synthesized
acgtacgccagctcccaagc

SEQ ID NO: 48844 - DNA, 20 bp, Artificial Sequence
  chemically synthesized
ccagctcccaagcaggtttg

SEQ ID NO: 48845 - DNA, 20 bp, Artificial Sequence
  chemically synthesized
cagctcccaagcaggtttgc

SEQ ID NO: 48846 - DNA, 20 bp, Artificial Sequence
  chemically synthesized
aagcaggtttgcgggttgca

SEQ ID NO: 48847 - DNA, 20 bp, Artificial Sequence
  chemically synthesized
caggtttgcgggttgcacag

SEQ ID NO: 48848 - DNA, 20 bp, Artificial Sequence
  chemically synthesized
aggtttgcgggttgcacagc

SEQ ID NO: 48849 - DNA, 20 bp, Artificial Sequence
  chemically synthesized
gcgggcgatgcaatctgatt

SEQ ID NO: 48850 - DNA, 20 bp, Artificial Sequence
  chemically synthesized
cgggcgatgcaatctgattt

SEQ ID NO: 48851 - DNA, 20 bp, Artificial Sequence
  chemically synthesized
caatctgatttaggctttta

SEQ ID NO: 48852 - DNA, 20 bp, Artificial Sequence
  chemically synthesized
aatctgatttaggcttttaa

SEQ ID NO: 48853 - DNA, 20 bp, Artificial Sequence
  chemically synthesized
atctgatttaggcttttaaa

SEQ ID NO: 48854 - DNA, 20 bp, Artificial Sequence
  chemically synthesized
cttttaaagggattgcaatc

SEQ ID NO: 48855 - DNA, 20 bp, Artificial Sequence
  chemically synthesized
ttaaagggattgcaatcaag

SEQ ID NO: 48856 - DNA, 20 bp, Artificial Sequence
  chemically synthesized
taaagggattgcaatcaagt

SEQ ID NO: 48857 - DNA, 20 bp, Artificial Sequence
  chemically synthesized
aaagggattgcaatcaagtg

SEQ ID NO: 48858 - DNA, 20 bp, Artificial Sequence
  chemically synthesized
gcaatcaagtggggccccac

SEQ ID NO: 48859 - DNA, 20 bp, Artificial Sequence
  chemically synthesized
cctcccctcccctccacccc

SEQ ID NO: 48860 - DNA, 20 bp, Artificial Sequence
  chemically synthesized
cccctcccctccacccccag

SEQ ID NO: 48861 - DNA, 20 bp, Artificial Sequence
  chemically synthesized
tccacccccagcagtctcca

SEQ ID NO: 48862 - DNA, 20 bp, Artificial Sequence
  chemically synthesized
ccacccccagcagtctccaa

SEQ ID NO: 48863 - DNA, 20 bp, Artificial Sequence
  chemically synthesized
ccaaaggcctccaacaaccc

SEQ ID NO: 48864 - DNA, 20 bp, Artificial Sequence
  chemically synthesized
aaaggcctccaacaacccca

SEQ ID NO: 48865 - DNA, 20 bp, Artificial Sequence
  chemically synthesized
ggcctccaacaaccccagag

SEQ ID NO: 48866 - DNA, 20 bp, Artificial Sequence
  chemically synthesized
gcctccaacaaccccagagt

SEQ ID NO: 48867 - DNA, 20 bp, Artificial Sequence
  chemically synthesized
cctccaacaaccccagagtg

SEQ ID NO: 48868 - DNA, 20 bp, Artificial Sequence
  chemically synthesized
ctccaacaaccccagagtgg

SEQ ID NO: 48869 - DNA, 20 bp, Artificial Sequence
  chemically synthesized
gagtgggggccatgtatcca

SEQ ID NO: 48870 - DNA, 20 bp, Artificial Sequence
  chemically synthesized
catgtatccaaagaaactcc

SEQ ID NO: 48871 - DNA, 20 bp, Artificial Sequence
  chemically synthesized
aagaaactccaagctgtata

SEQ ID NO: 48872 - DNA, 20 bp, Artificial Sequence
  chemically synthesized
aagctgtatacggatcacac

SEQ ID NO: 48873 - DNA, 20 bp, Artificial Sequence
  chemically synthesized
tacggatcacactggttttc

SEQ ID NO: 48874 - DNA, 20 bp, Artificial Sequence
  chemically synthesized
acggatcacactggttttcc

SEQ ID NO: 48875 - DNA, 20 bp, Artificial Sequence
  chemically synthesized
ggatcacactggttttccag

SEQ ID NO: 48876 - DNA, 20 bp, Artificial Sequence
  chemically synthesized
tggttttccaggagcaaaaa

SEQ ID NO: 48877 - DNA, 20 bp, Artificial Sequence
  chemically synthesized
tccaggagcaaaaacagaaa

SEQ ID NO: 48878 - DNA, 20 bp, Artificial Sequence
  chemically synthesized
ccaggagcaaaaacagaaac

SEQ ID NO: 48879 - DNA, 20 bp, Artificial Sequence
  chemically synthesized
gcaaaaacagaaacaggcct

SEQ ID NO: 48880 - DNA, 20 bp, Artificial Sequence
  chemically synthesized
caaaaacagaaacaggcctg

SEQ ID NO: 48881 - DNA, 20 bp, Artificial Sequence
  chemically synthesized
aacagaaacaggcctgaggc

SEQ ID NO: 48882 - DNA, 20 bp, Artificial Sequence
  chemically synthesized
attgaacctcctcctgctct

SEQ ID NO: 48883 - DNA, 20 bp, Artificial Sequence
  chemically synthesized
gaacctcctcctgctctgag

SEQ ID NO: 48884 - DNA, 20 bp, Artificial Sequence
  chemically synthesized
tcctcctgctctgagcagcc

SEQ ID NO: 48885 - DNA, 20 bp, Artificial Sequence
  chemically synthesized
cctcctgctctgagcagcct

SEQ ID NO: 48886 - DNA, 20 bp, Artificial Sequence
  chemically synthesized
ctcctgctctgagcagcctg

SEQ ID NO: 48887 - DNA, 20 bp, Artificial Sequence
  chemically synthesized
tcctgctctgagcagcctgg

SEQ ID NO: 48888 - DNA, 20 bp, Artificial Sequence
  chemically synthesized
cctgctctgagcagcctggg

SEQ ID NO: 48889 - DNA, 20 bp, Artificial Sequence
  chemically synthesized
gctctgagcagcctgggggg

SEQ ID NO: 48890 - DNA, 20 bp, Artificial Sequence
  chemically synthesized
agcagcctggggggcagact

SEQ ID NO: 48891 - DNA, 20 bp, Artificial Sequence
  chemically synthesized
agcctggggggcagactaag

SEQ ID NO: 48892 - DNA, 20 bp, Artificial Sequence
  chemically synthesized
cctggggggcagactaagca

SEQ ID NO: 48893 - DNA, 20 bp, Artificial Sequence
  chemically synthesized
ctggggggcagactaagcag

SEQ ID NO: 48894 - DNA, 20 bp, Artificial Sequence
  chemically synthesized
tggggggcagactaagcaga

SEQ ID NO: 48895 - DNA, 20 bp, Artificial Sequence
  chemically synthesized
agactaagcagagggctgtg

SEQ ID NO: 48896 - DNA, 20 bp, Artificial Sequence
  chemically synthesized
gggctgtgcagacccacata

SEQ ID NO: 48897 - DNA, 20 bp, Artificial Sequence
  chemically synthesized
gctgtgcagacccacataaa

SEQ ID NO: 48898 - DNA, 20 bp, Artificial Sequence
  chemically synthesized
ataaagagcctactgtgtgc

SEQ ID NO: 48899 - DNA, 20 bp, Artificial Sequence
  chemically synthesized
taaagagcctactgtgtgcc

SEQ ID NO: 48900 - DNA, 20 bp, Artificial Sequence
  chemically synthesized
gtgtgccaggcacttcaccc

SEQ ID NO: 48901 - DNA, 20 bp, Artificial Sequence
  chemically synthesized
tgtgccaggcacttcacccg

SEQ ID NO: 48902 - DNA, 20 bp, Artificial Sequence
  chemically synthesized
cttcacccgaggcacttcac

SEQ ID NO: 48903 - DNA, 20 bp, Artificial Sequence
  chemically synthesized
aggcacttcacaagcatgct

SEQ ID NO: 48904 - DNA, 20 bp, Artificial Sequence
  chemically synthesized
ggcacttcacaagcatgctt

SEQ ID NO: 48905 - DNA, 20 bp, Artificial Sequence
  chemically synthesized
gaatgaaacttccaactctt

SEQ ID NO: 48906 - DNA, 20 bp, Artificial Sequence
  chemically synthesized
aatgaaacttccaactcttt

SEQ ID NO: 48907 - DNA, 20 bp, Artificial Sequence
  chemically synthesized
acttccaactctttgggatg

SEQ ID NO: 48908 - DNA, 20 bp, Artificial Sequence
  chemically synthesized
cttccaactctttgggatgc

SEQ ID NO: 48909 - DNA, 20 bp, Artificial Sequence
  chemically synthesized
tctttgggatgcaggtgaaa

SEQ ID NO: 48910 - DNA, 20 bp, Artificial Sequence
  chemically synthesized
gatgcaggtgaaacagttcc

SEQ ID NO: 48911 - DNA, 20 bp, Artificial Sequence
  chemically synthesized
aggtgaaacagttcctggtt

SEQ ID NO: 48912 - DNA, 20 bp, Artificial Sequence
  chemically synthesized
gtgaaacagttcctggttca

SEQ ID NO: 48913 - DNA, 20 bp, Artificial Sequence
  chemically synthesized
gaaacagttcctggttcaga

SEQ ID NO: 48914 - DNA, 20 bp, Artificial Sequence
  chemically synthesized
aaacagttcctggttcagag

SEQ ID NO: 48915 - DNA, 20 bp, Artificial Sequence
  chemically synthesized
gttcctggttcagagaggtg

SEQ ID NO: 48916 - DNA, 20 bp, Artificial Sequence
  chemically synthesized
cctggttcagagaggtgaag

SEQ ID NO: 48917 - DNA, 20 bp, Artificial Sequence
  chemically synthesized
agaggtgaagcggcctgcct

SEQ ID NO: 48918 - DNA, 20 bp, Artificial Sequence
  chemically synthesized
gaggtgaagcggcctgcctg

SEQ ID NO: 48919 - DNA, 20 bp, Artificial Sequence
  chemically synthesized
gtgaagcggcctgcctgagg

SEQ ID NO: 48920 - DNA, 20 bp, Artificial Sequence
  chemically synthesized
gcggcctgcctgaggcagca

SEQ ID NO: 48921 - DNA, 20 bp, Artificial Sequence
  chemically synthesized
ggcagcacagctcttcttta

SEQ ID NO: 48922 - DNA, 20 bp, Artificial Sequence
  chemically synthesized
cccacctctaccctgtctca

SEQ ID NO: 48923 - DNA, 20 bp, Artificial Sequence
  chemically synthesized
tgtctcacggccccccatgc

SEQ ID NO: 48924 - DNA, 20 bp, Artificial Sequence
  chemically synthesized
ggccccccatgccagcctga

SEQ ID NO: 48925 - DNA, 20 bp, Artificial Sequence
  chemically synthesized
cctgacggttgtgtctgcct

SEQ ID NO: 48926 - DNA, 20 bp, Artificial Sequence
  chemically synthesized
gtcatgctccatttttccat

SEQ ID NO: 48927 - DNA, 20 bp, Artificial Sequence
  chemically synthesized
tcatgctccatttttccatc

SEQ ID NO: 48928 - DNA, 20 bp, Artificial Sequence
  chemically synthesized
atttttccatcgggaccatc

SEQ ID NO: 48929 - DNA, 20 bp, Artificial Sequence
  chemically synthesized
ttttccatcgggaccatcaa

SEQ ID NO: 48930 - DNA, 20 bp, Artificial Sequence
  chemically synthesized
tttccatcgggaccatcaag

SEQ ID NO: 48931 - DNA, 20 bp, Artificial Sequence
  chemically synthesized
ttccatcgggaccatcaaga

SEQ ID NO: 48932 - DNA, 20 bp, Artificial Sequence
  chemically synthesized
tcaagagggtgtttgtgtct

SEQ ID NO: 48933 - DNA, 20 bp, Artificial Sequence
  chemically synthesized
caagagggtgtttgtgtcta

SEQ ID NO: 48934 - DNA, 20 bp, Artificial Sequence
  chemically synthesized
tgtttgtgtctaaggctgac

SEQ ID NO: 48935 - DNA, 20 bp, Artificial Sequence
  chemically synthesized
gtttgtgtctaaggctgact

SEQ ID NO: 48936 - DNA, 20 bp, Artificial Sequence
  chemically synthesized
taaggctgactgggtaactt

SEQ ID NO: 48937 - DNA, 20 bp, Artificial Sequence
  chemically synthesized
ctgactgggtaactttggat

SEQ ID NO: 48938 - DNA, 20 bp, Artificial Sequence
  chemically synthesized
actgggtaactttggatgag

SEQ ID NO: 48939 - DNA, 20 bp, Artificial Sequence
  chemically synthesized
atgagcggtctctccgctct

SEQ ID NO: 48940 - DNA, 20 bp, Artificial Sequence
  chemically synthesized
ctgtttcctcatctgtcaaa

SEQ ID NO: 48941 - DNA, 20 bp, Artificial Sequence
  chemically synthesized
tgtttcctcatctgtcaaat

SEQ ID NO: 48942 - DNA, 20 bp, Artificial Sequence
  chemically synthesized
tctaacccactctgatctcc

SEQ ID NO: 48943 - DNA, 20 bp, Artificial Sequence
  chemically synthesized
ctaacccactctgatctccc

SEQ ID NO: 48944 - DNA, 20 bp, Artificial Sequence
  chemically synthesized
taacccactctgatctccca

SEQ ID NO: 48945 - DNA, 20 bp, Artificial Sequence
  chemically synthesized
cccactctgatctcccaggg

SEQ ID NO: 48946 - DNA, 20 bp, Artificial Sequence
  chemically synthesized
actctgatctcccagggcgg

SEQ ID NO: 48947 - DNA, 20 bp, Artificial Sequence
  chemically synthesized
tgatctcccagggcggcagt

SEQ ID NO: 48948 - DNA, 20 bp, Artificial Sequence
  chemically synthesized
ccagggcggcagtaagtctt

SEQ ID NO: 48949 - DNA, 20 bp, Artificial Sequence
  chemically synthesized
cggcagtaagtcttcagcat

SEQ ID NO: 48950 - DNA, 20 bp, Artificial Sequence
  chemically synthesized
ggcagtaagtcttcagcatc

SEQ ID NO: 48951 - DNA, 20 bp, Artificial Sequence
  chemically synthesized
gtcttcagcatcaggcattt

SEQ ID NO: 48952 - DNA, 20 bp, Artificial Sequence
  chemically synthesized
tcttcagcatcaggcatttt

SEQ ID NO: 48953 - DNA, 20 bp, Artificial Sequence
  chemically synthesized
cttcagcatcaggcattttg

SEQ ID NO: 48954 - DNA, 20 bp, Artificial Sequence
  chemically synthesized
tcaggcattttggggtgact

SEQ ID NO: 48955 - DNA, 20 bp, Artificial Sequence
  chemically synthesized
ttttggggtgactcagtaaa

SEQ ID NO: 48956 - DNA, 20 bp, Artificial Sequence
  chemically synthesized
tggggtgactcagtaaatgg

SEQ ID NO: 48957 - DNA, 20 bp, Artificial Sequence
  chemically synthesized
taaatggtagatcttgctac

SEQ ID NO: 48958 - DNA, 20 bp, Artificial Sequence
  chemically synthesized
atggtagatcttgctaccag

SEQ ID NO: 48959 - DNA, 20 bp, Artificial Sequence
  chemically synthesized
agatcttgctaccagtggaa

SEQ ID NO: 48960 - DNA, 20 bp, Artificial Sequence
  chemically synthesized
ctaccagtggaacagccact

SEQ ID NO: 48961 - DNA, 20 bp, Artificial Sequence
  chemically synthesized
taccagtggaacagccacta

SEQ ID NO: 48962 - DNA, 20 bp, Artificial Sequence
  chemically synthesized
aacagccactaaggattctg

SEQ ID NO: 48963 - DNA, 20 bp, Artificial Sequence
  chemically synthesized
gccactaaggattctgcagt

SEQ ID NO: 48964 - DNA, 20 bp, Artificial Sequence
  chemically synthesized
cactaaggattctgcagtga

SEQ ID NO: 48965 - DNA, 20 bp, Artificial Sequence
  chemically synthesized
taaggattctgcagtgagag

SEQ ID NO: 48966 - DNA, 20 bp, Artificial Sequence
  chemically synthesized
aggattctgcagtgagagca

SEQ ID NO: 48967 - DNA, 20 bp, Artificial Sequence
  chemically synthesized
ggattctgcagtgagagcag

SEQ ID NO: 48968 - DNA, 20 bp, Artificial Sequence
  chemically synthesized
gattctgcagtgagagcaga

SEQ ID NO: 48969 - DNA, 20 bp, Artificial Sequence
  chemically synthesized
ctgcagtgagagcagagggc

SEQ ID NO: 48970 - DNA, 20 bp, Artificial Sequence
  chemically synthesized
gtgagagcagagggccagct

SEQ ID NO: 48971 - DNA, 20 bp, Artificial Sequence
  chemically synthesized
agagcagagggccagctaag

SEQ ID NO: 48972 - DNA, 20 bp, Artificial Sequence
  chemically synthesized
ccagctaagtggtactctcc

SEQ ID NO: 48973 - DNA, 20 bp, Artificial Sequence
  chemically synthesized
agctaagtggtactctccca

SEQ ID NO: 48974 - DNA, 20 bp, Artificial Sequence
  chemically synthesized
tcacgccaccccctccacct

SEQ ID NO: 48975 - DNA, 20 bp, Artificial Sequence
  chemically synthesized
caccccctccaccttggaca

SEQ ID NO: 48976 - DNA, 20 bp, Artificial Sequence
  chemically synthesized
accccctccaccttggacac

SEQ ID NO: 48977 - DNA, 20 bp, Artificial Sequence
  chemically synthesized
accttggacacaggacgctg

SEQ ID NO: 48978 - DNA, 20 bp, Artificial Sequence
  chemically synthesized
cacaggacgctgtggtttct

SEQ ID NO: 48979 - DNA, 20 bp, Artificial Sequence
  chemically synthesized
ggacgctgtggtttctgagc

SEQ ID NO: 48980 - DNA, 20 bp, Artificial Sequence
  chemically synthesized
gacgctgtggtttctgagcc

SEQ ID NO: 48981 - DNA, 20 bp, Artificial Sequence
  chemically synthesized
ccaggtacaatgactccttt

SEQ ID NO: 48982 - DNA, 20 bp, Artificial Sequence
  chemically synthesized
gtacaatgactcctttcggt

SEQ ID NO: 48983 - DNA, 20 bp, Artificial Sequence
  chemically synthesized
atgactcctttcggtaagtg

SEQ ID NO: 48984 - DNA, 20 bp, Artificial Sequence
  chemically synthesized
actcctttcggtaagtgcag

SEQ ID NO: 48985 - DNA, 20 bp, Artificial Sequence
  chemically synthesized
cctttcggtaagtgcagtgg

SEQ ID NO: 48986 - DNA, 20 bp, Artificial Sequence
  chemically synthesized
agtggaagctgtacactgcc

SEQ ID NO: 48987 - DNA, 20 bp, Artificial Sequence
  chemically synthesized
gtggaagctgtacactgccc

SEQ ID NO: 48988 - DNA, 20 bp, Artificial Sequence
  chemically synthesized
agctgtacactgcccaggca

SEQ ID NO: 48989 - DNA, 20 bp, Artificial Sequence
  chemically synthesized
cactgcccaggcaaagcgtc

SEQ ID NO: 48990 - DNA, 20 bp, Artificial Sequence
  chemically synthesized
actgcccaggcaaagcgtcc

SEQ ID NO: 48991 - DNA, 20 bp, Artificial Sequence
  chemically synthesized
gcccaggcaaagcgtccggg

SEQ ID NO: 48992 - DNA, 20 bp, Artificial Sequence
  chemically synthesized
ggcaaagcgtccgggcagcg

SEQ ID NO: 48993 - DNA, 20 bp, Artificial Sequence
  chemically synthesized
gcaaagcgtccgggcagcgt

SEQ ID NO: 48994 - DNA, 20 bp, Artificial Sequence
  chemically synthesized
aagcgtccgggcagcgtagg

SEQ ID NO: 48995 - DNA, 20 bp, Artificial Sequence
  chemically synthesized
agcgtccgggcagcgtaggc

SEQ ID NO: 48996 - DNA, 20 bp, Artificial Sequence
  chemically synthesized
ggcagcgtaggcgggcgact

SEQ ID NO: 48997 - DNA, 20 bp, Artificial Sequence
  chemically synthesized
taggcgggcgactcagatcc

SEQ ID NO: 48998 - DNA, 20 bp, Artificial Sequence
  chemically synthesized
cgggcgactcagatcccagc

SEQ ID NO: 48999 - DNA, 20 bp, Artificial Sequence
  chemically synthesized
gcgactcagatcccagccag

SEQ ID NO: 49000 - DNA, 20 bp, Artificial Sequence
  chemically synthesized
cagatcccagccagtggact

SEQ ID NO: 49001 - DNA, 20 bp, Artificial Sequence
  chemically synthesized
ctgtttgctcctccgataac

SEQ ID NO: 49002 - DNA, 20 bp, Artificial Sequence
  chemically synthesized
tgtttgctcctccgataact

SEQ ID NO: 49003 - DNA, 20 bp, Artificial Sequence
  chemically synthesized
gtttgctcctccgataactg

SEQ ID NO: 49004 - DNA, 20 bp, Artificial Sequence
  chemically synthesized
tccgataactggggtgacct

SEQ ID NO: 49005 - DNA, 20 bp, Artificial Sequence
  chemically synthesized
tgaccttggttaatattcac

SEQ ID NO: 49006 - DNA, 20 bp, Artificial Sequence
  chemically synthesized
ccttggttaatattcaccag

SEQ ID NO: 49007 - DNA, 20 bp, Artificial Sequence
  chemically synthesized
agcctcccccgttgcccctc

SEQ ID NO: 49008 - DNA, 20 bp, Artificial Sequence
  chemically synthesized
ctggatccactgcttaaata

SEQ ID NO: 49009 - DNA, 20 bp, Artificial Sequence
  chemically synthesized
tccactgcttaaatacggac

SEQ ID NO: 49010 - DNA, 20 bp, Artificial Sequence
  chemically synthesized
ccactgcttaaatacggacg

SEQ ID NO: 49011 - DNA, 20 bp, Artificial Sequence
  chemically synthesized
tgcttaaatacggacgagga

SEQ ID NO: 49012 - DNA, 20 bp, Artificial Sequence
  chemically synthesized
gcttaaatacggacgaggac

SEQ ID NO: 49013 - DNA, 20 bp, Artificial Sequence
  chemically synthesized
cttaaatacggacgaggaca

SEQ ID NO: 49014 - DNA, 20 bp, Artificial Sequence
  chemically synthesized
aggacagggccctgtctcct

SEQ ID NO: 49015 - DNA, 20 bp, Artificial Sequence
  chemically synthesized
gggccctgtctcctcagctt

SEQ ID NO: 49016 - DNA, 20 bp, Artificial Sequence
  chemically synthesized
ggccctgtctcctcagcttc

SEQ ID NO: 49017 - DNA, 20 bp, Artificial Sequence
  chemically synthesized
ttcaggcaccaccactgacc

SEQ ID NO: 49018 - DNA, 20 bp, Artificial Sequence
  chemically synthesized
tcaggcaccaccactgacct

SEQ ID NO: 49019 - DNA, 20 bp, Artificial Sequence
  chemically synthesized
gcaccaccactgacctggga

SEQ ID NO: 49020 - DNA, 20 bp, Artificial Sequence
  chemically synthesized
gacctgggacagtgaatcgt

SEQ ID NO: 49021 - DNA, 20 bp, Artificial Sequence
  chemically synthesized
gtaagtatgcctttcactgc

SEQ ID NO: 49022 - DNA, 20 bp, Artificial Sequence
  chemically synthesized
aagtatgcctttcactgcga

SEQ ID NO: 49023 - DNA, 20 bp, Artificial Sequence
  chemically synthesized
agtatgcctttcactgcgag

SEQ ID NO: 49024 - DNA, 20 bp, Artificial Sequence
  chemically synthesized
cctttcactgcgagaggttc

SEQ ID NO: 49025 - DNA, 20 bp, Artificial Sequence
  chemically synthesized
tttcactgcgagaggttctg

SEQ ID NO: 49026 - DNA, 20 bp, Artificial Sequence
  chemically synthesized
tcactgcgagaggttctgga

SEQ ID NO: 49027 - DNA, 20 bp, Artificial Sequence
  chemically synthesized
cactgcgagaggttctggag

SEQ ID NO: 49028 - DNA, 20 bp, Artificial Sequence
  chemically synthesized
gaggttctggagaggcttct

SEQ ID NO: 49029 - DNA, 20 bp, Artificial Sequence
  chemically synthesized
agaggcttctgagctcccca

SEQ ID NO: 49030 - DNA, 20 bp, Artificial Sequence
  chemically synthesized
cttctgagctccccatggcc

SEQ ID NO: 49031 - DNA, 20 bp, Artificial Sequence
  chemically synthesized
ttctgagctccccatggccc

SEQ ID NO: 49032 - DNA, 20 bp, Artificial Sequence
  chemically synthesized
tgagctccccatggcccagg

SEQ ID NO: 49033 - DNA, 20 bp, Artificial Sequence
  chemically synthesized
gagctccccatggcccaggc

SEQ ID NO: 49034 - DNA, 20 bp, Artificial Sequence
  chemically synthesized
ctccccatggcccaggcagg

SEQ ID NO: 49035 - DNA, 20 bp, Artificial Sequence
  chemically synthesized
cccatggcccaggcaggcag

SEQ ID NO: 49036 - DNA, 20 bp, Artificial Sequence
  chemically synthesized
ccatggcccaggcaggcagc

SEQ ID NO: 49037 - DNA, 20 bp, Artificial Sequence
  chemically synthesized
gcccaggcaggcagcaggtc

SEQ ID NO: 49038 - DNA, 20 bp, Artificial Sequence
  chemically synthesized
cccaggcaggcagcaggtct

SEQ ID NO: 49039 - DNA, 20 bp, Artificial Sequence
  chemically synthesized
ccaggcaggcagcaggtctg

SEQ ID NO: 49040 - DNA, 20 bp, Artificial Sequence
  chemically synthesized
ggcaggcagcaggtctgggg

SEQ ID NO: 49041 - DNA, 20 bp, Artificial Sequence
  chemically synthesized
gcaggcagcaggtctggggc

SEQ ID NO: 49042 - DNA, 20 bp, Artificial Sequence
  chemically synthesized
aggcagcaggtctggggcag

SEQ ID NO: 49043 - DNA, 20 bp, Artificial Sequence
  chemically synthesized
ggcagcaggtctggggcagg

SEQ ID NO: 49044 - DNA, 20 bp, Artificial Sequence
  chemically synthesized
gcagcaggtctggggcagga

SEQ ID NO: 49045 - DNA, 20 bp, Artificial Sequence
  chemically synthesized
cagcaggtctggggcaggag

SEQ ID NO: 49046 - DNA, 20 bp, Artificial Sequence
  chemically synthesized
agcaggtctggggcaggagg

SEQ ID NO: 49047 - DNA, 20 bp, Artificial Sequence
  chemically synthesized
gcaggtctggggcaggaggg

SEQ ID NO: 49048 - DNA, 20 bp, Artificial Sequence
  chemically synthesized
ctggggcaggaggggggttg

SEQ ID NO: 49049 - DNA, 20 bp, Artificial Sequence
  chemically synthesized
ggggcaggaggggggttgtg

SEQ ID NO: 49050 - DNA, 20 bp, Artificial Sequence
  chemically synthesized
gcaggaggggggttgtggag

SEQ ID NO: 49051 - DNA, 20 bp, Artificial Sequence
  chemically synthesized
caggaggggggttgtggagt

SEQ ID NO: 49052 - DNA, 20 bp, Artificial Sequence
  chemically synthesized
ggagtgggtatccgcctgct

SEQ ID NO: 49053 - DNA, 20 bp, Artificial Sequence
  chemically synthesized
gagtgggtatccgcctgctg

SEQ ID NO: 49054 - DNA, 20 bp, Artificial Sequence
  chemically synthesized
ggtatccgcctgctgaggtg

SEQ ID NO: 49055 - DNA, 20 bp, Artificial Sequence
  chemically synthesized
gtatccgcctgctgaggtgc

SEQ ID NO: 49056 - DNA, 20 bp, Artificial Sequence
  chemically synthesized
tatccgcctgctgaggtgca

SEQ ID NO: 49057 - DNA, 20 bp, Artificial Sequence
  chemically synthesized
ccgcctgctgaggtgcaggg

SEQ ID NO: 49058 - DNA, 20 bp, Artificial Sequence
  chemically synthesized
ctgctgaggtgcagggcaga

SEQ ID NO: 49059 - DNA, 20 bp, Artificial Sequence
  chemically synthesized
gctgaggtgcagggcagatg

SEQ ID NO: 49060 - DNA, 20 bp, Artificial Sequence
  chemically synthesized
tgaggtgcagggcagatgga

SEQ ID NO: 49061 - DNA, 20 bp, Artificial Sequence
  chemically synthesized
gaggtgcagggcagatggag

SEQ ID NO: 49062 - DNA, 20 bp, Artificial Sequence
  chemically synthesized
cagggcagatggagaggctg

SEQ ID NO: 49063 - DNA, 20 bp, Artificial Sequence
  chemically synthesized
cagatggagaggctgcagct

SEQ ID NO: 49064 - DNA, 20 bp, Artificial Sequence
  chemically synthesized
agctcctattttcataataa

SEQ ID NO: 49065 - DNA, 20 bp, Artificial Sequence
  chemically synthesized
tcctattttcataataacag

SEQ ID NO: 49066 - DNA, 20 bp, Artificial Sequence
  chemically synthesized
ttcataataacagcagccat

SEQ ID NO: 49067 - DNA, 20 bp, Artificial Sequence
  chemically synthesized
tcataataacagcagccatg

SEQ ID NO: 49068 - DNA, 20 bp, Artificial Sequence
  chemically synthesized
cataataacagcagccatga

SEQ ID NO: 49069 - DNA, 20 bp, Artificial Sequence
  chemically synthesized
gagggttgtgtcctgtttcc

SEQ ID NO: 49070 - DNA, 20 bp, Artificial Sequence
  chemically synthesized
tcctgtttcccagtcctgcc

SEQ ID NO: 49071 - DNA, 20 bp, Artificial Sequence
  chemically synthesized
agtcctgcccggtcccccct

SEQ ID NO: 49072 - DNA, 20 bp, Artificial Sequence
  chemically synthesized
ggtcccccctcggtacctcc

SEQ ID NO: 49073 - DNA, 20 bp, Artificial Sequence
  chemically synthesized
cccccctcggtacctcctgg

SEQ ID NO: 49074 - DNA, 20 bp, Artificial Sequence
  chemically synthesized
gtacctcctggtggatacac

SEQ ID NO: 49075 - DNA, 20 bp, Artificial Sequence
  chemically synthesized
gtggatacactggttcctgt

SEQ ID NO: 49076 - DNA, 20 bp, Artificial Sequence
  chemically synthesized
gatacactggttcctgtaag

SEQ ID NO: 49077 - DNA, 20 bp, Artificial Sequence
  chemically synthesized
acactggttcctgtaagcag

SEQ ID NO: 49078 - DNA, 20 bp, Artificial Sequence
  chemically synthesized
ctggttcctgtaagcagaag

SEQ ID NO: 49079 - DNA, 20 bp, Artificial Sequence
  chemically synthesized
tcctgtaagcagaagtggat

SEQ ID NO: 49080 - DNA, 20 bp, Artificial Sequence
  chemically synthesized
cctgtaagcagaagtggatg

SEQ ID NO: 49081 - DNA, 20 bp, Artificial Sequence
  chemically synthesized
ctgtaagcagaagtggatga

SEQ ID NO: 49082 - DNA, 20 bp, Artificial Sequence
  chemically synthesized
cagaagtggatgagggtgtc

SEQ ID NO: 49083 - DNA, 20 bp, Artificial Sequence
  chemically synthesized
agaagtggatgagggtgtct

SEQ ID NO: 49084 - DNA, 20 bp, Artificial Sequence
  chemically synthesized
gatgagggtgtctaggtctg

SEQ ID NO: 49085 - DNA, 20 bp, Artificial Sequence
  chemically synthesized
ggtgtctaggtctgcagtcc

SEQ ID NO: 49086 - DNA, 20 bp, Artificial Sequence
  chemically synthesized
ggtctgcagtcctggcaccc

SEQ ID NO: 49087 - DNA, 20 bp, Artificial Sequence
  chemically synthesized
gtctgcagtcctggcacccc

SEQ ID NO: 49088 - DNA, 20 bp, Artificial Sequence
  chemically synthesized
gcagtcctggcaccccagga

SEQ ID NO: 49089 - DNA, 20 bp, Artificial Sequence
  chemically synthesized
cagtcctggcaccccaggat

SEQ ID NO: 49090 - DNA, 20 bp, Artificial Sequence
  chemically synthesized
agtcctggcaccccaggatg

SEQ ID NO: 49091 - DNA, 20 bp, Artificial Sequence
  chemically synthesized
gtcctggcaccccaggatgg

SEQ ID NO: 49092 - DNA, 20 bp, Artificial Sequence
  chemically synthesized
caccccaggatgggggacac

SEQ ID NO: 49093 - DNA, 20 bp, Artificial Sequence
  chemically synthesized
caggatgggggacaccagcc

SEQ ID NO: 49094 - DNA, 20 bp, Artificial Sequence
  chemically synthesized
gggggacaccagccaagata

SEQ ID NO: 49095 - DNA, 20 bp, Artificial Sequence
  chemically synthesized
caccagccaagatacagcaa

SEQ ID NO: 49096 - DNA, 20 bp, Artificial Sequence
  chemically synthesized
aagatacagcaacagcaaca

SEQ ID NO: 49097 - DNA, 20 bp, Artificial Sequence
  chemically synthesized
acagcaacagcaacaaagcg

SEQ ID NO: 49098 - DNA, 20 bp, Artificial Sequence
  chemically synthesized
gccatttctttctgtttgca

SEQ ID NO: 49099 - DNA, 20 bp, Artificial Sequence
  chemically synthesized
tgcacagctcctctgtctgt

SEQ ID NO: 49100 - DNA, 20 bp, Artificial Sequence
  chemically synthesized
gcacagctcctctgtctgtc

SEQ ID NO: 49101 - DNA, 20 bp, Artificial Sequence
  chemically synthesized
cacagctcctctgtctgtcg

SEQ ID NO: 49102 - DNA, 20 bp, Artificial Sequence
  chemically synthesized
acagctcctctgtctgtcgg

SEQ ID NO: 49103 - DNA, 20 bp, Artificial Sequence
  chemically synthesized
tcctgtctgttgtctcctat

SEQ ID NO: 49104 - DNA, 20 bp, Artificial Sequence
  chemically synthesized
tcaccacctctcctactgct

SEQ ID NO: 49105 - DNA, 20 bp, Artificial Sequence
  chemically synthesized
caccacctctcctactgctt

SEQ ID NO: 49106 - DNA, 20 bp, Artificial Sequence
  chemically synthesized
tgcatctttctccccttcta

SEQ ID NO: 49107 - DNA, 20 bp, Artificial Sequence
  chemically synthesized
ctttctccccttctatagat

SEQ ID NO: 49108 - DNA, 20 bp, Artificial Sequence
  chemically synthesized
tttctccccttctatagatg

SEQ ID NO: 49109 - DNA, 20 bp, Artificial Sequence
  chemically synthesized
tctccccttctatagatgag

SEQ ID NO: 49110 - DNA, 20 bp, Artificial Sequence
  chemically synthesized
ctccccttctatagatgagg

SEQ ID NO: 49111 - DNA, 20 bp, Artificial Sequence
  chemically synthesized
cttctatagatgaggaggtt

SEQ ID NO: 49112 - DNA, 20 bp, Artificial Sequence
  chemically synthesized
ttctatagatgaggaggtta

SEQ ID NO: 49113 - DNA, 20 bp, Artificial Sequence
  chemically synthesized
tagatgaggaggttaaggtc

SEQ ID NO: 49114 - DNA, 20 bp, Artificial Sequence
  chemically synthesized
gatgaggaggttaaggtcca

SEQ ID NO: 49115 - DNA, 20 bp, Artificial Sequence
  chemically synthesized
tgaggaggttaaggtccaga

SEQ ID NO: 49116 - DNA, 20 bp, Artificial Sequence
  chemically synthesized
gaggaggttaaggtccagag

SEQ ID NO: 49117 - DNA, 20 bp, Artificial Sequence
  chemically synthesized
aggaggttaaggtccagaga

SEQ ID NO: 49118 - DNA, 20 bp, Artificial Sequence
  chemically synthesized
ggaggttaaggtccagagag

SEQ ID NO: 49119 - DNA, 20 bp, Artificial Sequence
  chemically synthesized
ggttaaggtccagagagggg

SEQ ID NO: 49120 - DNA, 20 bp, Artificial Sequence
  chemically synthesized
gttaaggtccagagaggggt

SEQ ID NO: 49121 - DNA, 20 bp, Artificial Sequence
  chemically synthesized
ttaaggtccagagaggggtg

SEQ ID NO: 49122 - DNA, 20 bp, Artificial Sequence
  chemically synthesized
aaggtccagagaggggtggg

SEQ ID NO: 49123 - DNA, 20 bp, Artificial Sequence
  chemically synthesized
aggtccagagaggggtgggg

SEQ ID NO: 49124 - DNA, 20 bp, Artificial Sequence
  chemically synthesized
agaggggtggggaggaacgc

SEQ ID NO: 49125 - DNA, 20 bp, Artificial Sequence
  chemically synthesized
ctcacattctccatcccctc

SEQ ID NO: 49126 - DNA, 20 bp, Artificial Sequence
  chemically synthesized
ccatcccctccagatatgac

SEQ ID NO: 49127 - DNA, 20 bp, Artificial Sequence
  chemically synthesized
catcccctccagatatgacc

SEQ ID NO: 49128 - DNA, 20 bp, Artificial Sequence
  chemically synthesized
cctccagatatgaccaggaa

SEQ ID NO: 49129 - DNA, 20 bp, Artificial Sequence
  chemically synthesized
gaccaggaacagacctgtgc

SEQ ID NO: 49130 - DNA, 20 bp, Artificial Sequence
  chemically synthesized
accaggaacagacctgtgcc

SEQ ID NO: 49131 - DNA, 20 bp, Artificial Sequence
  chemically synthesized
aacagacctgtgccaggcct

SEQ ID NO: 49132 - DNA, 20 bp, Artificial Sequence
  chemically synthesized
tgttcctggtcatatctgga

SEQ ID NO: 49133 - DNA, 20 bp, Artificial Sequence
  chemically synthesized
ggtcatatctggaggggatg

SEQ ID NO: 49134 - DNA, 20 bp, Artificial Sequence
  chemically synthesized
ttggctggtgtcccccatcc

SEQ ID NO: 49135 - DNA, 20 bp, Artificial Sequence
  chemically synthesized
tctgccctgcacctcagcag

SEQ ID NO: 49136 - DNA, 20 bp, Artificial Sequence
  chemically synthesized
tcctcgtccgtatttaagca

SEQ ID NO: 49137 - DNA, 20 bp, Artificial Sequence
  chemically synthesized
ggcaacgggggaggctgctg

SEQ ID NO: 49138 - DNA, 20 bp, Artificial Sequence
  chemically synthesized
caggggctaagtccactggc

SEQ ID NO: 49139 - DNA, 20 bp, Artificial Sequence
  chemically synthesized
ctaagtccactggctgggat

SEQ ID NO: 49140 - DNA, 20 bp, Artificial Sequence
  chemically synthesized
cttccactgcacttaccgaa

SEQ ID NO: 49141 - DNA, 20 bp, Artificial Sequence
  chemically synthesized
cgtcctgtgtccaaggtgga

SEQ ID NO: 49142 - DNA, 20 bp, Artificial Sequence
  chemically synthesized
tccaaggtggagggggtggc

SEQ ID NO: 49143 - DNA, 20 bp, Artificial Sequence
  chemically synthesized
gtgagtcagacagtctctgg

SEQ ID NO: 49144 - DNA, 20 bp, Artificial Sequence
  chemically synthesized
ctggccctctgctctcactg

SEQ ID NO: 49145 - DNA, 20 bp, Artificial Sequence
  chemically synthesized
gtagcaagatctaccattta

SEQ ID NO: 49146 - DNA, 20 bp, Artificial Sequence
  chemically synthesized
ttactgccgccctgggagat

SEQ ID NO: 49147 - DNA, 20 bp, Artificial Sequence
  chemically synthesized
tgccgccctgggagatcaga

SEQ ID NO: 49148 - DNA, 20 bp, Artificial Sequence
  chemically synthesized
tggcatggggggccgtgaga

SEQ ID NO: 49149 - DNA, 20 bp, Artificial Sequence
  chemically synthesized
actgtttcacctgcatccca

SEQ ID NO: 49150 - DNA, 20 bp, Artificial Sequence
  chemically synthesized
aagcatgcttgtgaagtgcc

SEQ ID NO: 49151 - DNA, 20 bp, Artificial Sequence
  chemically synthesized
gcacacagtaggctctttat

SEQ ID NO: 49152 - DNA, 20 bp, Artificial Sequence
  chemically synthesized
agtgtgatccgtatacagct

SEQ ID NO: 49153 - DNA, 20 bp, Artificial Sequence
  chemically synthesized
gtatacagcttggagtttct

SEQ ID NO: 49154 - DNA, 20 bp, Artificial Sequence
  chemically synthesized
tggatacatggcccccactc

SEQ ID NO: 49155 - DNA, 20 bp, Artificial Sequence
  chemically synthesized
ggaggcctttggagactgct

SEQ ID NO: 49156 - DNA, 20 bp, Artificial Sequence
  chemically synthesized
ggtggaggggaggggaggta

SEQ ID NO: 49157 - DNA, 20 bp, Artificial Sequence
  chemically synthesized
gtacgtgccgtagatacttg

SEQ ID NO: 49158 - DNA, 20 bp, Artificial Sequence
  chemically synthesized
gtgccgtagatacttgcaga

SEQ ID NO: 49159 - DNA, 20 bp, Artificial Sequence
  chemically synthesized
cgtagatacttgcagagtga

SEQ ID NO: 49160 - DNA, 20 bp, Artificial Sequence
  chemically synthesized
gatacttgcagagtgaatgg

SEQ ID NO: 49161 - DNA, 20 bp, Artificial Sequence
  chemically synthesized
ccaccttggggctctaccag

SEQ ID NO: 49162 - DNA, 20 bp, Artificial Sequence
  chemically synthesized
tctaccaggcgagtgaccca

SEQ ID NO: 49163 - DNA, 20 bp, Artificial Sequence
  chemically synthesized
tactggctgtgaggcctcag

SEQ ID NO: 49164 - DNA, 20 bp, Artificial Sequence
  chemically synthesized
aatttccctatctgtaaaat

SEQ ID NO: 49165 - DNA, 20 bp, Artificial Sequence
  chemically synthesized
gtaccttgttgagctgctgt

SEQ ID NO: 49166 - DNA, 20 bp, Artificial Sequence
  chemically synthesized
agttcaaggaaagctcagag

SEQ ID NO: 49167 - DNA, 20 bp, Artificial Sequence
  chemically synthesized
ggaaagctcagagacgggta

SEQ ID NO: 49168 - DNA, 20 bp, Artificial Sequence
  chemically synthesized
gtgtcaggggctggtgtcac

SEQ ID NO: 49169 - DNA, 20 bp, Artificial Sequence
  chemically synthesized
aggggctggtgtcactgggg

SEQ ID NO: 49170 - DNA, 20 bp, Artificial Sequence
  chemically synthesized
tcattcagttaccctgtgaa

SEQ ID NO: 49171 - DNA, 20 bp, Artificial Sequence
  chemically synthesized
ctgtccttcccctgagctgg

SEQ ID NO: 49172 - DNA, 20 bp, Artificial Sequence
  chemically synthesized
ccttcccctgagctggctga

SEQ ID NO: 49173 - DNA, 20 bp, Artificial Sequence
  chemically synthesized
tgtccctcccacctgtggaa

SEQ ID NO: 49174 - DNA, 20 bp, Artificial Sequence
  chemically synthesized
gtctcttctggcaggcacag

SEQ ID NO: 49175 - DNA, 20 bp, Artificial Sequence
  chemically synthesized
aggttgccgcccctccaacc

SEQ ID NO: 49176 - DNA, 20 bp, Artificial Sequence
  chemically synthesized
ttggttcagctcaggactct

SEQ ID NO: 49177 - DNA, 20 bp, Artificial Sequence
  chemically synthesized
gcccacccaggaagtagact

SEQ ID NO: 49178 - DNA, 20 bp, Artificial Sequence
  chemically synthesized
ggacaagtcaccctctccct

SEQ ID NO: 49179 - DNA, 20 bp, Artificial Sequence
  chemically synthesized
aggtacagtcacactgccca

SEQ ID NO: 49180 - DNA, 20 bp, Artificial Sequence
  chemically synthesized
cttgcggcaactcaaaggga

SEQ ID NO: 49181 - DNA, 20 bp, Artificial Sequence
  chemically synthesized
aagggagagggtgacttgtc

SEQ ID NO: 49182 - DNA, 20 bp, Artificial Sequence
  chemically synthesized
caggtgacatgccgggctgt

SEQ ID NO: 49183 - DNA, 20 bp, Artificial Sequence
  chemically synthesized
ctccacccgaagtctacttc

SEQ ID NO: 49184 - DNA, 20 bp, Artificial Sequence
  chemically synthesized
tgcctccacgcagcaaccct

SEQ ID NO: 49185 - DNA, 20 bp, Artificial Sequence
  chemically synthesized
agctgaaccaagaaggagga

SEQ ID NO: 49186 - DNA, 20 bp, Artificial Sequence
  chemically synthesized
gcctagccgctgctgctgcc

SEQ ID NO: 49187 - DNA, 20 bp, Artificial Sequence
  chemically synthesized
gtgggagggacagcagggct

SEQ ID NO: 49188 - DNA, 20 bp, Artificial Sequence
  chemically synthesized
gggacagcagggcttagagt

SEQ ID NO: 49189 - DNA, 20 bp, Artificial Sequence
  chemically synthesized
cacagcccagtgctggagct

SEQ ID NO: 49190 - DNA, 20 bp, Artificial Sequence
  chemically synthesized
gcccagtgctggagctgtga

SEQ ID NO: 49191 - DNA, 20 bp, Artificial Sequence
  chemically synthesized
tgtgagtggatgtagagcag

SEQ ID NO: 49192 - DNA, 20 bp, Artificial Sequence
  chemically synthesized
ggacaggggccctgaagcca

SEQ ID NO: 49193 - DNA, 20 bp, Artificial Sequence
  chemically synthesized
gagctcagagagaaggggag

SEQ ID NO: 49194 - DNA, 20 bp, Artificial Sequence
  chemically synthesized
agtttcccgctgcctgaaag

SEQ ID NO: 49195 - DNA, 20 bp, Artificial Sequence
  chemically synthesized
ggtggtacctactcccttca

SEQ ID NO: 49196 - DNA, 20 bp, Artificial Sequence
  chemically synthesized
ctactcccttcacagggtaa

SEQ ID NO: 49197 - DNA, 20 bp, Artificial Sequence
  chemically synthesized
tgaggcctcacagccagtaa

SEQ ID NO: 49198 - DNA, 20 bp, Artificial Sequence
  chemically synthesized
cagtaagtgggttccctggt

SEQ ID NO: 49199 - DNA, 20 bp, Artificial Sequence
  chemically synthesized
tggtctgaatgtgtgtgctg

SEQ ID NO: 49200 - DNA, 20 bp, Artificial Sequence
  chemically synthesized
tgtgtgtgctggaggatcct

SEQ ID NO: 49201 - DNA, 20 bp, Artificial Sequence
  chemically synthesized
tggaggcataaatgggactg

SEQ ID NO: 49202 - DNA, 20 bp, Artificial Sequence
  chemically synthesized
gccagctcccaagcaggttt

SEQ ID NO: 49203 - DNA, 20 bp, Artificial Sequence
  chemically synthesized
aatctgatttaggcttttaa

SEQ ID NO: 49204 - DNA, 20 bp, Artificial Sequence
  chemically synthesized
ccaaaggcctccaacaaccc

SEQ ID NO: 49205 - DNA, 20 bp, Artificial Sequence
  chemically synthesized
aaagaaactccaagctgtat

SEQ ID NO: 49206 - DNA, 20 bp, Artificial Sequence
  chemically synthesized
ggcacttcacaagcatgctt

SEQ ID NO: 49207 - DNA, 20 bp, Artificial Sequence
  chemically synthesized
gaatgaaacttccaactctt

SEQ ID NO: 49208 - DNA, 20 bp, Artificial Sequence
  chemically synthesized
ttttccatcgggaccatcaa

SEQ ID NO: 49209 - DNA, 20 bp, Artificial Sequence
  chemically synthesized
gtgtttgtgtctaaggctga

SEQ ID NO: 49210 - DNA, 20 bp, Artificial Sequence
  chemically synthesized
ctaaggctgactgggtaact

SEQ ID NO: 49211 - DNA, 20 bp, Artificial Sequence
  chemically synthesized
gtcttcagcatcaggcattt

SEQ ID NO: 49212 - DNA, 20 bp, Artificial Sequence
  chemically synthesized
ctaccagtggaacagccact

SEQ ID NO: 49213 - DNA, 20 bp, Artificial Sequence
  chemically synthesized
ctgtttgctcctccgataac

SEQ ID NO: 49214 - DNA, 20 bp, Artificial Sequence
  chemically synthesized
cagcctcccccgttgcccct

SEQ ID NO: 49215 - DNA, 20 bp, Artificial Sequence
  chemically synthesized
accaccactgacctgggaca

SEQ ID NO: 49216 - DNA, 20 bp, Artificial Sequence
  chemically synthesized
cagcaggtctggggcaggag

SEQ ID NO: 49217 - DNA, 20 bp, Artificial Sequence
  chemically synthesized
ctggggcaggaggggggttg

SEQ ID NO: 49218 - DNA, 20 bp, Artificial Sequence
  chemically synthesized
ggcaggaggggggttgtgga

SEQ ID NO: 49219 - DNA, 20 bp, Artificial Sequence
  chemically synthesized
ttcataataacagcagccat

SEQ ID NO: 49220 - DNA, 20 bp, Artificial Sequence
  chemically synthesized
tcccccctcggtacctcctg

SEQ ID NO: 49221 - DNA, 20 bp, Artificial Sequence
  chemically synthesized
actggttcctgtaagcagaa

SEQ ID NO: 49222 - DNA, 20 bp, Artificial Sequence
  chemically synthesized
tcctgtaagcagaagtggat

SEQ ID NO: 49223 - DNA, 20 bp, Artificial Sequence
  chemically synthesized
ggtctgcagtcctggcaccc

SEQ ID NO: 49224 - DNA, 20 bp, Artificial Sequence
  chemically synthesized
gaggaggttaaggtccagag

SEQ ID NO: 49225 - DNA, 20 bp, Artificial Sequence
  chemically synthesized
tggtcatatctggaggggat

SEQ ID NO: 49226 - DNA, 20 bp, Artificial Sequence
  chemically synthesized
acctcctcatctatagaagg

SEQ ID NO: 49227 - DNA, 20 bp, Artificial Sequence
  chemically synthesized
cagacagaggagctgtgcaa

SEQ ID NO: 49228 - DNA, 20 bp, Artificial Sequence
  chemically synthesized
cagaggagctgtgcaaacag

SEQ ID NO: 49229 - DNA, 20 bp, Artificial Sequence
  chemically synthesized
aaggagtcattgtacctggc

SEQ ID NO: 49230 - DNA, 20 bp, Artificial Sequence
  chemically synthesized
gctggccctctgctctcact

SEQ ID NO: 49231 - DNA, 20 bp, Artificial Sequence
  chemically synthesized
gagacgggtactgggtgtgc

SEQ ID NO: 49232 - DNA, 20 bp, Artificial Sequence
  chemically synthesized
tcacactgcccagaggatta

SEQ ID NO: 49233 - DNA, 20 bp, Artificial Sequence
  chemically synthesized
tcttccctctgcagctggcc

SEQ ID NO: 49234 - DNA, 20 bp, Artificial Sequence
  chemically synthesized
aaacaaaggcccagagaggg

SEQ ID NO: 49235 - DNA, 20 bp, Artificial Sequence
  chemically synthesized
agagtgggggccatgtatcc

SEQ ID NO: 49236 - DNA, 20 bp, Artificial Sequence
  chemically synthesized
ctggttttccaggagcaaaa

SEQ ID NO: 49237 - DNA, 20 bp, Artificial Sequence
  chemically synthesized
tgtttctgtttttgctcctg

SEQ ID NO: 49238 - DNA, 20 bp, Artificial Sequence
  chemically synthesized
gggggtcattgtgcagatgg

SEQ ID NO: 49239 - DNA, 20 bp, Artificial Sequence
  chemically synthesized
cacactggttttccaggagc

SEQ ID NO: 49240 - DNA, 20 bp, Artificial Sequence
  chemically synthesized
ccaagcagtaggagaggtgg

SEQ ID NO: 49241 - DNA, 20 bp, Artificial Sequence
  chemically synthesized
gtgcaaacagaaagaaatgg

SEQ ID NO: 49242 - DNA, 20 bp, Artificial Sequence
  chemically synthesized
acctagacaccctcatccac

SEQ ID NO: 49243 - DNA, 20 bp, Artificial Sequence
  chemically synthesized
tctcgcagtgaaaggcatac

SEQ ID NO: 49244 - DNA, 20 bp, Artificial Sequence
  chemically synthesized
gtcgcccgcctacgctgccc

SEQ ID NO: 49245 - DNA, 20 bp, Artificial Sequence
  chemically synthesized
gacgctttgcctgggcagtg

SEQ ID NO: 49246 - DNA, 20 bp, Artificial Sequence
  chemically synthesized
gagctgtgctgcctcaggca

SEQ ID NO: 49247 - DNA, 20 bp, Artificial Sequence
  chemically synthesized
cttcacctctctgaaccagg

SEQ ID NO: 49248 - DNA, 20 bp, Artificial Sequence
  chemically synthesized
cacctgcatcccaaagagtt

SEQ ID NO: 49249 - DNA, 20 bp, Artificial Sequence
  chemically synthesized
gttggaagtttcattcccaa

SEQ ID NO: 49250 - DNA, 20 bp, Artificial Sequence
  chemically synthesized
ttatgtgggtctgcacagcc

SEQ ID NO: 49251 - DNA, 20 bp, Artificial Sequence
  chemically synthesized
tcaattttgaccagcctcag

SEQ ID NO: 49252 - DNA, 20 bp, Artificial Sequence
  chemically synthesized
ttgaccagcctcaggcctgt

SEQ ID NO: 49253 - DNA, 20 bp, Artificial Sequence
  chemically synthesized
gaaaaccagtgtgatccgta

SEQ ID NO: 49254 - DNA, 20 bp, Artificial Sequence
  chemically synthesized
agtgtgatccgtatacagct

SEQ ID NO: 49255 - DNA, 20 bp, Artificial Sequence
  chemically synthesized
gttgaggctagtggggcccc

SEQ ID NO: 49256 - DNA, 20 bp, Artificial Sequence
  chemically synthesized
caatccctttaaaagcctaa

SEQ ID NO: 49257 - DNA, 20 bp, Artificial Sequence
  chemically synthesized
gcccgctgtgcaacccgcaa

SEQ ID NO: 49258 - DNA, 20 bp, Artificial Sequence
  chemically synthesized
tggctgtgaggcctcaggtg

SEQ ID NO: 49259 - DNA, 20 bp, Artificial Sequence
  chemically synthesized
tgtaccttgttgagctgctg

SEQ ID NO: 49260 - DNA, 20 bp, Artificial Sequence
  chemically synthesized
ggtggggtgggccacacttg

SEQ ID NO: 49261 - DNA, 20 bp, Artificial Sequence
  chemically synthesized
ccttccctgcagctccatcc

SEQ ID NO: 49262 - DNA, 20 bp, Artificial Sequence
  chemically synthesized
atttcttcccctctctgggc

SEQ ID NO: 49263 - DNA, 20 bp, Artificial Sequence
  chemically synthesized
cagtaggctggggaggggcg

SEQ ID NO: 49264 - DNA, 20 bp, Artificial Sequence
  chemically synthesized
gaggtacagtcacactgccc

SEQ ID NO: 49265 - DNA, 20 bp, Artificial Sequence
  chemically synthesized
agacctggcaccaataactg

SEQ ID NO: 49266 - DNA, 20 bp, Artificial Sequence
  chemically synthesized
caggtgacatgccgggctgt

SEQ ID NO: 49267 - DNA, 20 bp, Artificial Sequence
  chemically synthesized
cctgtgcctgccagaagaga

SEQ ID NO: 49268 - DNA, 20 bp, Artificial Sequence
  chemically synthesized
cagaagagacagagcttgag

SEQ ID NO: 49269 - DNA, 20 bp, Artificial Sequence
  chemically synthesized
tccacaggtgggagggacag

SEQ ID NO: 49270 - DNA, 20 bp, Artificial Sequence
  chemically synthesized
gaaggggaggggagtctgag

SEQ ID NO: 49271 - DNA, 20 bp, Artificial Sequence
  chemically synthesized
ggagggagggcagcatcagg

SEQ ID NO: 49272 - DNA, 20 bp, Artificial Sequence
  chemically synthesized
ggcacacccagtacccgtct

SEQ ID NO: 49273 - DNA, 20 bp, Artificial Sequence
  chemically synthesized
gcacgtacgccagctcccaa

SEQ ID NO: 49274 - DNA, 20 bp, Artificial Sequence
  chemically synthesized
gttgcacagcgggcgatgca

SEQ ID NO: 49275 - DNA, 20 bp, Artificial Sequence
  chemically synthesized
agcgggcgatgcaatctgat

SEQ ID NO: 49276 - DNA, 20 bp, Artificial Sequence
  chemically synthesized
caatctgatttaggctttta

SEQ ID NO: 49277 - DNA, 20 bp, Artificial Sequence
  chemically synthesized
ccaagctgtatacggatcac

SEQ ID NO: 49278 - DNA, 20 bp, Artificial Sequence
  chemically synthesized
tcacccgaggcacttcacaa

SEQ ID NO: 49279 - DNA, 20 bp, Artificial Sequence
  chemically synthesized
agcacagctcttctttacag

SEQ ID NO: 49280 - DNA, 20 bp, Artificial Sequence
  chemically synthesized
ttccatcgggaccatcaaga

SEQ ID NO: 49281 - DNA, 20 bp, Artificial Sequence
  chemically synthesized
gagcggtctctccgctctga

SEQ ID NO: 49282 - DNA, 20 bp, Artificial Sequence
  chemically synthesized
gctaccagtggaacagccac

SEQ ID NO: 49283 - DNA, 20 bp, Artificial Sequence
  chemically synthesized
ccaccttggacacaggacgc

SEQ ID NO: 49284 - DNA, 20 bp, Artificial Sequence
  chemically synthesized
tcccagccagtggacttagc

SEQ ID NO: 49285 - DNA, 20 bp, Artificial Sequence
  chemically synthesized
ccccgttgcccctctggatc

SEQ ID NO: 49286 - DNA, 20 bp, Artificial Sequence
  chemically synthesized
cgaggacagggccctgtctc

SEQ ID NO: 49287 - DNA, 20 bp, Artificial Sequence
  chemically synthesized
ttcactgcgagaggttctgg

SEQ ID NO: 49288 - DNA, 20 bp, Artificial Sequence
  chemically synthesized
cagcagccatgagggttgtg

SEQ ID NO: 49289 - DNA, 20 bp, Artificial Sequence
  chemically synthesized
aacaaagcgcagccatttct

SEQ ID NO: 49290 - DNA, 20 bp, Artificial Sequence
  chemically synthesized
ataagcctcaccacctctcc

SEQ ID NO: 49291 - DNA, 22 bp, Artificial Sequence
  chemically synthesized
aggcctggcacaggtctgttcc

SEQ ID NO: 49292 - DNA, 22 bp, Artificial Sequence
  chemically synthesized
gcacaggtctgttcctggtcat

SEQ ID NO: 49293 - DNA, 22 bp, Artificial Sequence
  chemically synthesized
ttcctggtcatatctggagggg

SEQ ID NO: 49294 - DNA, 22 bp, Artificial Sequence
  chemically synthesized
ctggtcatatctggaggggatg

SEQ ID NO: 49295 - DNA, 22 bp, Artificial Sequence
  chemically synthesized
gtcatatctggaggggatggag

SEQ ID NO: 49296 - DNA, 22 bp, Artificial Sequence
  chemically synthesized
gaggggatggagaatgtgagcc

SEQ ID NO: 49297 - DNA, 22 bp, Artificial Sequence
  chemically synthesized
ctccccacccctctctggacct

SEQ ID NO: 49298 - DNA, 22 bp, Artificial Sequence
  chemically synthesized
cccacccctctctggaccttaa

SEQ ID NO: 49299 - DNA, 22 bp, Artificial Sequence
  chemically synthesized
tctggaccttaacctcctcatc

SEQ ID NO: 49300 - DNA, 22 bp, Artificial Sequence
  chemically synthesized
tggaccttaacctcctcatcta

SEQ ID NO: 49301 - DNA, 22 bp, Artificial Sequence
  chemically synthesized
gaccttaacctcctcatctata

SEQ ID NO: 49302 - DNA, 22 bp, Artificial Sequence
  chemically synthesized
aacctcctcatctatagaaggg

SEQ ID NO: 49303 - DNA, 22 bp, Artificial Sequence
  chemically synthesized
acctcctcatctatagaagggg

SEQ ID NO: 49304 - DNA, 22 bp, Artificial Sequence
  chemically synthesized
ctcatctatagaaggggagaaa

SEQ ID NO: 49305 - DNA, 22 bp, Artificial Sequence
  chemically synthesized
atctatagaaggggagaaagat

SEQ ID NO: 49306 - DNA, 22 bp, Artificial Sequence
  chemically synthesized
tagaaggggagaaagatgcatg

SEQ ID NO: 49307 - DNA, 22 bp, Artificial Sequence
  chemically synthesized
ataggagacaacagacaggagc

SEQ ID NO: 49308 - DNA, 22 bp, Artificial Sequence
  chemically synthesized
taggagacaacagacaggagcc

SEQ ID NO: 49309 - DNA, 22 bp, Artificial Sequence
  chemically synthesized
tgcaaacagaaagaaatggctg

SEQ ID NO: 49310 - DNA, 22 bp, Artificial Sequence
  chemically synthesized
cgctttgttgctgttgctgtat

SEQ ID NO: 49311 - DNA, 22 bp, Artificial Sequence
  chemically synthesized
tgttgctgttgctgtatcttgg

SEQ ID NO: 49312 - DNA, 22 bp, Artificial Sequence
  chemically synthesized
gttgctgttgctgtatcttggc

SEQ ID NO: 49313 - DNA, 22 bp, Artificial Sequence
  chemically synthesized
ttgctgttgctgtatcttggct

SEQ ID NO: 49314 - DNA, 22 bp, Artificial Sequence
  chemically synthesized
ctgttgctgtatcttggctggt

SEQ ID NO: 49315 - DNA, 22 bp, Artificial Sequence
  chemically synthesized
ttgctgtatcttggctggtgtc

SEQ ID NO: 49316 - DNA, 22 bp, Artificial Sequence
  chemically synthesized
ctgtatcttggctggtgtcccc

SEQ ID NO: 49317 - DNA, 22 bp, Artificial Sequence
  chemically synthesized
tatcttggctggtgtcccccat

SEQ ID NO: 49318 - DNA, 22 bp, Artificial Sequence
  chemically synthesized
ggctggtgtcccccatcctggg

SEQ ID NO: 49319 - DNA, 22 bp, Artificial Sequence
  chemically synthesized
gctggtgtcccccatcctgggg

SEQ ID NO: 49320 - DNA, 22 bp, Artificial Sequence
  chemically synthesized
gtgtcccccatcctggggtgcc

SEQ ID NO: 49321 - DNA, 22 bp, Artificial Sequence
  chemically synthesized
gggtgccaggactgcagaccta

SEQ ID NO: 49322 - DNA, 22 bp, Artificial Sequence
  chemically synthesized
cagacctagacaccctcatcca

SEQ ID NO: 49323 - DNA, 22 bp, Artificial Sequence
  chemically synthesized
gacaccctcatccacttctgct

SEQ ID NO: 49324 - DNA, 22 bp, Artificial Sequence
  chemically synthesized
atccacttctgcttacaggaac

SEQ ID NO: 49325 - DNA, 22 bp, Artificial Sequence
  chemically synthesized
ctgcttacaggaaccagtgtat

SEQ ID NO: 49326 - DNA, 22 bp, Artificial Sequence
  chemically synthesized
tgcttacaggaaccagtgtatc

SEQ ID NO: 49327 - DNA, 22 bp, Artificial Sequence
  chemically synthesized
cttacaggaaccagtgtatcca

SEQ ID NO: 49328 - DNA, 22 bp, Artificial Sequence
  chemically synthesized
acaggaaccagtgtatccacca

SEQ ID NO: 49329 - DNA, 22 bp, Artificial Sequence
  chemically synthesized
caggaaccagtgtatccaccag

SEQ ID NO: 49330 - DNA, 22 bp, Artificial Sequence
  chemically synthesized
ggaaacaggacacaaccctcat

SEQ ID NO: 49331 - DNA, 22 bp, Artificial Sequence
  chemically synthesized
atggctgctgttattatgaaaa

SEQ ID NO: 49332 - DNA, 22 bp, Artificial Sequence
  chemically synthesized
ctgttattatgaaaataggagc

SEQ ID NO: 49333 - DNA, 22 bp, Artificial Sequence
  chemically synthesized
ttattatgaaaataggagctca

SEQ ID NO: 49334 - DNA, 22 bp, Artificial Sequence
  chemically synthesized
ttatgaaaataggagctcagct

SEQ ID NO: 49335 - DNA, 22 bp, Artificial Sequence
  chemically synthesized
tgaaaataggagctcagctgca

SEQ ID NO: 49336 - DNA, 22 bp, Artificial Sequence
  chemically synthesized
agctgcagcctctccatctgcc

SEQ ID NO: 49337 - DNA, 22 bp, Artificial Sequence
  chemically synthesized
cagcctctccatctgccctgca

SEQ ID NO: 49338 - DNA, 22 bp, Artificial Sequence
  chemically synthesized
tccatctgccctgcacctcagc

SEQ ID NO: 49339 - DNA, 22 bp, Artificial Sequence
  chemically synthesized
catctgccctgcacctcagcag

SEQ ID NO: 49340 - DNA, 22 bp, Artificial Sequence
  chemically synthesized
ccctgcacctcagcaggcggat

SEQ ID NO: 49341 - DNA, 22 bp, Artificial Sequence
  chemically synthesized
cacctcagcaggcggataccca

SEQ ID NO: 49342 - DNA, 22 bp, Artificial Sequence
  chemically synthesized
agcaggcggatacccactccac

SEQ ID NO: 49343 - DNA, 22 bp, Artificial Sequence
  chemically synthesized
cacaacccccctcctgccccag

SEQ ID NO: 49344 - DNA, 22 bp, Artificial Sequence
  chemically synthesized
ctgccccagacctgctgcctgc

SEQ ID NO: 49345 - DNA, 22 bp, Artificial Sequence
  chemically synthesized
ccccagacctgctgcctgcctg

SEQ ID NO: 49346 - DNA, 22 bp, Artificial Sequence
  chemically synthesized
ctgcctgcctgggccatgggga

SEQ ID NO: 49347 - DNA, 22 bp, Artificial Sequence
  chemically synthesized
cctgcctgggccatggggagct

SEQ ID NO: 49348 - DNA, 22 bp, Artificial Sequence
  chemically synthesized
cctgggccatggggagctcaga

SEQ ID NO: 49349 - DNA, 22 bp, Artificial Sequence
  chemically synthesized
ggccatggggagctcagaagcc

SEQ ID NO: 49350 - DNA, 22 bp, Artificial Sequence
  chemically synthesized
agaagcctctccagaacctctc

SEQ ID NO: 49351 - DNA, 22 bp, Artificial Sequence
  chemically synthesized
tccagaacctctcgcagtgaaa

SEQ ID NO: 49352 - DNA, 22 bp, Artificial Sequence
  chemically synthesized
cagaacctctcgcagtgaaagg

SEQ ID NO: 49353 - DNA, 22 bp, Artificial Sequence
  chemically synthesized
tcgcagtgaaaggcatacttac

SEQ ID NO: 49354 - DNA, 22 bp, Artificial Sequence
  chemically synthesized
gcagtgaaaggcatacttacga

SEQ ID NO: 49355 - DNA, 22 bp, Artificial Sequence
  chemically synthesized
acgattcactgtcccaggtcag

SEQ ID NO: 49356 - DNA, 22 bp, Artificial Sequence
  chemically synthesized
cgattcactgtcccaggtcagt

SEQ ID NO: 49357 - DNA, 22 bp, Artificial Sequence
  chemically synthesized
actgtcccaggtcagtggtggt

SEQ ID NO: 49358 - DNA, 22 bp, Artificial Sequence
  chemically synthesized
tcccaggtcagtggtggtgcct

SEQ ID NO: 49359 - DNA, 22 bp, Artificial Sequence
  chemically synthesized
aagctgaggagacagggccctg

SEQ ID NO: 49360 - DNA, 22 bp, Artificial Sequence
  chemically synthesized
aggagacagggccctgtcctcg

SEQ ID NO: 49361 - DNA, 22 bp, Artificial Sequence
  chemically synthesized
tcctcgtccgtatttaagcagt

SEQ ID NO: 49362 - DNA, 22 bp, Artificial Sequence
  chemically synthesized
gtccgtatttaagcagtggatc

SEQ ID NO: 49363 - DNA, 22 bp, Artificial Sequence
  chemically synthesized
aagcagtggatccagaggggca

SEQ ID NO: 49364 - DNA, 22 bp, Artificial Sequence
  chemically synthesized
agcagtggatccagaggggcaa

SEQ ID NO: 49365 - DNA, 22 bp, Artificial Sequence
  chemically synthesized
ctggtgaatattaaccaaggtc

SEQ ID NO: 49366 - DNA, 22 bp, Artificial Sequence
  chemically synthesized
gtgaatattaaccaaggtcacc

SEQ ID NO: 49367 - DNA, 22 bp, Artificial Sequence
  chemically synthesized
accaaggtcaccccagttatcg

SEQ ID NO: 49368 - DNA, 22 bp, Artificial Sequence
  chemically synthesized
tcggaggagcaaacaggggcta

SEQ ID NO: 49369 - DNA, 22 bp, Artificial Sequence
  chemically synthesized
agtccactggctgggatctgag

SEQ ID NO: 49370 - DNA, 22 bp, Artificial Sequence
  chemically synthesized
gctgggatctgagtcgcccgcc

SEQ ID NO: 49371 - DNA, 22 bp, Artificial Sequence
  chemically synthesized
ggatctgagtcgcccgcctacg

SEQ ID NO: 49372 - DNA, 22 bp, Artificial Sequence
  chemically synthesized
agtcgcccgcctacgctgcccg

SEQ ID NO: 49373 - DNA, 22 bp, Artificial Sequence
  chemically synthesized
cgctgcccggacgctttgcctg

SEQ ID NO: 49374 - DNA, 22 bp, Artificial Sequence
  chemically synthesized
cccggacgctttgcctgggcag

SEQ ID NO: 49375 - DNA, 22 bp, Artificial Sequence
  chemically synthesized
tgcctgggcagtgtacagcttc

SEQ ID NO: 49376 - DNA, 22 bp, Artificial Sequence
  chemically synthesized
gcctgggcagtgtacagcttcc

SEQ ID NO: 49377 - DNA, 22 bp, Artificial Sequence
  chemically synthesized
cctgggcagtgtacagcttcca

SEQ ID NO: 49378 - DNA, 22 bp, Artificial Sequence
  chemically synthesized
ggcagtgtacagcttccactgc

SEQ ID NO: 49379 - DNA, 22 bp, Artificial Sequence
  chemically synthesized
ccactgcacttaccgaaaggag

SEQ ID NO: 49380 - DNA, 22 bp, Artificial Sequence
  chemically synthesized
cactgcacttaccgaaaggagt

SEQ ID NO: 49381 - DNA, 22 bp, Artificial Sequence
  chemically synthesized
cacttaccgaaaggagtcattg

SEQ ID NO: 49382 - DNA, 22 bp, Artificial Sequence
  chemically synthesized
accgaaaggagtcattgtacct

SEQ ID NO: 49383 - DNA, 22 bp, Artificial Sequence
  chemically synthesized
ccgaaaggagtcattgtacctg

SEQ ID NO: 49384 - DNA, 22 bp, Artificial Sequence
  chemically synthesized
tacctggctcagaaaccacagc

SEQ ID NO: 49385 - DNA, 22 bp, Artificial Sequence
  chemically synthesized
gctcagaaaccacagcgtcctg

SEQ ID NO: 49386 - DNA, 22 bp, Artificial Sequence
  chemically synthesized
agaaaccacagcgtcctgtgtc

SEQ ID NO: 49387 - DNA, 22 bp, Artificial Sequence
  chemically synthesized
tgtccaaggtggagggggtggc

SEQ ID NO: 49388 - DNA, 22 bp, Artificial Sequence
  chemically synthesized
tgggagagtaccacttagctgg

SEQ ID NO: 49389 - DNA, 22 bp, Artificial Sequence
  chemically synthesized
ggagagtaccacttagctggcc

SEQ ID NO: 49390 - DNA, 22 bp, Artificial Sequence
  chemically synthesized
agctggccctctgctctcactg

SEQ ID NO: 49391 - DNA, 22 bp, Artificial Sequence
  chemically synthesized
gctggccctctgctctcactgc

SEQ ID NO: 49392 - DNA, 22 bp, Artificial Sequence
  chemically synthesized
gccctctgctctcactgcagaa

SEQ ID NO: 49393 - DNA, 22 bp, Artificial Sequence
  chemically synthesized
tgctctcactgcagaatcctta

SEQ ID NO: 49394 - DNA, 22 bp, Artificial Sequence
  chemically synthesized
ctctcactgcagaatccttagt

SEQ ID NO: 49395 - DNA, 22 bp, Artificial Sequence
  chemically synthesized
tcactgcagaatccttagtggc

SEQ ID NO: 49396 - DNA, 22 bp, Artificial Sequence
  chemically synthesized
actgcagaatccttagtggctg

SEQ ID NO: 49397 - DNA, 22 bp, Artificial Sequence
  chemically synthesized
cagaatccttagtggctgttcc

SEQ ID NO: 49398 - DNA, 22 bp, Artificial Sequence
  chemically synthesized
agtggctgttccactggtagca

SEQ ID NO: 49399 - DNA, 22 bp, Artificial Sequence
  chemically synthesized
gtggctgttccactggtagcaa

SEQ ID NO: 49400 - DNA, 22 bp, Artificial Sequence
  chemically synthesized
ttccactggtagcaagatctac

SEQ ID NO: 49401 - DNA, 22 bp, Artificial Sequence
  chemically synthesized
cactggtagcaagatctaccat

SEQ ID NO: 49402 - DNA, 22 bp, Artificial Sequence
  chemically synthesized
gtagcaagatctaccatttact

SEQ ID NO: 49403 - DNA, 22 bp, Artificial Sequence
  chemically synthesized
ccatttactgagtcaccccaaa

SEQ ID NO: 49404 - DNA, 22 bp, Artificial Sequence
  chemically synthesized
actgagtcaccccaaaatgcct

SEQ ID NO: 49405 - DNA, 22 bp, Artificial Sequence
  chemically synthesized
ctgagtcaccccaaaatgcctg

SEQ ID NO: 49406 - DNA, 22 bp, Artificial Sequence
  chemically synthesized
agtcaccccaaaatgcctgatg

SEQ ID NO: 49407 - DNA, 22 bp, Artificial Sequence
  chemically synthesized
atgctgaagacttactgccgcc

SEQ ID NO: 49408 - DNA, 22 bp, Artificial Sequence
  chemically synthesized
aagacttactgccgccctggga

SEQ ID NO: 49409 - DNA, 22 bp, Artificial Sequence
  chemically synthesized
actgccgccctgggagatcaga

SEQ ID NO: 49410 - DNA, 22 bp, Artificial Sequence
  chemically synthesized
ctgccgccctgggagatcagag

SEQ ID NO: 49411 - DNA, 22 bp, Artificial Sequence
  chemically synthesized
ccgccctgggagatcagagtgg

SEQ ID NO: 49412 - DNA, 22 bp, Artificial Sequence
  chemically synthesized
ggagatcagagtgggttagagc

SEQ ID NO: 49413 - DNA, 22 bp, Artificial Sequence
  chemically synthesized
gagcccatttgacagatgagga

SEQ ID NO: 49414 - DNA, 22 bp, Artificial Sequence
  chemically synthesized
gacagatgaggaaacaggctca

SEQ ID NO: 49415 - DNA, 22 bp, Artificial Sequence
  chemically synthesized
acagatgaggaaacaggctcag

SEQ ID NO: 49416 - DNA, 22 bp, Artificial Sequence
  chemically synthesized
agagcggagagaccgctcatcc

SEQ ID NO: 49417 - DNA, 22 bp, Artificial Sequence
  chemically synthesized
atccaaagttacccagtcagcc

SEQ ID NO: 49418 - DNA, 22 bp, Artificial Sequence
  chemically synthesized
cccagtcagccttagacacaaa

SEQ ID NO: 49419 - DNA, 22 bp, Artificial Sequence
  chemically synthesized
agacacaaacaccctcttgatg

SEQ ID NO: 49420 - DNA, 22 bp, Artificial Sequence
  chemically synthesized
gacacaaacaccctcttgatgg

SEQ ID NO: 49421 - DNA, 22 bp, Artificial Sequence
  chemically synthesized
ttgatggtcccgatggaaaaat

SEQ ID NO: 49422 - DNA, 22 bp, Artificial Sequence
  chemically synthesized
gatggtcccgatggaaaaatgg

SEQ ID NO: 49423 - DNA, 22 bp, Artificial Sequence
  chemically synthesized
atggtcccgatggaaaaatgga

SEQ ID NO: 49424 - DNA, 22 bp, Artificial Sequence
  chemically synthesized
aggcagacacaaccgtcaggct

SEQ ID NO: 49425 - DNA, 22 bp, Artificial Sequence
  chemically synthesized
gcatggggggccgtgagacagg

SEQ ID NO: 49426 - DNA, 22 bp, Artificial Sequence
  chemically synthesized
taaagaagagctgtgctgcctc

SEQ ID NO: 49427 - DNA, 22 bp, Artificial Sequence
  chemically synthesized
tgctgcctcaggcaggccgctt

SEQ ID NO: 49428 - DNA, 22 bp, Artificial Sequence
  chemically synthesized
cctcaggcaggccgcttcacct

SEQ ID NO: 49429 - DNA, 22 bp, Artificial Sequence
  chemically synthesized
aggcaggccgcttcacctctct

SEQ ID NO: 49430 - DNA, 22 bp, Artificial Sequence
  chemically synthesized
cacctctctgaaccaggaactg

SEQ ID NO: 49431 - DNA, 22 bp, Artificial Sequence
  chemically synthesized
acctctctgaaccaggaactgt

SEQ ID NO: 49432 - DNA, 22 bp, Artificial Sequence
  chemically synthesized
tctgaaccaggaactgtttcac

SEQ ID NO: 49433 - DNA, 22 bp, Artificial Sequence
  chemically synthesized
tgaaccaggaactgtttcacct

SEQ ID NO: 49434 - DNA, 22 bp, Artificial Sequence
  chemically synthesized
aaccaggaactgtttcacctgc

SEQ ID NO: 49435 - DNA, 22 bp, Artificial Sequence
  chemically synthesized
tttcacctgcatcccaaagagt

SEQ ID NO: 49436 - DNA, 22 bp, Artificial Sequence
  chemically synthesized
cacctgcatcccaaagagttgg

SEQ ID NO: 49437 - DNA, 22 bp, Artificial Sequence
  chemically synthesized
acctgcatcccaaagagttgga

SEQ ID NO: 49438 - DNA, 22 bp, Artificial Sequence
  chemically synthesized
catcccaaagagttggaagttt

SEQ ID NO: 49439 - DNA, 22 bp, Artificial Sequence
  chemically synthesized
gaagtttcattcccaagcatgc

SEQ ID NO: 49440 - DNA, 22 bp, Artificial Sequence
  chemically synthesized
cattcccaagcatgcttgtgaa

SEQ ID NO: 49441 - DNA, 22 bp, Artificial Sequence
  chemically synthesized
attcccaagcatgcttgtgaag

SEQ ID NO: 49442 - DNA, 22 bp, Artificial Sequence
  chemically synthesized
ccaagcatgcttgtgaagtgcc

SEQ ID NO: 49443 - DNA, 22 bp, Artificial Sequence
  chemically synthesized
gtgaagtgcctcgggtgaagtg

SEQ ID NO: 49444 - DNA, 22 bp, Artificial Sequence
  chemically synthesized
tgaagtgcctcgggtgaagtgc

SEQ ID NO: 49445 - DNA, 22 bp, Artificial Sequence
  chemically synthesized
gggtgaagtgcctggcacacag

SEQ ID NO: 49446 - DNA, 22 bp, Artificial Sequence
  chemically synthesized
gcacacagtaggctctttatgt

SEQ ID NO: 49447 - DNA, 22 bp, Artificial Sequence
  chemically synthesized
tttatgtgggtctgcacagccc

SEQ ID NO: 49448 - DNA, 22 bp, Artificial Sequence
  chemically synthesized
tatgtgggtctgcacagccctc

SEQ ID NO: 49449 - DNA, 22 bp, Artificial Sequence
  chemically synthesized
atgtgggtctgcacagccctct

SEQ ID NO: 49450 - DNA, 22 bp, Artificial Sequence
  chemically synthesized
tgtgggtctgcacagccctctg

SEQ ID NO: 49451 - DNA, 22 bp, Artificial Sequence
  chemically synthesized
cacagccctctgcttagtctgc

SEQ ID NO: 49452 - DNA, 22 bp, Artificial Sequence
  chemically synthesized
tgcttagtctgccccccaggct

SEQ ID NO: 49453 - DNA, 22 bp, Artificial Sequence
  chemically synthesized
cttagtctgccccccaggctgc

SEQ ID NO: 49454 - DNA, 22 bp, Artificial Sequence
  chemically synthesized
agtctgccccccaggctgctca

SEQ ID NO: 49455 - DNA, 22 bp, Artificial Sequence
  chemically synthesized
gtctgccccccaggctgctcag

SEQ ID NO: 49456 - DNA, 22 bp, Artificial Sequence
  chemically synthesized
ccccccaggctgctcagagcag

SEQ ID NO: 49457 - DNA, 22 bp, Artificial Sequence
  chemically synthesized
ctcagagcaggaggaggttcaa

SEQ ID NO: 49458 - DNA, 22 bp, Artificial Sequence
  chemically synthesized
agagcaggaggaggttcaattt

SEQ ID NO: 49459 - DNA, 22 bp, Artificial Sequence
  chemically synthesized
aattttgaccagcctcaggcct

SEQ ID NO: 49460 - DNA, 22 bp, Artificial Sequence
  chemically synthesized
tgaccagcctcaggcctgtttc

SEQ ID NO: 49461 - DNA, 22 bp, Artificial Sequence
  chemically synthesized
gaccagcctcaggcctgtttct

SEQ ID NO: 49462 - DNA, 22 bp, Artificial Sequence
  chemically synthesized
accagcctcaggcctgtttctg

SEQ ID NO: 49463 - DNA, 22 bp, Artificial Sequence
  chemically synthesized
aggcctgtttctgtttttgctc

SEQ ID NO: 49464 - DNA, 22 bp, Artificial Sequence
  chemically synthesized
tttctgtttttgctcctggaaa

SEQ ID NO: 49465 - DNA, 22 bp, Artificial Sequence
  chemically synthesized
ctgtttttgctcctggaaaacc

SEQ ID NO: 49466 - DNA, 22 bp, Artificial Sequence
  chemically synthesized
tgtttttgctcctggaaaacca

SEQ ID NO: 49467 - DNA, 22 bp, Artificial Sequence
  chemically synthesized
tttttgctcctggaaaaccagt

SEQ ID NO: 49468 - DNA, 22 bp, Artificial Sequence
  chemically synthesized
ttgctcctggaaaaccagtgtg

SEQ ID NO: 49469 - DNA, 22 bp, Artificial Sequence
  chemically synthesized
tgctcctggaaaaccagtgtga

SEQ ID NO: 49470 - DNA, 22 bp, Artificial Sequence
  chemically synthesized
gctcctggaaaaccagtgtgat

SEQ ID NO: 49471 - DNA, 22 bp, Artificial Sequence
  chemically synthesized
ctcctggaaaaccagtgtgatc

SEQ ID NO: 49472 - DNA, 22 bp, Artificial Sequence
  chemically synthesized
ctggaaaaccagtgtgatccgt

SEQ ID NO: 49473 - DNA, 22 bp, Artificial Sequence
  chemically synthesized
gaaaaccagtgtgatccgtata

SEQ ID NO: 49474 - DNA, 22 bp, Artificial Sequence
  chemically synthesized
ggagtttctttggatacatggc

SEQ ID NO: 49475 - DNA, 22 bp, Artificial Sequence
  chemically synthesized
gagtttctttggatacatggcc

SEQ ID NO: 49476 - DNA, 22 bp, Artificial Sequence
  chemically synthesized
ctttggatacatggcccccact

SEQ ID NO: 49477 - DNA, 22 bp, Artificial Sequence
  chemically synthesized
tttggatacatggcccccactc

SEQ ID NO: 49478 - DNA, 22 bp, Artificial Sequence
  chemically synthesized
tggatacatggcccccactctg

SEQ ID NO: 49479 - DNA, 22 bp, Artificial Sequence
  chemically synthesized
ggatacatggcccccactctgg

SEQ ID NO: 49480 - DNA, 22 bp, Artificial Sequence
  chemically synthesized
gatacatggcccccactctggg

SEQ ID NO: 49481 - DNA, 22 bp, Artificial Sequence
  chemically synthesized
tggggttgttggaggcctttgg

SEQ ID NO: 49482 - DNA, 22 bp, Artificial Sequence
  chemically synthesized
gggttgttggaggcctttggag

SEQ ID NO: 49483 - DNA, 22 bp, Artificial Sequence
  chemically synthesized
ttggaggcctttggagactgct

SEQ ID NO: 49484 - DNA, 22 bp, Artificial Sequence
  chemically synthesized
gaggcctttggagactgctggg

SEQ ID NO: 49485 - DNA, 22 bp, Artificial Sequence
  chemically synthesized
tggagactgctgggggtggagg

SEQ ID NO: 49486 - DNA, 22 bp, Artificial Sequence
  chemically synthesized
ggagactgctgggggtggaggg

SEQ ID NO: 49487 - DNA, 22 bp, Artificial Sequence
  chemically synthesized
gagactgctgggggtggagggg

SEQ ID NO: 49488 - DNA, 22 bp, Artificial Sequence
  chemically synthesized
ctgggggtggaggggaggggag

SEQ ID NO: 49489 - DNA, 22 bp, Artificial Sequence
  chemically synthesized
ggggtggaggggaggggaggta

SEQ ID NO: 49490 - DNA, 22 bp, Artificial Sequence
  chemically synthesized
aggctagtggggccccacttga

SEQ ID NO: 49491 - DNA, 22 bp, Artificial Sequence
  chemically synthesized
gtggggccccacttgattgcaa

SEQ ID NO: 49492 - DNA, 22 bp, Artificial Sequence
  chemically synthesized
gattgcaatccctttaaaagcc

SEQ ID NO: 49493 - DNA, 22 bp, Artificial Sequence
  chemically synthesized
attgcaatccctttaaaagcct

SEQ ID NO: 49494 - DNA, 22 bp, Artificial Sequence
  chemically synthesized
caatccctttaaaagcctaaat

SEQ ID NO: 49495 - DNA, 22 bp, Artificial Sequence
  chemically synthesized
taaaagcctaaatcagattgca

SEQ ID NO: 49496 - DNA, 22 bp, Artificial Sequence
  chemically synthesized
aaaagcctaaatcagattgcat

SEQ ID NO: 49497 - DNA, 22 bp, Artificial Sequence
  chemically synthesized
aaagcctaaatcagattgcatc

SEQ ID NO: 49498 - DNA, 22 bp, Artificial Sequence
  chemically synthesized
aatcagattgcatcgcccgctg

SEQ ID NO: 49499 - DNA, 22 bp, Artificial Sequence
  chemically synthesized
catcgcccgctgtgcaacccgc

SEQ ID NO: 49500 - DNA, 22 bp, Artificial Sequence
  chemically synthesized
tgcaacccgcaaacctgcttgg

SEQ ID NO: 49501 - DNA, 22 bp, Artificial Sequence
  chemically synthesized
cttgggagctggcgtacgtgcc

SEQ ID NO: 49502 - DNA, 22 bp, Artificial Sequence
  chemically synthesized
gggagctggcgtacgtgccgta

SEQ ID NO: 49503 - DNA, 22 bp, Artificial Sequence
  chemically synthesized
ggagctggcgtacgtgccgtag

SEQ ID NO: 49504 - DNA, 22 bp, Artificial Sequence
  chemically synthesized
gcgtacgtgccgtagatacttg

SEQ ID NO: 49505 - DNA, 22 bp, Artificial Sequence
  chemically synthesized
gcagagtgaatggatgagtgca

SEQ ID NO: 49506 - DNA, 22 bp, Artificial Sequence
  chemically synthesized
cagagtgaatggatgagtgcat

SEQ ID NO: 49507 - DNA, 22 bp, Artificial Sequence
  chemically synthesized
ttgccccttctgtcattcacca

SEQ ID NO: 49508 - DNA, 22 bp, Artificial Sequence
  chemically synthesized
tgccccttctgtcattcaccag

SEQ ID NO: 49509 - DNA, 22 bp, Artificial Sequence
  chemically synthesized
gccccttctgtcattcaccagt

SEQ ID NO: 49510 - DNA, 22 bp, Artificial Sequence
  chemically synthesized
ccccttctgtcattcaccagtc

SEQ ID NO: 49511 - DNA, 22 bp, Artificial Sequence
  chemically synthesized
ctgtcattcaccagtcccattt

SEQ ID NO: 49512 - DNA, 22 bp, Artificial Sequence
  chemically synthesized
tgtcattcaccagtcccattta

SEQ ID NO: 49513 - DNA, 22 bp, Artificial Sequence
  chemically synthesized
tcattcaccagtcccatttatg

SEQ ID NO: 49514 - DNA, 22 bp, Artificial Sequence
  chemically synthesized
accagtcccatttatgcctcca

SEQ ID NO: 49515 - DNA, 22 bp, Artificial Sequence
  chemically synthesized
atgcctccaccttggggctcta

SEQ ID NO: 49516 - DNA, 22 bp, Artificial Sequence
  chemically synthesized
tgcctccaccttggggctctac

SEQ ID NO: 49517 - DNA, 22 bp, Artificial Sequence
  chemically synthesized
caccttggggctctaccaggcg

SEQ ID NO: 49518 - DNA, 22 bp, Artificial Sequence
  chemically synthesized
ggggctctaccaggcgagtgac

SEQ ID NO: 49519 - DNA, 22 bp, Artificial Sequence
  chemically synthesized
gggctctaccaggcgagtgacc

SEQ ID NO: 49520 - DNA, 22 bp, Artificial Sequence
  chemically synthesized
taccaggcgagtgacccacagg

SEQ ID NO: 49521 - DNA, 22 bp, Artificial Sequence
  chemically synthesized
ccaggcgagtgacccacaggat

SEQ ID NO: 49522 - DNA, 22 bp, Artificial Sequence
  chemically synthesized
cagcacacacattcagaccagg

SEQ ID NO: 49523 - DNA, 22 bp, Artificial Sequence
  chemically synthesized
agaccagggaacccacttactg

SEQ ID NO: 49524 - DNA, 22 bp, Artificial Sequence
  chemically synthesized
actggctgtgaggcctcaggtg

SEQ ID NO: 49525 - DNA, 22 bp, Artificial Sequence
  chemically synthesized
ctggctgtgaggcctcaggtga

SEQ ID NO: 49526 - DNA, 22 bp, Artificial Sequence
  chemically synthesized
gctgtgaggcctcaggtgagtt

SEQ ID NO: 49527 - DNA, 22 bp, Artificial Sequence
  chemically synthesized
tgaggcctcaggtgagttgttt

SEQ ID NO: 49528 - DNA, 22 bp, Artificial Sequence
  chemically synthesized
aggtgagttgtttaaccgctcc

SEQ ID NO: 49529 - DNA, 22 bp, Artificial Sequence
  chemically synthesized
tttaaccgctccgagcctcaat

SEQ ID NO: 49530 - DNA, 22 bp, Artificial Sequence
  chemically synthesized
aaccgctccgagcctcaatttc

SEQ ID NO: 49531 - DNA, 22 bp, Artificial Sequence
  chemically synthesized
accgctccgagcctcaatttcc

SEQ ID NO: 49532 - DNA, 22 bp, Artificial Sequence
  chemically synthesized
cgagcctcaatttccctatctg

SEQ ID NO: 49533 - DNA, 22 bp, Artificial Sequence
  chemically synthesized
aatttccctatctgtaaaatgg

SEQ ID NO: 49534 - DNA, 22 bp, Artificial Sequence
  chemically synthesized
ccctatctgtaaaatggggatg

SEQ ID NO: 49535 - DNA, 22 bp, Artificial Sequence
  chemically synthesized
cctatctgtaaaatggggatgg

SEQ ID NO: 49536 - DNA, 22 bp, Artificial Sequence
  chemically synthesized
tctgtaaaatggggatggtgac

SEQ ID NO: 49537 - DNA, 22 bp, Artificial Sequence
  chemically synthesized
taaaatggggatggtgacggta

SEQ ID NO: 49538 - DNA, 22 bp, Artificial Sequence
  chemically synthesized
gttgagctgctgtgaggattaa

SEQ ID NO: 49539 - DNA, 22 bp, Artificial Sequence
  chemically synthesized
ttgagctgctgtgaggattaaa

SEQ ID NO: 49540 - DNA, 22 bp, Artificial Sequence
  chemically synthesized
agctgctgtgaggattaaaatg

SEQ ID NO: 49541 - DNA, 22 bp, Artificial Sequence
  chemically synthesized
ctgtgaggattaaaatgcaaca

SEQ ID NO: 49542 - DNA, 22 bp, Artificial Sequence
  chemically synthesized
tgaggattaaaatgcaacagtt

SEQ ID NO: 49543 - DNA, 22 bp, Artificial Sequence
  chemically synthesized
aaatgcaacagttcaaggaaag

SEQ ID NO: 49544 - DNA, 22 bp, Artificial Sequence
  chemically synthesized
aaggaaagctcagagacgggta

SEQ ID NO: 49545 - DNA, 22 bp, Artificial Sequence
  chemically synthesized
agagacgggtactgggtgtgcc

SEQ ID NO: 49546 - DNA, 22 bp, Artificial Sequence
  chemically synthesized
ggtgtgcccagaaagcccctcc

SEQ ID NO: 49547 - DNA, 22 bp, Artificial Sequence
  chemically synthesized
ctgatgctgccctccctccccc

SEQ ID NO: 49548 - DNA, 22 bp, Artificial Sequence
  chemically synthesized
atgctgccctccctcccccgtg

SEQ ID NO: 49549 - DNA, 22 bp, Artificial Sequence
  chemically synthesized
ccctccctcccccgtgtcaggg

SEQ ID NO: 49550 - DNA, 22 bp, Artificial Sequence
  chemically synthesized
cctcccccgtgtcaggggctgg

SEQ ID NO: 49551 - DNA, 22 bp, Artificial Sequence
  chemically synthesized
ccccgtgtcaggggctggtgtc

SEQ ID NO: 49552 - DNA, 22 bp, Artificial Sequence
  chemically synthesized
gtgtcactggggtggggtgggc

SEQ ID NO: 49553 - DNA, 22 bp, Artificial Sequence
  chemically synthesized
gggtggggtgggccacacttga

SEQ ID NO: 49554 - DNA, 22 bp, Artificial Sequence
  chemically synthesized
gaagagctttcctccaggcagt

SEQ ID NO: 49555 - DNA, 22 bp, Artificial Sequence
  chemically synthesized
aagagctttcctccaggcagtc

SEQ ID NO: 49556 - DNA, 22 bp, Artificial Sequence
  chemically synthesized
tcctccaggcagtctctcattc

SEQ ID NO: 49557 - DNA, 22 bp, Artificial Sequence
  chemically synthesized
cctccaggcagtctctcattca

SEQ ID NO: 49558 - DNA, 22 bp, Artificial Sequence
  chemically synthesized
ctccaggcagtctctcattcag

SEQ ID NO: 49559 - DNA, 22 bp, Artificial Sequence
  chemically synthesized
caggcagtctctcattcagtta

SEQ ID NO: 49560 - DNA, 22 bp, Artificial Sequence
  chemically synthesized
tcattcagttaccctgtgaagg

SEQ ID NO: 49561 - DNA, 22 bp, Artificial Sequence
  chemically synthesized
attcagttaccctgtgaaggga

SEQ ID NO: 49562 - DNA, 22 bp, Artificial Sequence
  chemically synthesized
agttaccctgtgaagggagtag

SEQ ID NO: 49563 - DNA, 22 bp, Artificial Sequence
  chemically synthesized
ccctgtgaagggagtaggtacc

SEQ ID NO: 49564 - DNA, 22 bp, Artificial Sequence
  chemically synthesized
tgaagggagtaggtaccaccct

SEQ ID NO: 49565 - DNA, 22 bp, Artificial Sequence
  chemically synthesized
ctttcaggcagcgggaaactga

SEQ ID NO: 49566 - DNA, 22 bp, Artificial Sequence
  chemically synthesized
tcaggcagcgggaaactgagct

SEQ ID NO: 49567 - DNA, 22 bp, Artificial Sequence
  chemically synthesized
caggcagcgggaaactgagctc

SEQ ID NO: 49568 - DNA, 22 bp, Artificial Sequence
  chemically synthesized
aggcagcgggaaactgagctca

SEQ ID NO: 49569 - DNA, 22 bp, Artificial Sequence
  chemically synthesized
agctcagactcccctccccttc

SEQ ID NO: 49570 - DNA, 22 bp, Artificial Sequence
  chemically synthesized
agactcccctccccttctctct

SEQ ID NO: 49571 - DNA, 22 bp, Artificial Sequence
  chemically synthesized
ccctccccttctctctgagctc

SEQ ID NO: 49572 - DNA, 22 bp, Artificial Sequence
  chemically synthesized
cccttctctctgagctcccttc

SEQ ID NO: 49573 - DNA, 22 bp, Artificial Sequence
  chemically synthesized
ctctctgagctcccttccctgc

SEQ ID NO: 49574 - DNA, 22 bp, Artificial Sequence
  chemically synthesized
tctctgagctcccttccctgca

SEQ ID NO: 49575 - DNA, 22 bp, Artificial Sequence
  chemically synthesized
tctgagctcccttccctgcagc

SEQ ID NO: 49576 - DNA, 22 bp, Artificial Sequence
  chemically synthesized
tgagctcccttccctgcagctc

SEQ ID NO: 49577 - DNA, 22 bp, Artificial Sequence
  chemically synthesized
agctcccttccctgcagctcca

SEQ ID NO: 49578 - DNA, 22 bp, Artificial Sequence
  chemically synthesized
ccttccctgcagctccatcccc

SEQ ID NO: 49579 - DNA, 22 bp, Artificial Sequence
  chemically synthesized
ccctgcagctccatcccctggc

SEQ ID NO: 49580 - DNA, 22 bp, Artificial Sequence
  chemically synthesized
cctgcagctccatcccctggct

SEQ ID NO: 49581 - DNA, 22 bp, Artificial Sequence
  chemically synthesized
cagctccatcccctggcttcag

SEQ ID NO: 49582 - DNA, 22 bp, Artificial Sequence
  chemically synthesized
catcccctggcttcagggcccc

SEQ ID NO: 49583 - DNA, 22 bp, Artificial Sequence
  chemically synthesized
gcttcagggcccctgtccttcc

SEQ ID NO: 49584 - DNA, 22 bp, Artificial Sequence
  chemically synthesized
cagggcccctgtccttcccctg

SEQ ID NO: 49585 - DNA, 22 bp, Artificial Sequence
  chemically synthesized
agggcccctgtccttcccctga

SEQ ID NO: 49586 - DNA, 22 bp, Artificial Sequence
  chemically synthesized
tccttcccctgagctggctgaa

SEQ ID NO: 49587 - DNA, 22 bp, Artificial Sequence
  chemically synthesized
cccctgagctggctgaatggat

SEQ ID NO: 49588 - DNA, 22 bp, Artificial Sequence
  chemically synthesized
ccctgagctggctgaatggata

SEQ ID NO: 49589 - DNA, 22 bp, Artificial Sequence
  chemically synthesized
agctggctgaatggatattccg

SEQ ID NO: 49590 - DNA, 22 bp, Artificial Sequence
  chemically synthesized
gctgaatggatattccgctgct

SEQ ID NO: 49591 - DNA, 22 bp, Artificial Sequence
  chemically synthesized
aatggatattccgctgctctac

SEQ ID NO: 49592 - DNA, 22 bp, Artificial Sequence
  chemically synthesized
cgctgctctacatccactcaca

SEQ ID NO: 49593 - DNA, 22 bp, Artificial Sequence
  chemically synthesized
ctctacatccactcacagctcc

SEQ ID NO: 49594 - DNA, 22 bp, Artificial Sequence
  chemically synthesized
tacatccactcacagctccagc

SEQ ID NO: 49595 - DNA, 22 bp, Artificial Sequence
  chemically synthesized
catccactcacagctccagcac

SEQ ID NO: 49596 - DNA, 22 bp, Artificial Sequence
  chemically synthesized
acagctccagcactgggctgtg

SEQ ID NO: 49597 - DNA, 22 bp, Artificial Sequence
  chemically synthesized
cagcactgggctgtggttgagg

SEQ ID NO: 49598 - DNA, 22 bp, Artificial Sequence
  chemically synthesized
ggctgtggttgaggtcgcctgc

SEQ ID NO: 49599 - DNA, 22 bp, Artificial Sequence
  chemically synthesized
tggttgaggtcgcctgccctcg

SEQ ID NO: 49600 - DNA, 22 bp, Artificial Sequence
  chemically synthesized
aggtcgcctgccctcggtagct

SEQ ID NO: 49601 - DNA, 22 bp, Artificial Sequence
  chemically synthesized
ccctcggtagctcctgggcatt

SEQ ID NO: 49602 - DNA, 22 bp, Artificial Sequence
  chemically synthesized
ggtagctcctgggcatttcttc

SEQ ID NO: 49603 - DNA, 22 bp, Artificial Sequence
  chemically synthesized
ctgggcatttcttcccctctct

SEQ ID NO: 49604 - DNA, 22 bp, Artificial Sequence
  chemically synthesized
ggcatttcttcccctctctggg

SEQ ID NO: 49605 - DNA, 22 bp, Artificial Sequence
  chemically synthesized
cttcccctctctgggcctttgt

SEQ ID NO: 49606 - DNA, 22 bp, Artificial Sequence
  chemically synthesized
ttcccctctctgggcctttgtt

SEQ ID NO: 49607 - DNA, 22 bp, Artificial Sequence
  chemically synthesized
cccctctctgggcctttgtttt

SEQ ID NO: 49608 - DNA, 22 bp, Artificial Sequence
  chemically synthesized
ccctctctgggcctttgttttc

SEQ ID NO: 49609 - DNA, 22 bp, Artificial Sequence
  chemically synthesized
tctgggcctttgttttcccatc

SEQ ID NO: 49610 - DNA, 22 bp, Artificial Sequence
  chemically synthesized
tgggcctttgttttcccatctg

SEQ ID NO: 49611 - DNA, 22 bp, Artificial Sequence
  chemically synthesized
ggcctttgttttcccatctgca

SEQ ID NO: 49612 - DNA, 22 bp, Artificial Sequence
  chemically synthesized
tgttttcccatctgcacaatga

SEQ ID NO: 49613 - DNA, 22 bp, Artificial Sequence
  chemically synthesized
gttttcccatctgcacaatgac

SEQ ID NO: 49614 - DNA, 22 bp, Artificial Sequence
  chemically synthesized
ttttcccatctgcacaatgacc

SEQ ID NO: 49615 - DNA, 22 bp, Artificial Sequence
  chemically synthesized
tcccatctgcacaatgaccccc

SEQ ID NO: 49616 - DNA, 22 bp, Artificial Sequence
  chemically synthesized
cccatctgcacaatgaccccca

SEQ ID NO: 49617 - DNA, 22 bp, Artificial Sequence
  chemically synthesized
ccatctgcacaatgacccccac

SEQ ID NO: 49618 - DNA, 22 bp, Artificial Sequence
  chemically synthesized
cacaatgacccccactctaagc

SEQ ID NO: 49619 - DNA, 22 bp, Artificial Sequence
  chemically synthesized
taagccctgctgtccctcccac

SEQ ID NO: 49620 - DNA, 22 bp, Artificial Sequence
  chemically synthesized
agccctgctgtccctcccacct

SEQ ID NO: 49621 - DNA, 22 bp, Artificial Sequence
  chemically synthesized
ctgtccctcccacctgtggaac

SEQ ID NO: 49622 - DNA, 22 bp, Artificial Sequence
  chemically synthesized
tccctcccacctgtggaactga

SEQ ID NO: 49623 - DNA, 22 bp, Artificial Sequence
  chemically synthesized
ccacctgtggaactgagtgagc

SEQ ID NO: 49624 - DNA, 22 bp, Artificial Sequence
  chemically synthesized
tggaactgagtgagcagcagca

SEQ ID NO: 49625 - DNA, 22 bp, Artificial Sequence
  chemically synthesized
agtgagcagcagcagcaatgtc

SEQ ID NO: 49626 - DNA, 22 bp, Artificial Sequence
  chemically synthesized
tcctgctctcctcaagctctcc

SEQ ID NO: 49627 - DNA, 22 bp, Artificial Sequence
  chemically synthesized
cctgctctcctcaagctctcct

SEQ ID NO: 49628 - DNA, 22 bp, Artificial Sequence
  chemically synthesized
ctgctctcctcaagctctcctc

SEQ ID NO: 49629 - DNA, 22 bp, Artificial Sequence
  chemically synthesized
ctctcctcaagctctcctcaag

SEQ ID NO: 49630 - DNA, 22 bp, Artificial Sequence
  chemically synthesized
tcctcaagctctcctcaagctc

SEQ ID NO: 49631 - DNA, 22 bp, Artificial Sequence
  chemically synthesized
ctcaagctctcctcaagctctg

SEQ ID NO: 49632 - DNA, 22 bp, Artificial Sequence
  chemically synthesized
aagctctcctcaagctctgtct

SEQ ID NO: 49633 - DNA, 22 bp, Artificial Sequence
  chemically synthesized
tcctcaagctctgtctcttctg

SEQ ID NO: 49634 - DNA, 22 bp, Artificial Sequence
  chemically synthesized
ctcaagctctgtctcttctggc

SEQ ID NO: 49635 - DNA, 22 bp, Artificial Sequence
  chemically synthesized
aagctctgtctcttctggcagg

SEQ ID NO: 49636 - DNA, 22 bp, Artificial Sequence
  chemically synthesized
tgtctcttctggcaggcacagg

SEQ ID NO: 49637 - DNA, 22 bp, Artificial Sequence
  chemically synthesized
tctcttctggcaggcacaggag

SEQ ID NO: 49638 - DNA, 22 bp, Artificial Sequence
  chemically synthesized
ttctggcaggcacaggagagtg

SEQ ID NO: 49639 - DNA, 22 bp, Artificial Sequence
  chemically synthesized
ctggcaggcacaggagagtggc

SEQ ID NO: 49640 - DNA, 22 bp, Artificial Sequence
  chemically synthesized
tggcaggcacaggagagtggcc

SEQ ID NO: 49641 - DNA, 22 bp, Artificial Sequence
  chemically synthesized
gcaggcacaggagagtggcctg

SEQ ID NO: 49642 - DNA, 22 bp, Artificial Sequence
  chemically synthesized
aaggctggcaggaggttgccgc

SEQ ID NO: 49643 - DNA, 22 bp, Artificial Sequence
  chemically synthesized
gcaggaggttgccgcccctcca

SEQ ID NO: 49644 - DNA, 22 bp, Artificial Sequence
  chemically synthesized
ccgcccctccaacctggaattc

SEQ ID NO: 49645 - DNA, 22 bp, Artificial Sequence
  chemically synthesized
caacctggaattcctggcagca

SEQ ID NO: 49646 - DNA, 22 bp, Artificial Sequence
  chemically synthesized
gaattcctggcagcagcagcgg

SEQ ID NO: 49647 - DNA, 22 bp, Artificial Sequence
  chemically synthesized
ctggcagcagcagcggctaggc

SEQ ID NO: 49648 - DNA, 22 bp, Artificial Sequence
  chemically synthesized
gcagcagcagcggctaggcctt

SEQ ID NO: 49649 - DNA, 22 bp, Artificial Sequence
  chemically synthesized
ggccttcctcggaggcccgacc

SEQ ID NO: 49650 - DNA, 22 bp, Artificial Sequence
  chemically synthesized
cctcggaggcccgaccccctcc

SEQ ID NO: 49651 - DNA, 22 bp, Artificial Sequence
  chemically synthesized
ctcggaggcccgaccccctcct

SEQ ID NO: 49652 - DNA, 22 bp, Artificial Sequence
  chemically synthesized
ggaggcccgaccccctcctcct

SEQ ID NO: 49653 - DNA, 22 bp, Artificial Sequence
  chemically synthesized
ctccttcttggttcagctcagg

SEQ ID NO: 49654 - DNA, 22 bp, Artificial Sequence
  chemically synthesized
cttcttggttcagctcaggact

SEQ ID NO: 49655 - DNA, 22 bp, Artificial Sequence
  chemically synthesized
cttggttcagctcaggactctg

SEQ ID NO: 49656 - DNA, 22 bp, Artificial Sequence
  chemically synthesized
ttggttcagctcaggactctga

SEQ ID NO: 49657 - DNA, 22 bp, Artificial Sequence
  chemically synthesized
ggttcagctcaggactctgagg

SEQ ID NO: 49658 - DNA, 22 bp, Artificial Sequence
  chemically synthesized
gttcagctcaggactctgaggg

SEQ ID NO: 49659 - DNA, 22 bp, Artificial Sequence
  chemically synthesized
agctcaggactctgagggttgc

SEQ ID NO: 49660 - DNA, 22 bp, Artificial Sequence
  chemically synthesized
aggactctgagggttgctgcgt

SEQ ID NO: 49661 - DNA, 22 bp, Artificial Sequence
  chemically synthesized
tgagggttgctgcgtggaggca

SEQ ID NO: 49662 - DNA, 22 bp, Artificial Sequence
  chemically synthesized
agggttgctgcgtggaggcagt

SEQ ID NO: 49663 - DNA, 22 bp, Artificial Sequence
  chemically synthesized
ctgcgtggaggcagtgcatgcc

SEQ ID NO: 49664 - DNA, 22 bp, Artificial Sequence
  chemically synthesized
cgtggaggcagtgcatgccctg

SEQ ID NO: 49665 - DNA, 22 bp, Artificial Sequence
  chemically synthesized
ggcacagtgcccagttcctgcc

SEQ ID NO: 49666 - DNA, 22 bp, Artificial Sequence
  chemically synthesized
ctgcccacccaggaagtagact

SEQ ID NO: 49667 - DNA, 22 bp, Artificial Sequence
  chemically synthesized
cccacccaggaagtagacttcg

SEQ ID NO: 49668 - DNA, 22 bp, Artificial Sequence
  chemically synthesized
cgggtggaggcagtaggctggg

SEQ ID NO: 49669 - DNA, 22 bp, Artificial Sequence
  chemically synthesized
gggtggaggcagtaggctgggg

SEQ ID NO: 49670 - DNA, 22 bp, Artificial Sequence
  chemically synthesized
gggaggggcggggagcttggac

SEQ ID NO: 49671 - DNA, 22 bp, Artificial Sequence
  chemically synthesized
ggacaggaaggagccttgctca

SEQ ID NO: 49672 - DNA, 22 bp, Artificial Sequence
  chemically synthesized
gacaggaaggagccttgctcat

SEQ ID NO: 49673 - DNA, 22 bp, Artificial Sequence
  chemically synthesized
gctcattgcccggcagacacaa

SEQ ID NO: 49674 - DNA, 22 bp, Artificial Sequence
  chemically synthesized
ctcattgcccggcagacacaag

SEQ ID NO: 49675 - DNA, 22 bp, Artificial Sequence
  chemically synthesized
attgcccggcagacacaagact

SEQ ID NO: 49676 - DNA, 22 bp, Artificial Sequence
  chemically synthesized
cccggcagacacaagactgggc

SEQ ID NO: 49677 - DNA, 22 bp, Artificial Sequence
  chemically synthesized
ggccctcataaactcagacagc

SEQ ID NO: 49678 - DNA, 22 bp, Artificial Sequence
  chemically synthesized
ataaactcagacagcccggcat

SEQ ID NO: 49679 - DNA, 22 bp, Artificial Sequence
  chemically synthesized
agacagcccggcatgtcacctg

SEQ ID NO: 49680 - DNA, 22 bp, Artificial Sequence
  chemically synthesized
ttgtacctgccctttcagctct

SEQ ID NO: 49681 - DNA, 22 bp, Artificial Sequence
  chemically synthesized
tacctgccctttcagctctgtg

SEQ ID NO: 49682 - DNA, 22 bp, Artificial Sequence
  chemically synthesized
ccctttcagctctgtgacccgg

SEQ ID NO: 49683 - DNA, 22 bp, Artificial Sequence
  chemically synthesized
tcagctctgtgacccgggacaa

SEQ ID NO: 49684 - DNA, 22 bp, Artificial Sequence
  chemically synthesized
cagctctgtgacccgggacaag

SEQ ID NO: 49685 - DNA, 22 bp, Artificial Sequence
  chemically synthesized
agctctgtgacccgggacaagt

SEQ ID NO: 49686 - DNA, 22 bp, Artificial Sequence
  chemically synthesized
tgtgacccgggacaagtcaccc

SEQ ID NO: 49687 - DNA, 22 bp, Artificial Sequence
  chemically synthesized
tgacccgggacaagtcaccctc

SEQ ID NO: 49688 - DNA, 22 bp, Artificial Sequence
  chemically synthesized
tccctttgagttgccgcaagag

SEQ ID NO: 49689 - DNA, 22 bp, Artificial Sequence
  chemically synthesized
cctttgagttgccgcaagaggt

SEQ ID NO: 49690 - DNA, 22 bp, Artificial Sequence
  chemically synthesized
tgagttgccgcaagaggtacag

SEQ ID NO: 49691 - DNA, 22 bp, Artificial Sequence
  chemically synthesized
gagttgccgcaagaggtacagt

SEQ ID NO: 49692 - DNA, 22 bp, Artificial Sequence
  chemically synthesized
agttgccgcaagaggtacagtc

SEQ ID NO: 49693 - DNA, 22 bp, Artificial Sequence
  chemically synthesized
ccgcaagaggtacagtcacact

SEQ ID NO: 49694 - DNA, 22 bp, Artificial Sequence
  chemically synthesized
cccagaggattactagaaatga

SEQ ID NO: 49695 - DNA, 22 bp, Artificial Sequence
  chemically synthesized
ctagaaatgacaggcctcgccc

SEQ ID NO: 49696 - DNA, 22 bp, Artificial Sequence
  chemically synthesized
gaaatgacaggcctcgccctcc

SEQ ID NO: 49697 - DNA, 22 bp, Artificial Sequence
  chemically synthesized
gccctcctggcacagacctggc

SEQ ID NO: 49698 - DNA, 22 bp, Artificial Sequence
  chemically synthesized
ctggcacagacctggcaccaat

SEQ ID NO: 49699 - DNA, 22 bp, Artificial Sequence
  chemically synthesized
gcacagacctggcaccaataac

SEQ ID NO: 49700 - DNA, 22 bp, Artificial Sequence
  chemically synthesized
gcaccaataactggcaggtttc

SEQ ID NO: 49701 - DNA, 22 bp, Artificial Sequence
  chemically synthesized
gcaggtttctggggccagctgc

SEQ ID NO: 49702 - DNA, 22 bp, Artificial Sequence
  chemically synthesized
ctggggccagctgcagagggaa

SEQ ID NO: 49703 - DNA, 22 bp, Artificial Sequence
  chemically synthesized
tggggccagctgcagagggaag

SEQ ID NO: 49704 - DNA, 22 bp, Artificial Sequence
  chemically synthesized
gggccagctgcagagggaagag

SEQ ID NO: 49705 - DNA, 22 bp, Artificial Sequence
  chemically synthesized
cagagggaagaggactgagcca

SEQ ID NO: 49706 - DNA, 22 bp, Artificial Sequence
  chemically synthesized
agccacctatgaaatgcccagt

SEQ ID NO: 49707 - DNA, 22 bp, Artificial Sequence
  chemically synthesized
tgaaatgcccagtgggcagccc

SEQ ID NO: 49708 - DNA, 22 bp, Artificial Sequence
  chemically synthesized
ggcaggtctgtgtgcactgggg

SEQ ID NO: 49709 - DNA, 22 bp, Artificial Sequence
  chemically synthesized
tgtgcactggggaggtgtgtgt

SEQ ID NO: 49710 - DNA, 22 bp, Artificial Sequence
  chemically synthesized
gggaggtgtgtgtcataggacc

SEQ ID NO: 49711 - DNA, 22 bp, Artificial Sequence
  chemically synthesized
tgacacacacctccccagtgca

SEQ ID NO: 49712 - DNA, 22 bp, Artificial Sequence
  chemically synthesized
cccagtgcacacagacctgccc

SEQ ID NO: 49713 - DNA, 22 bp, Artificial Sequence
  chemically synthesized
cccaactgtggggctgcccact

SEQ ID NO: 49714 - DNA, 22 bp, Artificial Sequence
  chemically synthesized
tggggctgcccactgggcattt

SEQ ID NO: 49715 - DNA, 22 bp, Artificial Sequence
  chemically synthesized
cccactgggcatttcataggtg

SEQ ID NO: 49716 - DNA, 22 bp, Artificial Sequence
  chemically synthesized
ggcatttcataggtggctcagt

SEQ ID NO: 49717 - DNA, 22 bp, Artificial Sequence
  chemically synthesized
cataggtggctcagtcctcttc

SEQ ID NO: 49718 - DNA, 22 bp, Artificial Sequence
  chemically synthesized
ataggtggctcagtcctcttcc

SEQ ID NO: 49719 - DNA, 22 bp, Artificial Sequence
  chemically synthesized
agtcctcttccctctgcagctg

SEQ ID NO: 49720 - DNA, 22 bp, Artificial Sequence
  chemically synthesized
ttccctctgcagctggccccag

SEQ ID NO: 49721 - DNA, 22 bp, Artificial Sequence
  chemically synthesized
ccctctgcagctggccccagaa

SEQ ID NO: 49722 - DNA, 22 bp, Artificial Sequence
  chemically synthesized
cctctgcagctggccccagaaa

SEQ ID NO: 49723 - DNA, 22 bp, Artificial Sequence
  chemically synthesized
tgcagctggccccagaaacctg

SEQ ID NO: 49724 - DNA, 22 bp, Artificial Sequence
  chemically synthesized
cagctggccccagaaacctgcc

SEQ ID NO: 49725 - DNA, 22 bp, Artificial Sequence
  chemically synthesized
gccccagaaacctgccagttat

SEQ ID NO: 49726 - DNA, 22 bp, Artificial Sequence
  chemically synthesized
ccagttattggtgccaggtctg

SEQ ID NO: 49727 - DNA, 22 bp, Artificial Sequence
  chemically synthesized
ttggtgccaggtctgtgccagg

SEQ ID NO: 49728 - DNA, 22 bp, Artificial Sequence
  chemically synthesized
gtgccaggtctgtgccaggagg

SEQ ID NO: 49729 - DNA, 22 bp, Artificial Sequence
  chemically synthesized
tgccaggagggcgaggcctgtc

SEQ ID NO: 49730 - DNA, 22 bp, Artificial Sequence
  chemically synthesized
tcatttctagtaatcctctggg

SEQ ID NO: 49731 - DNA, 22 bp, Artificial Sequence
  chemically synthesized
ctagtaatcctctgggcagtgt

SEQ ID NO: 49732 - DNA, 22 bp, Artificial Sequence
  chemically synthesized
tagtaatcctctgggcagtgtg

SEQ ID NO: 49733 - DNA, 22 bp, Artificial Sequence
  chemically synthesized
gtaatcctctgggcagtgtgac

SEQ ID NO: 49734 - DNA, 22 bp, Artificial Sequence
  chemically synthesized
tgggcagtgtgactgtacctct

SEQ ID NO: 49735 - DNA, 22 bp, Artificial Sequence
  chemically synthesized
ggcagtgtgactgtacctcttg

SEQ ID NO: 49736 - DNA, 22 bp, Artificial Sequence
  chemically synthesized
tacctcttgcggcaactcaaag

SEQ ID NO: 49737 - DNA, 22 bp, Artificial Sequence
  chemically synthesized
ttgcggcaactcaaagggagag

SEQ ID NO: 49738 - DNA, 22 bp, Artificial Sequence
  chemically synthesized
gcggcaactcaaagggagaggg

SEQ ID NO: 49739 - DNA, 22 bp, Artificial Sequence
  chemically synthesized
cggcaactcaaagggagagggt

SEQ ID NO: 49740 - DNA, 22 bp, Artificial Sequence
  chemically synthesized
aaagggagagggtgacttgtcc

SEQ ID NO: 49741 - DNA, 22 bp, Artificial Sequence
  chemically synthesized
gtcccgggtcacagagctgaaa

SEQ ID NO: 49742 - DNA, 22 bp, Artificial Sequence
  chemically synthesized
tcccgggtcacagagctgaaag

SEQ ID NO: 49743 - DNA, 22 bp, Artificial Sequence
  chemically synthesized
aaagggcaggtacaacaggtga

SEQ ID NO: 49744 - DNA, 22 bp, Artificial Sequence
  chemically synthesized
tctgagtttatgagggcccagt

SEQ ID NO: 49745 - DNA, 22 bp, Artificial Sequence
  chemically synthesized
agtttatgagggcccagtcttg

SEQ ID NO: 49746 - DNA, 22 bp, Artificial Sequence
  chemically synthesized
atgagggcccagtcttgtgtct

SEQ ID NO: 49747 - DNA, 22 bp, Artificial Sequence
  chemically synthesized
tgagggcccagtcttgtgtctg

SEQ ID NO: 49748 - DNA, 22 bp, Artificial Sequence
  chemically synthesized
gtgtctgccgggcaatgagcaa

SEQ ID NO: 49749 - DNA, 22 bp, Artificial Sequence
  chemically synthesized
tgtctgccgggcaatgagcaag

SEQ ID NO: 49750 - DNA, 22 bp, Artificial Sequence
  chemically synthesized
ccgggcaatgagcaaggctcct

SEQ ID NO: 49751 - DNA, 22 bp, Artificial Sequence
  chemically synthesized
cttcctgtccaagctccccgcc

SEQ ID NO: 49752 - DNA, 22 bp, Artificial Sequence
  chemically synthesized
cctgtccaagctccccgcccct

SEQ ID NO: 49753 - DNA, 22 bp, Artificial Sequence
  chemically synthesized
ctgtccaagctccccgcccctc

SEQ ID NO: 49754 - DNA, 22 bp, Artificial Sequence
  chemically synthesized
tccaagctccccgcccctcccc

SEQ ID NO: 49755 - DNA, 22 bp, Artificial Sequence
  chemically synthesized
cccgcccctccccagcctactg

SEQ ID NO: 49756 - DNA, 22 bp, Artificial Sequence
  chemically synthesized
cccagcctactgcctccacccg

SEQ ID NO: 49757 - DNA, 22 bp, Artificial Sequence
  chemically synthesized
ctgcctccacccgaagtctact

SEQ ID NO: 49758 - DNA, 22 bp, Artificial Sequence
  chemically synthesized
cctccacccgaagtctacttcc

SEQ ID NO: 49759 - DNA, 22 bp, Artificial Sequence
  chemically synthesized
cacccgaagtctacttcctggg

SEQ ID NO: 49760 - DNA, 22 bp, Artificial Sequence
  chemically synthesized
cttcctgggtgggcaggaactg

SEQ ID NO: 49761 - DNA, 22 bp, Artificial Sequence
  chemically synthesized
cctgggtgggcaggaactgggc

SEQ ID NO: 49762 - DNA, 22 bp, Artificial Sequence
  chemically synthesized
ctgggtgggcaggaactgggca

SEQ ID NO: 49763 - DNA, 22 bp, Artificial Sequence
  chemically synthesized
ggtgggcaggaactgggcactg

SEQ ID NO: 49764 - DNA, 22 bp, Artificial Sequence
  chemically synthesized
ggcactgtgcccagggcatgca

SEQ ID NO: 49765 - DNA, 22 bp, Artificial Sequence
  chemically synthesized
tgcccagggcatgcactgcctc

SEQ ID NO: 49766 - DNA, 22 bp, Artificial Sequence
  chemically synthesized
cctccacgcagcaaccctcaga

SEQ ID NO: 49767 - DNA, 22 bp, Artificial Sequence
  chemically synthesized
cacgcagcaaccctcagagtcc

SEQ ID NO: 49768 - DNA, 22 bp, Artificial Sequence
  chemically synthesized
agagtcctgagctgaaccaaga

SEQ ID NO: 49769 - DNA, 22 bp, Artificial Sequence
  chemically synthesized
agctgaaccaagaaggaggagg

SEQ ID NO: 49770 - DNA, 22 bp, Artificial Sequence
  chemically synthesized
aaccaagaaggaggagggggtc

SEQ ID NO: 49771 - DNA, 22 bp, Artificial Sequence
  chemically synthesized
cgaggaaggcctagccgctgct

SEQ ID NO: 49772 - DNA, 22 bp, Artificial Sequence
  chemically synthesized
gccgctgctgctgccaggaatt

SEQ ID NO: 49773 - DNA, 22 bp, Artificial Sequence
  chemically synthesized
ctgctgccaggaattccaggtt

SEQ ID NO: 49774 - DNA, 22 bp, Artificial Sequence
  chemically synthesized
ctgccaggaattccaggttgga

SEQ ID NO: 49775 - DNA, 22 bp, Artificial Sequence
  chemically synthesized
ccaggaattccaggttggaggg

SEQ ID NO: 49776 - DNA, 22 bp, Artificial Sequence
  chemically synthesized
caggttggaggggcggcaacct

SEQ ID NO: 49777 - DNA, 22 bp, Artificial Sequence
  chemically synthesized
gaggggcggcaacctcctgcca

SEQ ID NO: 49778 - DNA, 22 bp, Artificial Sequence
  chemically synthesized
ctgccagccttcaggccactct

SEQ ID NO: 49779 - DNA, 22 bp, Artificial Sequence
  chemically synthesized
ccagccttcaggccactctcct

SEQ ID NO: 49780 - DNA, 22 bp, Artificial Sequence
  chemically synthesized
caggccactctcctgtgcctgc

SEQ ID NO: 49781 - DNA, 22 bp, Artificial Sequence
  chemically synthesized
aggccactctcctgtgcctgcc

SEQ ID NO: 49782 - DNA, 22 bp, Artificial Sequence
  chemically synthesized
tcctgtgcctgccagaagagac

SEQ ID NO: 49783 - DNA, 22 bp, Artificial Sequence
  chemically synthesized
ctgtgcctgccagaagagacag

SEQ ID NO: 49784 - DNA, 22 bp, Artificial Sequence
  chemically synthesized
tgcctgccagaagagacagagc

SEQ ID NO: 49785 - DNA, 22 bp, Artificial Sequence
  chemically synthesized
ccagaagagacagagcttgagg

SEQ ID NO: 49786 - DNA, 22 bp, Artificial Sequence
  chemically synthesized
gaggagagcttgaggagagcag

SEQ ID NO: 49787 - DNA, 22 bp, Artificial Sequence
  chemically synthesized
aggagagcttgaggagagcagg

SEQ ID NO: 49788 - DNA, 22 bp, Artificial Sequence
  chemically synthesized
gaggagagcaggaaaggtggga

SEQ ID NO: 49789 - DNA, 22 bp, Artificial Sequence
  chemically synthesized
aggagagcaggaaaggtgggac

SEQ ID NO: 49790 - DNA, 22 bp, Artificial Sequence
  chemically synthesized
ctgctgctgctcactcagttcc

SEQ ID NO: 49791 - DNA, 22 bp, Artificial Sequence
  chemically synthesized
ctgctgctcactcagttccaca

SEQ ID NO: 49792 - DNA, 22 bp, Artificial Sequence
  chemically synthesized
ctgctcactcagttccacaggt

SEQ ID NO: 49793 - DNA, 22 bp, Artificial Sequence
  chemically synthesized
ctcactcagttccacaggtggg

SEQ ID NO: 49794 - DNA, 22 bp, Artificial Sequence
  chemically synthesized
actcagttccacaggtgggagg

SEQ ID NO: 49795 - DNA, 22 bp, Artificial Sequence
  chemically synthesized
agttccacaggtgggagggaca

SEQ ID NO: 49796 - DNA, 22 bp, Artificial Sequence
  chemically synthesized
cacaggtgggagggacagcagg

SEQ ID NO: 49797 - DNA, 22 bp, Artificial Sequence
  chemically synthesized
agagtgggggtcattgtgcaga

SEQ ID NO: 49798 - DNA, 22 bp, Artificial Sequence
  chemically synthesized
gagtgggggtcattgtgcagat

SEQ ID NO: 49799 - DNA, 22 bp, Artificial Sequence
  chemically synthesized
tgcagatgggaaaacaaaggcc

SEQ ID NO: 49800 - DNA, 22 bp, Artificial Sequence
  chemically synthesized
ccgagggcaggcgacctcaacc

SEQ ID NO: 49801 - DNA, 22 bp, Artificial Sequence
  chemically synthesized
aaccacagcccagtgctggagc

SEQ ID NO: 49802 - DNA, 22 bp, Artificial Sequence
  chemically synthesized
gagctgtgagtggatgtagagc

SEQ ID NO: 49803 - DNA, 22 bp, Artificial Sequence
  chemically synthesized
tgagtggatgtagagcagcgga

SEQ ID NO: 49804 - DNA, 22 bp, Artificial Sequence
  chemically synthesized
agccagctcaggggaaggacag

SEQ ID NO: 49805 - DNA, 22 bp, Artificial Sequence
  chemically synthesized
aggggaaggacaggggccctga

SEQ ID NO: 49806 - DNA, 22 bp, Artificial Sequence
  chemically synthesized
aagccaggggatggagctgcag

SEQ ID NO: 49807 - DNA, 22 bp, Artificial Sequence
  chemically synthesized
cagggaagggagctcagagaga

SEQ ID NO: 49808 - DNA, 22 bp, Artificial Sequence
  chemically synthesized
agagagaaggggaggggagtct

SEQ ID NO: 49809 - DNA, 22 bp, Artificial Sequence
  chemically synthesized
agctcagtttcccgctgcctga

SEQ ID NO: 49810 - DNA, 22 bp, Artificial Sequence
  chemically synthesized
agtttcccgctgcctgaaagga

SEQ ID NO: 49811 - DNA, 22 bp, Artificial Sequence
  chemically synthesized
cccgctgcctgaaaggagggtg

SEQ ID NO: 49812 - DNA, 22 bp, Artificial Sequence
  chemically synthesized
ccgctgcctgaaaggagggtgg

SEQ ID NO: 49813 - DNA, 22 bp, Artificial Sequence
  chemically synthesized
cctgaaaggagggtggtaccta

SEQ ID NO: 49814 - DNA, 22 bp, Artificial Sequence
  chemically synthesized
aaaggagggtggtacctactcc

SEQ ID NO: 49815 - DNA, 22 bp, Artificial Sequence
  chemically synthesized
ctcccttcacagggtaactgaa

SEQ ID NO: 49816 - DNA, 22 bp, Artificial Sequence
  chemically synthesized
ccttcacagggtaactgaatga

SEQ ID NO: 49817 - DNA, 22 bp, Artificial Sequence
  chemically synthesized
cacagggtaactgaatgagaga

SEQ ID NO: 49818 - DNA, 22 bp, Artificial Sequence
  chemically synthesized
acagggtaactgaatgagagac

SEQ ID NO: 49819 - DNA, 22 bp, Artificial Sequence
  chemically synthesized
aatgagagactgcctggaggaa

SEQ ID NO: 49820 - DNA, 22 bp, Artificial Sequence
  chemically synthesized
cctggaggaaagctcttcaagt

SEQ ID NO: 49821 - DNA, 22 bp, Artificial Sequence
  chemically synthesized
gaggaaagctcttcaagtgtgg

SEQ ID NO: 49822 - DNA, 22 bp, Artificial Sequence
  chemically synthesized
ttcaagtgtggcccaccccacc

SEQ ID NO: 49823 - DNA, 22 bp, Artificial Sequence
  chemically synthesized
caagtgtggcccaccccacccc

SEQ ID NO: 49824 - DNA, 22 bp, Artificial Sequence
  chemically synthesized
aagtgtggcccaccccacccca

SEQ ID NO: 49825 - DNA, 22 bp, Artificial Sequence
  chemically synthesized
acacgggggagggagggcagca

SEQ ID NO: 49826 - DNA, 22 bp, Artificial Sequence
  chemically synthesized
tctgggcacacccagtacccgt

SEQ ID NO: 49827 - DNA, 22 bp, Artificial Sequence
  chemically synthesized
ctgggcacacccagtacccgtc

SEQ ID NO: 49828 - DNA, 22 bp, Artificial Sequence
  chemically synthesized
tgggcacacccagtacccgtct

SEQ ID NO: 49829 - DNA, 22 bp, Artificial Sequence
  chemically synthesized
ggcacacccagtacccgtctct

SEQ ID NO: 49830 - DNA, 22 bp, Artificial Sequence
  chemically synthesized
tgagctttccttgaactgttgc

SEQ ID NO: 49831 - DNA, 22 bp, Artificial Sequence
  chemically synthesized
agctttccttgaactgttgcat

SEQ ID NO: 49832 - DNA, 22 bp, Artificial Sequence
  chemically synthesized
tccttgaactgttgcattttaa

SEQ ID NO: 49833 - DNA, 22 bp, Artificial Sequence
  chemically synthesized
ccttgaactgttgcattttaat

SEQ ID NO: 49834 - DNA, 22 bp, Artificial Sequence
  chemically synthesized
cttgaactgttgcattttaatc

SEQ ID NO: 49835 - DNA, 22 bp, Artificial Sequence
  chemically synthesized
gaactgttgcattttaatcctc

SEQ ID NO: 49836 - DNA, 22 bp, Artificial Sequence
  chemically synthesized
aactgttgcattttaatcctca

SEQ ID NO: 49837 - DNA, 22 bp, Artificial Sequence
  chemically synthesized
ttgcattttaatcctcacagca

SEQ ID NO: 49838 - DNA, 22 bp, Artificial Sequence
  chemically synthesized
cattttaatcctcacagcagct

SEQ ID NO: 49839 - DNA, 22 bp, Artificial Sequence
  chemically synthesized
taatcctcacagcagctcaaca

SEQ ID NO: 49840 - DNA, 22 bp, Artificial Sequence
  chemically synthesized
aatcctcacagcagctcaacaa

SEQ ID NO: 49841 - DNA, 22 bp, Artificial Sequence
  chemically synthesized
atcctcacagcagctcaacaag

SEQ ID NO: 49842 - DNA, 22 bp, Artificial Sequence
  chemically synthesized
acagcagctcaacaaggtacat

SEQ ID NO: 49843 - DNA, 22 bp, Artificial Sequence
  chemically synthesized
aacaaggtacataccgtcacca

SEQ ID NO: 49844 - DNA, 22 bp, Artificial Sequence
  chemically synthesized
tacagatagggaaattgaggct

SEQ ID NO: 49845 - DNA, 22 bp, Artificial Sequence
  chemically synthesized
acagatagggaaattgaggctc

SEQ ID NO: 49846 - DNA, 22 bp, Artificial Sequence
  chemically synthesized
cagatagggaaattgaggctcg

SEQ ID NO: 49847 - DNA, 22 bp, Artificial Sequence
  chemically synthesized
aggctcggagcggttaaacaac

SEQ ID NO: 49848 - DNA, 22 bp, Artificial Sequence
  chemically synthesized
ggagcggttaaacaactcacct

SEQ ID NO: 49849 - DNA, 22 bp, Artificial Sequence
  chemically synthesized
aacaactcacctgaggcctcac

SEQ ID NO: 49850 - DNA, 22 bp, Artificial Sequence
  chemically synthesized
acctgaggcctcacagccagta

SEQ ID NO: 49851 - DNA, 22 bp, Artificial Sequence
  chemically synthesized
aggcctcacagccagtaagtgg

SEQ ID NO: 49852 - DNA, 22 bp, Artificial Sequence
  chemically synthesized
acagccagtaagtgggttccct

SEQ ID NO: 49853 - DNA, 22 bp, Artificial Sequence
  chemically synthesized
cctggtctgaatgtgtgtgctg

SEQ ID NO: 49854 - DNA, 22 bp, Artificial Sequence
  chemically synthesized
gtctgaatgtgtgtgctggagg

SEQ ID NO: 49855 - DNA, 22 bp, Artificial Sequence
  chemically synthesized
aatgtgtgtgctggaggatcct

SEQ ID NO: 49856 - DNA, 22 bp, Artificial Sequence
  chemically synthesized
gaggatcctgtgggtcactcgc

SEQ ID NO: 49857 - DNA, 22 bp, Artificial Sequence
  chemically synthesized
tgggtcactcgcctggtagagc

SEQ ID NO: 49858 - DNA, 22 bp, Artificial Sequence
  chemically synthesized
gcctggtagagccccaaggtgg

SEQ ID NO: 49859 - DNA, 22 bp, Artificial Sequence
  chemically synthesized
gtagagccccaaggtggaggca

SEQ ID NO: 49860 - DNA, 22 bp, Artificial Sequence
  chemically synthesized
gtgaatgacagaaggggcaaaa

SEQ ID NO: 49861 - DNA, 22 bp, Artificial Sequence
  chemically synthesized
atccattcactctgcaagtatc

SEQ ID NO: 49862 - DNA, 22 bp, Artificial Sequence
  chemically synthesized
actctgcaagtatctacggcac

SEQ ID NO: 49863 - DNA, 22 bp, Artificial Sequence
  chemically synthesized
tgcaagtatctacggcacgtac

SEQ ID NO: 49864 - DNA, 22 bp, Artificial Sequence
  chemically synthesized
caagtatctacggcacgtacgc

SEQ ID NO: 49865 - DNA, 22 bp, Artificial Sequence
  chemically synthesized
cggcacgtacgccagctcccaa

SEQ ID NO: 49866 - DNA, 22 bp, Artificial Sequence
  chemically synthesized
ccaagcaggtttgcgggttgca

SEQ ID NO: 49867 - DNA, 22 bp, Artificial Sequence
  chemically synthesized
gcgggttgcacagcgggcgatg

SEQ ID NO: 49868 - DNA, 22 bp, Artificial Sequence
  chemically synthesized
cgggttgcacagcgggcgatgc

SEQ ID NO: 49869 - DNA, 22 bp, Artificial Sequence
  chemically synthesized
cacagcgggcgatgcaatctga

SEQ ID NO: 49870 - DNA, 22 bp, Artificial Sequence
  chemically synthesized
atttaggcttttaaagggattg

SEQ ID NO: 49871 - DNA, 22 bp, Artificial Sequence
  chemically synthesized
aggcttttaaagggattgcaat

SEQ ID NO: 49872 - DNA, 22 bp, Artificial Sequence
  chemically synthesized
ggcttttaaagggattgcaatc

SEQ ID NO: 49873 - DNA, 22 bp, Artificial Sequence
  chemically synthesized
ttaaagggattgcaatcaagtg

SEQ ID NO: 49874 - DNA, 22 bp, Artificial Sequence
  chemically synthesized
taaagggattgcaatcaagtgg

SEQ ID NO: 49875 - DNA, 22 bp, Artificial Sequence
  chemically synthesized
aaagggattgcaatcaagtggg

SEQ ID NO: 49876 - DNA, 22 bp, Artificial Sequence
  chemically synthesized
aagggattgcaatcaagtgggg

SEQ ID NO: 49877 - DNA, 22 bp, Artificial Sequence
  chemically synthesized
caatcaagtggggccccactag

SEQ ID NO: 49878 - DNA, 22 bp, Artificial Sequence
  chemically synthesized
gcctcaaccctgtacctcccct

SEQ ID NO: 49879 - DNA, 22 bp, Artificial Sequence
  chemically synthesized
aaccctgtacctcccctcccct

SEQ ID NO: 49880 - DNA, 22 bp, Artificial Sequence
  chemically synthesized
tacctcccctcccctccacccc

SEQ ID NO: 49881 - DNA, 22 bp, Artificial Sequence
  chemically synthesized
ccctcccctccacccccagcag

SEQ ID NO: 49882 - DNA, 22 bp, Artificial Sequence
  chemically synthesized
ccctccacccccagcagtctcc

SEQ ID NO: 49883 - DNA, 22 bp, Artificial Sequence
  chemically synthesized
cacccccagcagtctccaaagg

SEQ ID NO: 49884 - DNA, 22 bp, Artificial Sequence
  chemically synthesized
caaaggcctccaacaaccccag

SEQ ID NO: 49885 - DNA, 22 bp, Artificial Sequence
  chemically synthesized
caacaaccccagagtgggggcc

SEQ ID NO: 49886 - DNA, 22 bp, Artificial Sequence
  chemically synthesized
caagctgtatacggatcacact

SEQ ID NO: 49887 - DNA, 22 bp, Artificial Sequence
  chemically synthesized
tatacggatcacactggttttc

SEQ ID NO: 49888 - DNA, 22 bp, Artificial Sequence
  chemically synthesized
gttttccaggagcaaaaacaga

SEQ ID NO: 49889 - DNA, 22 bp, Artificial Sequence
  chemically synthesized
tccaggagcaaaaacagaaaca

SEQ ID NO: 49890 - DNA, 22 bp, Artificial Sequence
  chemically synthesized
ccaggagcaaaaacagaaacag

SEQ ID NO: 49891 - DNA, 22 bp, Artificial Sequence
  chemically synthesized
caggagcaaaaacagaaacagg

SEQ ID NO: 49892 - DNA, 22 bp, Artificial Sequence
  chemically synthesized
aggctggtcaaaattgaacctc

SEQ ID NO: 49893 - DNA, 22 bp, Artificial Sequence
  chemically synthesized
gtcaaaattgaacctcctcctg

SEQ ID NO: 49894 - DNA, 22 bp, Artificial Sequence
  chemically synthesized
aacctcctcctgctctgagcag

SEQ ID NO: 49895 - DNA, 22 bp, Artificial Sequence
  chemically synthesized
ctcctgctctgagcagcctggg

SEQ ID NO: 49896 - DNA, 22 bp, Artificial Sequence
  chemically synthesized
ctgctctgagcagcctgggggg

SEQ ID NO: 49897 - DNA, 22 bp, Artificial Sequence
  chemically synthesized
ctctgagcagcctggggggcag

SEQ ID NO: 49898 - DNA, 22 bp, Artificial Sequence
  chemically synthesized
tgagcagcctggggggcagact

SEQ ID NO: 49899 - DNA, 22 bp, Artificial Sequence
  chemically synthesized
agcagcctggggggcagactaa

SEQ ID NO: 49900 - DNA, 22 bp, Artificial Sequence
  chemically synthesized
gggggcagactaagcagagggc

SEQ ID NO: 49901 - DNA, 22 bp, Artificial Sequence
  chemically synthesized
agcagagggctgtgcagaccca

SEQ ID NO: 49902 - DNA, 22 bp, Artificial Sequence
  chemically synthesized
tgcagacccacataaagagcct

SEQ ID NO: 49903 - DNA, 22 bp, Artificial Sequence
  chemically synthesized
ctgtgtgccaggcacttcaccc

SEQ ID NO: 49904 - DNA, 22 bp, Artificial Sequence
  chemically synthesized
tgtgccaggcacttcacccgag

SEQ ID NO: 49905 - DNA, 22 bp, Artificial Sequence
  chemically synthesized
cacccgaggcacttcacaagca

SEQ ID NO: 49906 - DNA, 22 bp, Artificial Sequence
  chemically synthesized
acccgaggcacttcacaagcat

SEQ ID NO: 49907 - DNA, 22 bp, Artificial Sequence
  chemically synthesized
cacaagcatgcttgggaatgaa

SEQ ID NO: 49908 - DNA, 22 bp, Artificial Sequence
  chemically synthesized
acaagcatgcttgggaatgaaa

SEQ ID NO: 49909 - DNA, 22 bp, Artificial Sequence
  chemically synthesized
gggaatgaaacttccaactctt

SEQ ID NO: 49910 - DNA, 22 bp, Artificial Sequence
  chemically synthesized
ggaatgaaacttccaactcttt

SEQ ID NO: 49911 - DNA, 22 bp, Artificial Sequence
  chemically synthesized
ccaactctttgggatgcaggtg

SEQ ID NO: 49912 - DNA, 22 bp, Artificial Sequence
  chemically synthesized
caactctttgggatgcaggtga

SEQ ID NO: 49913 - DNA, 22 bp, Artificial Sequence
  chemically synthesized
tttgggatgcaggtgaaacagt

SEQ ID NO: 49914 - DNA, 22 bp, Artificial Sequence
  chemically synthesized
tgggatgcaggtgaaacagttc

SEQ ID NO: 49915 - DNA, 22 bp, Artificial Sequence
  chemically synthesized
gggatgcaggtgaaacagttcc

SEQ ID NO: 49916 - DNA, 22 bp, Artificial Sequence
  chemically synthesized
ggatgcaggtgaaacagttcct

SEQ ID NO: 49917 - DNA, 22 bp, Artificial Sequence
  chemically synthesized
ctggttcagagaggtgaagcgg

SEQ ID NO: 49918 - DNA, 22 bp, Artificial Sequence
  chemically synthesized
gttcagagaggtgaagcggcct

SEQ ID NO: 49919 - DNA, 22 bp, Artificial Sequence
  chemically synthesized
agagaggtgaagcggcctgcct

SEQ ID NO: 49920 - DNA, 22 bp, Artificial Sequence
  chemically synthesized
cctgaggcagcacagctcttct

SEQ ID NO: 49921 - DNA, 22 bp, Artificial Sequence
  chemically synthesized
aggcagcacagctcttctttac

SEQ ID NO: 49922 - DNA, 22 bp, Artificial Sequence
  chemically synthesized
ttctttacagatgtgcttcccc

SEQ ID NO: 49923 - DNA, 22 bp, Artificial Sequence
  chemically synthesized
ctttacagatgtgcttccccac

SEQ ID NO: 49924 - DNA, 22 bp, Artificial Sequence
  chemically synthesized
tttacagatgtgcttccccacc

SEQ ID NO: 49925 - DNA, 22 bp, Artificial Sequence
  chemically synthesized
tacagatgtgcttccccacctc

SEQ ID NO: 49926 - DNA, 22 bp, Artificial Sequence
  chemically synthesized
acagatgtgcttccccacctct

SEQ ID NO: 49927 - DNA, 22 bp, Artificial Sequence
  chemically synthesized
cagatgtgcttccccacctcta

SEQ ID NO: 49928 - DNA, 22 bp, Artificial Sequence
  chemically synthesized
ccccacctctaccctgtctcac

SEQ ID NO: 49929 - DNA, 22 bp, Artificial Sequence
  chemically synthesized
cccacctctaccctgtctcacg

SEQ ID NO: 49930 - DNA, 22 bp, Artificial Sequence
  chemically synthesized
taccctgtctcacggcccccca

SEQ ID NO: 49931 - DNA, 22 bp, Artificial Sequence
  chemically synthesized
ccctgtctcacggccccccatg

SEQ ID NO: 49932 - DNA, 22 bp, Artificial Sequence
  chemically synthesized
tctcacggccccccatgccagc

SEQ ID NO: 49933 - DNA, 22 bp, Artificial Sequence
  chemically synthesized
acggccccccatgccagcctga

SEQ ID NO: 49934 - DNA, 22 bp, Artificial Sequence
  chemically synthesized
acggttgtgtctgcctcagtca

SEQ ID NO: 49935 - DNA, 22 bp, Artificial Sequence
  chemically synthesized
tgtctgcctcagtcatgctcca

SEQ ID NO: 49936 - DNA, 22 bp, Artificial Sequence
  chemically synthesized
cctcagtcatgctccatttttc

SEQ ID NO: 49937 - DNA, 22 bp, Artificial Sequence
  chemically synthesized
agtcatgctccatttttccatc

SEQ ID NO: 49938 - DNA, 22 bp, Artificial Sequence
  chemically synthesized
catttttccatcgggaccatca

SEQ ID NO: 49939 - DNA, 22 bp, Artificial Sequence
  chemically synthesized
ttccatcgggaccatcaagagg

SEQ ID NO: 49940 - DNA, 22 bp, Artificial Sequence
  chemically synthesized
tccatcgggaccatcaagaggg

SEQ ID NO: 49941 - DNA, 22 bp, Artificial Sequence
  chemically synthesized
ccatcgggaccatcaagagggt

SEQ ID NO: 49942 - DNA, 22 bp, Artificial Sequence
  chemically synthesized
catcgggaccatcaagagggtg

SEQ ID NO: 49943 - DNA, 22 bp, Artificial Sequence
  chemically synthesized
gtgtctaaggctgactgggtaa

SEQ ID NO: 49944 - DNA, 22 bp, Artificial Sequence
  chemically synthesized
tgtctaaggctgactgggtaac

SEQ ID NO: 49945 - DNA, 22 bp, Artificial Sequence
  chemically synthesized
aggctgactgggtaactttgga

SEQ ID NO: 49946 - DNA, 22 bp, Artificial Sequence
  chemically synthesized
actgggtaactttggatgagcg

SEQ ID NO: 49947 - DNA, 22 bp, Artificial Sequence
  chemically synthesized
ggtaactttggatgagcggtct

SEQ ID NO: 49948 - DNA, 22 bp, Artificial Sequence
  chemically synthesized
tggatgagcggtctctccgctc

SEQ ID NO: 49949 - DNA, 22 bp, Artificial Sequence
  chemically synthesized
ggatgagcggtctctccgctct

SEQ ID NO: 49950 - DNA, 22 bp, Artificial Sequence
  chemically synthesized
gatgagcggtctctccgctctg

SEQ ID NO: 49951 - DNA, 22 bp, Artificial Sequence
  chemically synthesized
tccgctctgagcctgtttcctc

SEQ ID NO: 49952 - DNA, 22 bp, Artificial Sequence
  chemically synthesized
cgctctgagcctgtttcctcat

SEQ ID NO: 49953 - DNA, 22 bp, Artificial Sequence
  chemically synthesized
tgagcctgtttcctcatctgtc

SEQ ID NO: 49954 - DNA, 22 bp, Artificial Sequence
  chemically synthesized
agcctgtttcctcatctgtcaa

SEQ ID NO: 49955 - DNA, 22 bp, Artificial Sequence
  chemically synthesized
tttcctcatctgtcaaatgggc

SEQ ID NO: 49956 - DNA, 22 bp, Artificial Sequence
  chemically synthesized
cctcatctgtcaaatgggctct

SEQ ID NO: 49957 - DNA, 22 bp, Artificial Sequence
  chemically synthesized
ctcatctgtcaaatgggctcta

SEQ ID NO: 49958 - DNA, 22 bp, Artificial Sequence
  chemically synthesized
atctgtcaaatgggctctaacc

SEQ ID NO: 49959 - DNA, 22 bp, Artificial Sequence
  chemically synthesized
tcaaatgggctctaacccactc

SEQ ID NO: 49960 - DNA, 22 bp, Artificial Sequence
  chemically synthesized
taacccactctgatctcccagg

SEQ ID NO: 49961 - DNA, 22 bp, Artificial Sequence
  chemically synthesized
acccactctgatctcccagggc

SEQ ID NO: 49962 - DNA, 22 bp, Artificial Sequence
  chemically synthesized
tgatctcccagggcggcagtaa

SEQ ID NO: 49963 - DNA, 22 bp, Artificial Sequence
  chemically synthesized
atctcccagggcggcagtaagt

SEQ ID NO: 49964 - DNA, 22 bp, Artificial Sequence
  chemically synthesized
ccagggcggcagtaagtcttca

SEQ ID NO: 49965 - DNA, 22 bp, Artificial Sequence
  chemically synthesized
cagcatcaggcattttggggtg

SEQ ID NO: 49966 - DNA, 22 bp, Artificial Sequence
  chemically synthesized
agcatcaggcattttggggtga

SEQ ID NO: 49967 - DNA, 22 bp, Artificial Sequence
  chemically synthesized
tggggtgactcagtaaatggta

SEQ ID NO: 49968 - DNA, 22 bp, Artificial Sequence
  chemically synthesized
ggggtgactcagtaaatggtag

SEQ ID NO: 49969 - DNA, 22 bp, Artificial Sequence
  chemically synthesized
gggtgactcagtaaatggtaga

SEQ ID NO: 49970 - DNA, 22 bp, Artificial Sequence
  chemically synthesized
agtaaatggtagatcttgctac

SEQ ID NO: 49971 - DNA, 22 bp, Artificial Sequence
  chemically synthesized
gctaccagtggaacagccacta

SEQ ID NO: 49972 - DNA, 22 bp, Artificial Sequence
  chemically synthesized
ctaccagtggaacagccactaa

SEQ ID NO: 49973 - DNA, 22 bp, Artificial Sequence
  chemically synthesized
ccagtggaacagccactaagga

SEQ ID NO: 49974 - DNA, 22 bp, Artificial Sequence
  chemically synthesized
aggattctgcagtgagagcaga

SEQ ID NO: 49975 - DNA, 22 bp, Artificial Sequence
  chemically synthesized
tgcagtgagagcagagggccag

SEQ ID NO: 49976 - DNA, 22 bp, Artificial Sequence
  chemically synthesized
cagtgagagcagagggccagct

SEQ ID NO: 49977 - DNA, 22 bp, Artificial Sequence
  chemically synthesized
agtggtactctcccagagactg

SEQ ID NO: 49978 - DNA, 22 bp, Artificial Sequence
  chemically synthesized
tcccagagactgtctgactcac

SEQ ID NO: 49979 - DNA, 22 bp, Artificial Sequence
  chemically synthesized
ccagagactgtctgactcacgc

SEQ ID NO: 49980 - DNA, 22 bp, Artificial Sequence
  chemically synthesized
tctgactcacgccaccccctcc

SEQ ID NO: 49981 - DNA, 22 bp, Artificial Sequence
  chemically synthesized
actcacgccaccccctccacct

SEQ ID NO: 49982 - DNA, 22 bp, Artificial Sequence
  chemically synthesized
acgccaccccctccaccttgga

SEQ ID NO: 49983 - DNA, 22 bp, Artificial Sequence
  chemically synthesized
caccttggacacaggacgctgt

SEQ ID NO: 49984 - DNA, 22 bp, Artificial Sequence
  chemically synthesized
ggacacaggacgctgtggtttc

SEQ ID NO: 49985 - DNA, 22 bp, Artificial Sequence
  chemically synthesized
gacacaggacgctgtggtttct

SEQ ID NO: 49986 - DNA, 22 bp, Artificial Sequence
  chemically synthesized
tggtttctgagccaggtacaat

SEQ ID NO: 49987 - DNA, 22 bp, Artificial Sequence
  chemically synthesized
ctgagccaggtacaatgactcc

SEQ ID NO: 49988 - DNA, 22 bp, Artificial Sequence
  chemically synthesized
tgagccaggtacaatgactcct

SEQ ID NO: 49989 - DNA, 22 bp, Artificial Sequence
  chemically synthesized
agccaggtacaatgactccttt

SEQ ID NO: 49990 - DNA, 22 bp, Artificial Sequence
  chemically synthesized
ctttcggtaagtgcagtggaag

SEQ ID NO: 49991 - DNA, 22 bp, Artificial Sequence
  chemically synthesized
tcggtaagtgcagtggaagctg

SEQ ID NO: 49992 - DNA, 22 bp, Artificial Sequence
  chemically synthesized
cggtaagtgcagtggaagctgt

SEQ ID NO: 49993 - DNA, 22 bp, Artificial Sequence
  chemically synthesized
ggtaagtgcagtggaagctgta

SEQ ID NO: 49994 - DNA, 22 bp, Artificial Sequence
  chemically synthesized
tacactgcccaggcaaagcgtc

SEQ ID NO: 49995 - DNA, 22 bp, Artificial Sequence
  chemically synthesized
cccaggcaaagcgtccgggcag

SEQ ID NO: 49996 - DNA, 22 bp, Artificial Sequence
  chemically synthesized
agatcccagccagtggacttag

SEQ ID NO: 49997 - DNA, 22 bp, Artificial Sequence
  chemically synthesized
agcccctgtttgctcctccgat

SEQ ID NO: 49998 - DNA, 22 bp, Artificial Sequence
  chemically synthesized
gcccctgtttgctcctccgata

SEQ ID NO: 49999 - DNA, 22 bp, Artificial Sequence
  chemically synthesized
tttgctcctccgataactgggg

SEQ ID NO: 50000 - DNA, 22 bp, Artificial Sequence
  chemically synthesized
gctcctccgataactggggtga

SEQ ID NO: 50001 - DNA, 22 bp, Artificial Sequence
  chemically synthesized
ctcctccgataactggggtgac

SEQ ID NO: 50002 - DNA, 22 bp, Artificial Sequence
  chemically synthesized
ctccgataactggggtgacctt

SEQ ID NO: 50003 - DNA, 22 bp, Artificial Sequence
  chemically synthesized
cgataactggggtgaccttggt

SEQ ID NO: 50004 - DNA, 22 bp, Artificial Sequence
  chemically synthesized
gggtgaccttggttaatattca

SEQ ID NO: 50005 - DNA, 22 bp, Artificial Sequence
  chemically synthesized
ggttaatattcaccagcagcct

SEQ ID NO: 50006 - DNA, 22 bp, Artificial Sequence
  chemically synthesized
gttaatattcaccagcagcctc

SEQ ID NO: 50007 - DNA, 22 bp, Artificial Sequence
  chemically synthesized
atattcaccagcagcctccccc

SEQ ID NO: 50008 - DNA, 22 bp, Artificial Sequence
  chemically synthesized
accagcagcctcccccgttgcc

SEQ ID NO: 50009 - DNA, 22 bp, Artificial Sequence
  chemically synthesized
ccccgttgcccctctggatcca

SEQ ID NO: 50010 - DNA, 22 bp, Artificial Sequence
  chemically synthesized
cccctctggatccactgcttaa

SEQ ID NO: 50011 - DNA, 22 bp, Artificial Sequence
  chemically synthesized
tggatccactgcttaaatacgg

SEQ ID NO: 50012 - DNA, 22 bp, Artificial Sequence
  chemically synthesized
gatccactgcttaaatacggac

SEQ ID NO: 50013 - DNA, 22 bp, Artificial Sequence
  chemically synthesized
cttaaatacggacgaggacagg

SEQ ID NO: 50014 - DNA, 22 bp, Artificial Sequence
  chemically synthesized
aaatacggacgaggacagggcc

SEQ ID NO: 50015 - DNA, 22 bp, Artificial Sequence
  chemically synthesized
aatacggacgaggacagggccc

SEQ ID NO: 50016 - DNA, 22 bp, Artificial Sequence
  chemically synthesized
tctcctcagcttcaggcaccac

SEQ ID NO: 50017 - DNA, 22 bp, Artificial Sequence
  chemically synthesized
ctcagcttcaggcaccaccact

SEQ ID NO: 50018 - DNA, 22 bp, Artificial Sequence
  chemically synthesized
agcttcaggcaccaccactgac

SEQ ID NO: 50019 - DNA, 22 bp, Artificial Sequence
  chemically synthesized
caggcaccaccactgacctggg

SEQ ID NO: 50020 - DNA, 22 bp, Artificial Sequence
  chemically synthesized
aggcaccaccactgacctggga

SEQ ID NO: 50021 - DNA, 22 bp, Artificial Sequence
  chemically synthesized
acctgggacagtgaatcgtaag

SEQ ID NO: 50022 - DNA, 22 bp, Artificial Sequence
  chemically synthesized
ggacagtgaatcgtaagtatgc

SEQ ID NO: 50023 - DNA, 22 bp, Artificial Sequence
  chemically synthesized
tcactgcgagaggttctggaga

SEQ ID NO: 50024 - DNA, 22 bp, Artificial Sequence
  chemically synthesized
cactgcgagaggttctggagag

SEQ ID NO: 50025 - DNA, 22 bp, Artificial Sequence
  chemically synthesized
actgcgagaggttctggagagg

SEQ ID NO: 50026 - DNA, 22 bp, Artificial Sequence
  chemically synthesized
cgagaggttctggagaggcttc

SEQ ID NO: 50027 - DNA, 22 bp, Artificial Sequence
  chemically synthesized
tggagaggcttctgagctcccc

SEQ ID NO: 50028 - DNA, 22 bp, Artificial Sequence
  chemically synthesized
gagaggcttctgagctccccat

SEQ ID NO: 50029 - DNA, 22 bp, Artificial Sequence
  chemically synthesized
ctgagctccccatggcccaggc

SEQ ID NO: 50030 - DNA, 22 bp, Artificial Sequence
  chemically synthesized
tgagctccccatggcccaggca

SEQ ID NO: 50031 - DNA, 22 bp, Artificial Sequence
  chemically synthesized
agctccccatggcccaggcagg

SEQ ID NO: 50032 - DNA, 22 bp, Artificial Sequence
  chemically synthesized
cccatggcccaggcaggcagca

SEQ ID NO: 50033 - DNA, 22 bp, Artificial Sequence
  chemically synthesized
gggcaggaggggggttgtggag

SEQ ID NO: 50034 - DNA, 22 bp, Artificial Sequence
  chemically synthesized
tggagtgggtatccgcctgctg

SEQ ID NO: 50035 - DNA, 22 bp, Artificial Sequence
  chemically synthesized
ctgaggtgcagggcagatggag

SEQ ID NO: 50036 - DNA, 22 bp, Artificial Sequence
  chemically synthesized
aggtgcagggcagatggagagg

SEQ ID NO: 50037 - DNA, 22 bp, Artificial Sequence
  chemically synthesized
cagctgagctcctattttcata

SEQ ID NO: 50038 - DNA, 22 bp, Artificial Sequence
  chemically synthesized
agctcctattttcataataaca

SEQ ID NO: 50039 - DNA, 22 bp, Artificial Sequence
  chemically synthesized
ctattttcataataacagcagc

SEQ ID NO: 50040 - DNA, 22 bp, Artificial Sequence
  chemically synthesized
ttttcataataacagcagccat

SEQ ID NO: 50041 - DNA, 22 bp, Artificial Sequence
  chemically synthesized
tcataataacagcagccatgag

SEQ ID NO: 50042 - DNA, 22 bp, Artificial Sequence
  chemically synthesized
cataataacagcagccatgagg

SEQ ID NO: 50043 - DNA, 22 bp, Artificial Sequence
  chemically synthesized
ataataacagcagccatgaggg

SEQ ID NO: 50044 - DNA, 22 bp, Artificial Sequence
  chemically synthesized
tgtcctgtttcccagtcctgcc

SEQ ID NO: 50045 - DNA, 22 bp, Artificial Sequence
  chemically synthesized
tttcccagtcctgcccggtccc

SEQ ID NO: 50046 - DNA, 22 bp, Artificial Sequence
  chemically synthesized
cccagtcctgcccggtcccccc

SEQ ID NO: 50047 - DNA, 22 bp, Artificial Sequence
  chemically synthesized
ccagtcctgcccggtcccccct

SEQ ID NO: 50048 - DNA, 22 bp, Artificial Sequence
  chemically synthesized
cccggtcccccctcggtacctc

SEQ ID NO: 50049 - DNA, 22 bp, Artificial Sequence
  chemically synthesized
ggtacctcctggtggatacact

SEQ ID NO: 50050 - DNA, 22 bp, Artificial Sequence
  chemically synthesized
ctggtggatacactggttcctg

SEQ ID NO: 50051 - DNA, 22 bp, Artificial Sequence
  chemically synthesized
gtggatacactggttcctgtaa

SEQ ID NO: 50052 - DNA, 22 bp, Artificial Sequence
  chemically synthesized
gttcctgtaagcagaagtggat

SEQ ID NO: 50053 - DNA, 22 bp, Artificial Sequence
  chemically synthesized
ctgtaagcagaagtggatgagg

SEQ ID NO: 50054 - DNA, 22 bp, Artificial Sequence
  chemically synthesized
taagcagaagtggatgagggtg

SEQ ID NO: 50055 - DNA, 22 bp, Artificial Sequence
  chemically synthesized
ggtctgcagtcctggcacccca

SEQ ID NO: 50056 - DNA, 22 bp, Artificial Sequence
  chemically synthesized
cagtcctggcaccccaggatgg

SEQ ID NO: 50057 - DNA, 22 bp, Artificial Sequence
  chemically synthesized
gcaccccaggatgggggacacc

SEQ ID NO: 50058 - DNA, 22 bp, Artificial Sequence
  chemically synthesized
ctttctgtttgcacagctcctc

SEQ ID NO: 50059 - DNA, 22 bp, Artificial Sequence
  chemically synthesized
tttctgtttgcacagctcctct

SEQ ID NO: 50060 - DNA, 22 bp, Artificial Sequence
  chemically synthesized
tctgtttgcacagctcctctgt

SEQ ID NO: 50061 - DNA, 22 bp, Artificial Sequence
  chemically synthesized
ctgtttgcacagctcctctgtc

SEQ ID NO: 50062 - DNA, 22 bp, Artificial Sequence
  chemically synthesized
tgtttgcacagctcctctgtct

SEQ ID NO: 50063 - DNA, 22 bp, Artificial Sequence
  chemically synthesized
tttgcacagctcctctgtctgt

SEQ ID NO: 50064 - DNA, 22 bp, Artificial Sequence
  chemically synthesized
gcacagctcctctgtctgtcgg

SEQ ID NO: 50065 - DNA, 22 bp, Artificial Sequence
  chemically synthesized
cacagctcctctgtctgtcggg

SEQ ID NO: 50066 - DNA, 22 bp, Artificial Sequence
  chemically synthesized
ctctgtctgtcgggggctcctg

SEQ ID NO: 50067 - DNA, 22 bp, Artificial Sequence
  chemically synthesized
tgtctgtcgggggctcctgtct

SEQ ID NO: 50068 - DNA, 22 bp, Artificial Sequence
  chemically synthesized
tctgtcgggggctcctgtctgt

SEQ ID NO: 50069 - DNA, 22 bp, Artificial Sequence
  chemically synthesized
tcgggggctcctgtctgttgtc

SEQ ID NO: 50070 - DNA, 22 bp, Artificial Sequence
  chemically synthesized
ctgtctgttgtctcctataagc

SEQ ID NO: 50071 - DNA, 22 bp, Artificial Sequence
  chemically synthesized
tctgttgtctcctataagcctc

SEQ ID NO: 50072 - DNA, 22 bp, Artificial Sequence
  chemically synthesized
ttgtctcctataagcctcacca

SEQ ID NO: 50073 - DNA, 22 bp, Artificial Sequence
  chemically synthesized
tctcctataagcctcaccacct

SEQ ID NO: 50074 - DNA, 22 bp, Artificial Sequence
  chemically synthesized
ctataagcctcaccacctctcc

SEQ ID NO: 50075 - DNA, 22 bp, Artificial Sequence
  chemically synthesized
taagcctcaccacctctcctac

SEQ ID NO: 50076 - DNA, 22 bp, Artificial Sequence
  chemically synthesized
accacctctcctactgcttggg

SEQ ID NO: 50077 - DNA, 22 bp, Artificial Sequence
  chemically synthesized
tcctactgcttgggcatgcatc

SEQ ID NO: 50078 - DNA, 22 bp, Artificial Sequence
  chemically synthesized
ctactgcttgggcatgcatctt

SEQ ID NO: 50079 - DNA, 22 bp, Artificial Sequence
  chemically synthesized
ctgcttgggcatgcatctttct

SEQ ID NO: 50080 - DNA, 22 bp, Artificial Sequence
  chemically synthesized
cttgggcatgcatctttctccc

SEQ ID NO: 50081 - DNA, 22 bp, Artificial Sequence
  chemically synthesized
gggcatgcatctttctcccctt

SEQ ID NO: 50082 - DNA, 22 bp, Artificial Sequence
  chemically synthesized
ggcatgcatctttctccccttc

SEQ ID NO: 50083 - DNA, 22 bp, Artificial Sequence
  chemically synthesized
tctccccttctatagatgagga

SEQ ID NO: 50084 - DNA, 22 bp, Artificial Sequence
  chemically synthesized
ctccccttctatagatgaggag

SEQ ID NO: 50085 - DNA, 22 bp, Artificial Sequence
  chemically synthesized
tccccttctatagatgaggagg

SEQ ID NO: 50086 - DNA, 22 bp, Artificial Sequence
  chemically synthesized
cccttctatagatgaggaggtt

SEQ ID NO: 50087 - DNA, 22 bp, Artificial Sequence
  chemically synthesized
ctatagatgaggaggttaaggt

SEQ ID NO: 50088 - DNA, 22 bp, Artificial Sequence
  chemically synthesized
tatagatgaggaggttaaggtc

SEQ ID NO: 50089 - DNA, 22 bp, Artificial Sequence
  chemically synthesized
tagatgaggaggttaaggtcca

SEQ ID NO: 50090 - DNA, 22 bp, Artificial Sequence
  chemically synthesized
aggtccagagaggggtggggag

SEQ ID NO: 50091 - DNA, 22 bp, Artificial Sequence
  chemically synthesized
acattctccatcccctccagat

SEQ ID NO: 50092 - DNA, 22 bp, Artificial Sequence
  chemically synthesized
tccatcccctccagatatgacc

SEQ ID NO: 50093 - DNA, 22 bp, Artificial Sequence
  chemically synthesized
catcccctccagatatgaccag

SEQ ID NO: 50094 - DNA, 22 bp, Artificial Sequence
  chemically synthesized
cagatatgaccaggaacagacc

SEQ ID NO: 50095 - DNA, 20 bp, Artificial Sequence
  chemically synthesized
cgagcgagccgcgatgacaa

SEQ ID NO: 50096 - DNA, 20 bp, Artificial Sequence
  chemically synthesized
tcccatcaacatttctgtgc

SEQ ID NO: 50097 - DNA, 20 bp, Artificial Sequence
  chemically synthesized
tgctggactccttccactcg

SEQ ID NO: 50098 - DNA, 20 bp, Artificial Sequence
  chemically synthesized
gctggactccttccactcgc

SEQ ID NO: 50099 - DNA, 20 bp, Artificial Sequence
  chemically synthesized
ttccactcgcgggtcgtctc

SEQ ID NO: 50100 - DNA, 20 bp, Artificial Sequence
  chemically synthesized
ccactcgcgggtcgtctcca

SEQ ID NO: 50101 - DNA, 20 bp, Artificial Sequence
  chemically synthesized
cgcgggtcgtctccagagct

SEQ ID NO: 50102 - DNA, 20 bp, Artificial Sequence
  chemically synthesized
gtctccagagctcagaaaat

SEQ ID NO: 50103 - DNA, 20 bp, Artificial Sequence
  chemically synthesized
tctccagagctcagaaaatg

SEQ ID NO: 50104 - DNA, 20 bp, Artificial Sequence
  chemically synthesized
agctcagaaaatgaggtgat

SEQ ID NO: 50105 - DNA, 20 bp, Artificial Sequence
  chemically synthesized
tcagaaaatgaggtgatcag

SEQ ID NO: 50106 - DNA, 20 bp, Artificial Sequence
  chemically synthesized
cagaaaatgaggtgatcagt

SEQ ID NO: 50107 - DNA, 20 bp, Artificial Sequence
  chemically synthesized
aatgaggtgatcagtgggac

SEQ ID NO: 50108 - DNA, 20 bp, Artificial Sequence
  chemically synthesized
aggtgatcagtgggacgagt

SEQ ID NO: 50109 - DNA, 20 bp, Artificial Sequence
  chemically synthesized
ggtgatcagtgggacgagta

SEQ ID NO: 50110 - DNA, 20 bp, Artificial Sequence
  chemically synthesized
gatcagtgggacgagtaagg

SEQ ID NO: 50111 - DNA, 20 bp, Artificial Sequence
  chemically synthesized
atcagtgggacgagtaagga

SEQ ID NO: 50112 - DNA, 20 bp, Artificial Sequence
  chemically synthesized
tcagtgggacgagtaaggaa

SEQ ID NO: 50113 - DNA, 20 bp, Artificial Sequence
  chemically synthesized
cagtgggacgagtaaggaag

SEQ ID NO: 50114 - DNA, 20 bp, Artificial Sequence
  chemically synthesized
agtgggacgagtaaggaagg

SEQ ID NO: 50115 - DNA, 20 bp, Artificial Sequence
  chemically synthesized
gtgggacgagtaaggaaggg

SEQ ID NO: 50116 - DNA, 20 bp, Artificial Sequence
  chemically synthesized
gacgagtaaggaaggggggt

SEQ ID NO: 50117 - DNA, 20 bp, Artificial Sequence
  chemically synthesized
acgagtaaggaaggggggtt

SEQ ID NO: 50118 - DNA, 20 bp, Artificial Sequence
  chemically synthesized
gagtaaggaaggggggttgg

SEQ ID NO: 50119 - DNA, 20 bp, Artificial Sequence
  chemically synthesized
gtaaggaaggggggttggga

SEQ ID NO: 50120 - DNA, 20 bp, Artificial Sequence
  chemically synthesized
taaggaaggggggttgggag

SEQ ID NO: 50121 - DNA, 20 bp, Artificial Sequence
  chemically synthesized
aaggaaggggggttgggaga

SEQ ID NO: 50122 - DNA, 20 bp, Artificial Sequence
  chemically synthesized
aggaaggggggttgggagag

SEQ ID NO: 50123 - DNA, 20 bp, Artificial Sequence
  chemically synthesized
ggggttgggagaggggcgat

SEQ ID NO: 50124 - DNA, 20 bp, Artificial Sequence
  chemically synthesized
gggttgggagaggggcgatt

SEQ ID NO: 50125 - DNA, 20 bp, Artificial Sequence
  chemically synthesized
agaggggcgattgggcaacc

SEQ ID NO: 50126 - DNA, 20 bp, Artificial Sequence
  chemically synthesized
gcaacccggctgcacaaaca

SEQ ID NO: 50127 - DNA, 20 bp, Artificial Sequence
  chemically synthesized
caacccggctgcacaaacac

SEQ ID NO: 50128 - DNA, 20 bp, Artificial Sequence
  chemically synthesized
acccggctgcacaaacacgg

SEQ ID NO: 50129 - DNA, 20 bp, Artificial Sequence
  chemically synthesized
cccggctgcacaaacacggg

SEQ ID NO: 50130 - DNA, 20 bp, Artificial Sequence
  chemically synthesized
tgcacaaacacgggaggtca

SEQ ID NO: 50131 - DNA, 20 bp, Artificial Sequence
  chemically synthesized
gggaggtcaaagattgcgcc

SEQ ID NO: 50132 - DNA, 20 bp, Artificial Sequence
  chemically synthesized
aagattgcgcccagcccgcc

SEQ ID NO: 50133 - DNA, 20 bp, Artificial Sequence
  chemically synthesized
agattgcgcccagcccgccc

SEQ ID NO: 50134 - DNA, 20 bp, Artificial Sequence
  chemically synthesized
tgcgcccagcccgcccaggc

SEQ ID NO: 50135 - DNA, 20 bp, Artificial Sequence
  chemically synthesized
gcgcccagcccgcccaggcc

SEQ ID NO: 50136 - DNA, 20 bp, Artificial Sequence
  chemically synthesized
cagcccgcccaggccgggaa

SEQ ID NO: 50137 - DNA, 20 bp, Artificial Sequence
  chemically synthesized
cccaggccgggaatggaata

SEQ ID NO: 50138 - DNA, 20 bp, Artificial Sequence
  chemically synthesized
ccaggccgggaatggaataa

SEQ ID NO: 50139 - DNA, 20 bp, Artificial Sequence
  chemically synthesized
caggccgggaatggaataaa

SEQ ID NO: 50140 - DNA, 20 bp, Artificial Sequence
  chemically synthesized
gggaatggaataaagggacg

SEQ ID NO: 50141 - DNA, 20 bp, Artificial Sequence
  chemically synthesized
ggaatggaataaagggacgc

SEQ ID NO: 50142 - DNA, 20 bp, Artificial Sequence
  chemically synthesized
gaatggaataaagggacgcg

SEQ ID NO: 50143 - DNA, 20 bp, Artificial Sequence
  chemically synthesized
aataaagggacgcggggcgc

SEQ ID NO: 50144 - DNA, 20 bp, Artificial Sequence
  chemically synthesized
taaagggacgcggggcgccg

SEQ ID NO: 50145 - DNA, 20 bp, Artificial Sequence
  chemically synthesized
aaagggacgcggggcgccgg

SEQ ID NO: 50146 - DNA, 20 bp, Artificial Sequence
  chemically synthesized
gcggggcgccggaggctgca

SEQ ID NO: 50147 - DNA, 20 bp, Artificial Sequence
  chemically synthesized
gggcgccggaggctgcacag

SEQ ID NO: 50148 - DNA, 20 bp, Artificial Sequence
  chemically synthesized
gccggaggctgcacagaagc

SEQ ID NO: 50149 - DNA, 20 bp, Artificial Sequence
  chemically synthesized
gtccgactgtgctcgctgct

SEQ ID NO: 50150 - DNA, 20 bp, Artificial Sequence
  chemically synthesized
tcgctgctcagcgccgcacc

SEQ ID NO: 50151 - DNA, 20 bp, Artificial Sequence
  chemically synthesized
ctgctcagcgccgcacccgg

SEQ ID NO: 50152 - DNA, 20 bp, Artificial Sequence
  chemically synthesized
cagcgccgcacccggaagat

SEQ ID NO: 50153 - DNA, 20 bp, Artificial Sequence
  chemically synthesized
agcgccgcacccggaagatg

SEQ ID NO: 50154 - DNA, 20 bp, Artificial Sequence
  chemically synthesized
ccggaagatgaggctcgccg

SEQ ID NO: 50155 - DNA, 20 bp, Artificial Sequence
  chemically synthesized
cggaagatgaggctcgccgt

SEQ ID NO: 50156 - DNA, 20 bp, Artificial Sequence
  chemically synthesized
gaagatgaggctcgccgtgg

SEQ ID NO: 50157 - DNA, 20 bp, Artificial Sequence
  chemically synthesized
gctcgccgtgggagccctgc

SEQ ID NO: 50158 - DNA, 20 bp, Artificial Sequence
  chemically synthesized
cctgctggtctgcgccgtcc

SEQ ID NO: 50159 - DNA, 20 bp, Artificial Sequence
  chemically synthesized
ctgctggtctgcgccgtcct

SEQ ID NO: 50160 - DNA, 20 bp, Artificial Sequence
  chemically synthesized
tggtctgcgccgtcctgggt

SEQ ID NO: 50161 - DNA, 20 bp, Artificial Sequence
  chemically synthesized
tgcgccgtcctgggtgagtg

SEQ ID NO: 50162 - DNA, 20 bp, Artificial Sequence
  chemically synthesized
gcgccgtcctgggtgagtgc

SEQ ID NO: 50163 - DNA, 20 bp, Artificial Sequence
  chemically synthesized
gtcctgggtgagtgcgggca

SEQ ID NO: 50164 - DNA, 20 bp, Artificial Sequence
  chemically synthesized
tcctgggtgagtgcgggcac

SEQ ID NO: 50165 - DNA, 20 bp, Artificial Sequence
  chemically synthesized
cctgggtgagtgcgggcacg

SEQ ID NO: 50166 - DNA, 20 bp, Artificial Sequence
  chemically synthesized
gggtgagtgcgggcacgggg

SEQ ID NO: 50167 - DNA, 20 bp, Artificial Sequence
  chemically synthesized
gcgggcacggggtagcaccg

SEQ ID NO: 50168 - DNA, 20 bp, Artificial Sequence
  chemically synthesized
gggcacggggtagcaccgca

SEQ ID NO: 50169 - DNA, 20 bp, Artificial Sequence
  chemically synthesized
gggtagcaccgcagagtcgc

SEQ ID NO: 50170 - DNA, 20 bp, Artificial Sequence
  chemically synthesized
cccgcgcgttccctgcaacc

SEQ ID NO: 50171 - DNA, 20 bp, Artificial Sequence
  chemically synthesized
ccgcgcgttccctgcaaccc

SEQ ID NO: 50172 - DNA, 20 bp, Artificial Sequence
  chemically synthesized
cgcgttccctgcaacccggg

SEQ ID NO: 50173 - DNA, 20 bp, Artificial Sequence
  chemically synthesized
caacccgggcggccaccgcg

SEQ ID NO: 50174 - DNA, 20 bp, Artificial Sequence
  chemically synthesized
gcctgcatgcactccgcgct

SEQ ID NO: 50175 - DNA, 20 bp, Artificial Sequence
  chemically synthesized
cctgcatgcactccgcgctc

SEQ ID NO: 50176 - DNA, 20 bp, Artificial Sequence
  chemically synthesized
catgcactccgcgctcaggc

SEQ ID NO: 50177 - DNA, 20 bp, Artificial Sequence
  chemically synthesized
gcactccgcgctcaggctgg

SEQ ID NO: 50178 - DNA, 20 bp, Artificial Sequence
  chemically synthesized
ccgcgctcaggctggaagcc

SEQ ID NO: 50179 - DNA, 20 bp, Artificial Sequence
  chemically synthesized
cgcgctcaggctggaagcct

SEQ ID NO: 50180 - DNA, 20 bp, Artificial Sequence
  chemically synthesized
aggctggaagcctgggtgtc

SEQ ID NO: 50181 - DNA, 20 bp, Artificial Sequence
  chemically synthesized
ggctggaagcctgggtgtct

SEQ ID NO: 50182 - DNA, 20 bp, Artificial Sequence
  chemically synthesized
gcctctctacgccccacccc

SEQ ID NO: 50183 - DNA, 20 bp, Artificial Sequence
  chemically synthesized
ccccacccctggcctttgct

SEQ ID NO: 50184 - DNA, 20 bp, Artificial Sequence
  chemically synthesized
cccacccctggcctttgctt

SEQ ID NO: 50185 - DNA, 20 bp, Artificial Sequence
  chemically synthesized
ctggcctttgcttgggcttc

SEQ ID NO: 50186 - DNA, 20 bp, Artificial Sequence
  chemically synthesized
tccccctcctcctctttgtc

SEQ ID NO: 50187 - DNA, 20 bp, Artificial Sequence
  chemically synthesized
tctttgtccagtaaatcttg

SEQ ID NO: 50188 - DNA, 20 bp, Artificial Sequence
  chemically synthesized
ttgtccagtaaatcttgcag

SEQ ID NO: 50189 - DNA, 20 bp, Artificial Sequence
  chemically synthesized
agcagtgaaatacaataaat

SEQ ID NO: 50190 - DNA, 20 bp, Artificial Sequence
  chemically synthesized
cagtgaaatacaataaatca

SEQ ID NO: 50191 - DNA, 20 bp, Artificial Sequence
  chemically synthesized
taaatcagagcacgtctaac

SEQ ID NO: 50192 - DNA, 20 bp, Artificial Sequence
  chemically synthesized
aaatcagagcacgtctaacc

SEQ ID NO: 50193 - DNA, 20 bp, Artificial Sequence
  chemically synthesized
ctttgctgctgcctcttgtc

SEQ ID NO: 50194 - DNA, 20 bp, Artificial Sequence
  chemically synthesized
cttgtcaagtccgaactcct

SEQ ID NO: 50195 - DNA, 20 bp, Artificial Sequence
  chemically synthesized
caagtccgaactccttagca

SEQ ID NO: 50196 - DNA, 20 bp, Artificial Sequence
  chemically synthesized
aactccttagcatggcattc

SEQ ID NO: 50197 - DNA, 20 bp, Artificial Sequence
  chemically synthesized
actccttagcatggcattca

SEQ ID NO: 50198 - DNA, 20 bp, Artificial Sequence
  chemically synthesized
gcatggcattcaaggcctcc

SEQ ID NO: 50199 - DNA, 20 bp, Artificial Sequence
  chemically synthesized
catggcattcaaggcctccc

SEQ ID NO: 50200 - DNA, 20 bp, Artificial Sequence
  chemically synthesized
gggtctgaccattccccttt

SEQ ID NO: 50201 - DNA, 20 bp, Artificial Sequence
  chemically synthesized
gtctgaccattcccctttca

SEQ ID NO: 50202 - DNA, 20 bp, Artificial Sequence
  chemically synthesized
tctgaccattcccctttcag

SEQ ID NO: 50203 - DNA, 20 bp, Artificial Sequence
  chemically synthesized
tttcagaggctgatgtcccc

SEQ ID NO: 50204 - DNA, 20 bp, Artificial Sequence
  chemically synthesized
ttcagaggctgatgtcccct

SEQ ID NO: 50205 - DNA, 20 bp, Artificial Sequence
  chemically synthesized
ctgatgtcccctgggtgccc

SEQ ID NO: 50206 - DNA, 20 bp, Artificial Sequence
  chemically synthesized
tgatgtcccctgggtgccct

SEQ ID NO: 50207 - DNA, 20 bp, Artificial Sequence
  chemically synthesized
atgtcccctgggtgccctgg

SEQ ID NO: 50208 - DNA, 20 bp, Artificial Sequence
  chemically synthesized
cctgggtgccctgggagctg

SEQ ID NO: 50209 - DNA, 20 bp, Artificial Sequence
  chemically synthesized
ggagctgtagatgtcctgcc

SEQ ID NO: 50210 - DNA, 20 bp, Artificial Sequence
  chemically synthesized
gagctgtagatgtcctgcca

SEQ ID NO: 50211 - DNA, 20 bp, Artificial Sequence
  chemically synthesized
ctgtagatgtcctgccaagg

SEQ ID NO: 50212 - DNA, 20 bp, Artificial Sequence
  chemically synthesized
tagatgtcctgccaaggaag

SEQ ID NO: 50213 - DNA, 20 bp, Artificial Sequence
  chemically synthesized
gccaaggaagcggtgccatc

SEQ ID NO: 50214 - DNA, 20 bp, Artificial Sequence
  chemically synthesized
aaggaagcggtgccatcgag

SEQ ID NO: 50215 - DNA, 20 bp, Artificial Sequence
  chemically synthesized
aagcggtgccatcgagcggt

SEQ ID NO: 50216 - DNA, 20 bp, Artificial Sequence
  chemically synthesized
gcggtgccatcgagcggtca

SEQ ID NO: 50217 - DNA, 20 bp, Artificial Sequence
  chemically synthesized
gccatcgagcggtcagagca

SEQ ID NO: 50218 - DNA, 20 bp, Artificial Sequence
  chemically synthesized
ccatcgagcggtcagagcat

SEQ ID NO: 50219 - DNA, 20 bp, Artificial Sequence
  chemically synthesized
catcgagcggtcagagcatg

SEQ ID NO: 50220 - DNA, 20 bp, Artificial Sequence
  chemically synthesized
cggtcagagcatggggtttg

SEQ ID NO: 50221 - DNA, 20 bp, Artificial Sequence
  chemically synthesized
cagagcatggggtttgaagc

SEQ ID NO: 50222 - DNA, 20 bp, Artificial Sequence
  chemically synthesized
gggtttgaagccagacttct

SEQ ID NO: 50223 - DNA, 20 bp, Artificial Sequence
  chemically synthesized
aagccagacttcttggatcc

SEQ ID NO: 50224 - DNA, 20 bp, Artificial Sequence
  chemically synthesized
gacttcttggatccaagtcc

SEQ ID NO: 50225 - DNA, 20 bp, Artificial Sequence
  chemically synthesized
tcttggatccaagtcctggc

SEQ ID NO: 50226 - DNA, 20 bp, Artificial Sequence
  chemically synthesized
agtcctggccggctcctcac

SEQ ID NO: 50227 - DNA, 20 bp, Artificial Sequence
  chemically synthesized
gtcctggccggctcctcacc

SEQ ID NO: 50228 - DNA, 20 bp, Artificial Sequence
  chemically synthesized
tcctggccggctcctcacca

SEQ ID NO: 50229 - DNA, 20 bp, Artificial Sequence
  chemically synthesized
ctggccggctcctcaccagg

SEQ ID NO: 50230 - DNA, 20 bp, Artificial Sequence
  chemically synthesized
tggccggctcctcaccaggg

SEQ ID NO: 50231 - DNA, 20 bp, Artificial Sequence
  chemically synthesized
ggccggctcctcaccaggga

SEQ ID NO: 50232 - DNA, 20 bp, Artificial Sequence
  chemically synthesized
gccggctcctcaccagggag

SEQ ID NO: 50233 - DNA, 20 bp, Artificial Sequence
  chemically synthesized
ccggctcctcaccagggagg

SEQ ID NO: 50234 - DNA, 20 bp, Artificial Sequence
  chemically synthesized
caccagggagggggtcatca

SEQ ID NO: 50235 - DNA, 20 bp, Artificial Sequence
  chemically synthesized
gggtcatcacagcacttgcc

SEQ ID NO: 50236 - DNA, 20 bp, Artificial Sequence
  chemically synthesized
ggtcatcacagcacttgcct

SEQ ID NO: 50237 - DNA, 20 bp, Artificial Sequence
  chemically synthesized
tcatcacagcacttgcctgg

SEQ ID NO: 50238 - DNA, 20 bp, Artificial Sequence
  chemically synthesized
catcacagcacttgcctggg

SEQ ID NO: 50239 - DNA, 20 bp, Artificial Sequence
  chemically synthesized
atcacagcacttgcctggga

SEQ ID NO: 50240 - DNA, 20 bp, Artificial Sequence
  chemically synthesized
cttgcctgggagggtcaaat

SEQ ID NO: 50241 - DNA, 20 bp, Artificial Sequence
  chemically synthesized
ttgcctgggagggtcaaatg

SEQ ID NO: 50242 - DNA, 20 bp, Artificial Sequence
  chemically synthesized
tgcctgggagggtcaaatga

SEQ ID NO: 50243 - DNA, 20 bp, Artificial Sequence
  chemically synthesized
tgggagggtcaaatgagggt

SEQ ID NO: 50244 - DNA, 20 bp, Artificial Sequence
  chemically synthesized
agggtcaaatgagggtcagc

SEQ ID NO: 50245 - DNA, 20 bp, Artificial Sequence
  chemically synthesized
gggtcaaatgagggtcagcg

SEQ ID NO: 50246 - DNA, 20 bp, Artificial Sequence
  chemically synthesized
tcaaatgagggtcagcgagg

SEQ ID NO: 50247 - DNA, 20 bp, Artificial Sequence
  chemically synthesized
aatgagggtcagcgaggtgg

SEQ ID NO: 50248 - DNA, 20 bp, Artificial Sequence
  chemically synthesized
tcagcgaggtggcagatgct

SEQ ID NO: 50249 - DNA, 20 bp, Artificial Sequence
  chemically synthesized
aggtggcagatgctgagtac

SEQ ID NO: 50250 - DNA, 20 bp, Artificial Sequence
  chemically synthesized
tggcagatgctgagtaccag

SEQ ID NO: 50251 - DNA, 20 bp, Artificial Sequence
  chemically synthesized
cagatgctgagtaccagtgg

SEQ ID NO: 50252 - DNA, 20 bp, Artificial Sequence
  chemically synthesized
atgttgcacacatcctgcta

SEQ ID NO: 50253 - DNA, 20 bp, Artificial Sequence
  chemically synthesized
tgttgcacacatcctgctat

SEQ ID NO: 50254 - DNA, 20 bp, Artificial Sequence
  chemically synthesized
gttgcacacatcctgctatg

SEQ ID NO: 50255 - DNA, 20 bp, Artificial Sequence
  chemically synthesized
gcacacatcctgctatgggg

SEQ ID NO: 50256 - DNA, 20 bp, Artificial Sequence
  chemically synthesized
cacatcctgctatggggcag

SEQ ID NO: 50257 - DNA, 20 bp, Artificial Sequence
  chemically synthesized
gccacactccccgacctcct

SEQ ID NO: 50258 - DNA, 20 bp, Artificial Sequence
  chemically synthesized
ccacactccccgacctcctg

SEQ ID NO: 50259 - DNA, 20 bp, Artificial Sequence
  chemically synthesized
cactccccgacctcctgagg

SEQ ID NO: 50260 - DNA, 20 bp, Artificial Sequence
  chemically synthesized
actccccgacctcctgaggt

SEQ ID NO: 50261 - DNA, 20 bp, Artificial Sequence
  chemically synthesized
ctccccgacctcctgaggtg

SEQ ID NO: 50262 - DNA, 20 bp, Artificial Sequence
  chemically synthesized
taacttctgcctgccattca

SEQ ID NO: 50263 - DNA, 20 bp, Artificial Sequence
  chemically synthesized
aacttctgcctgccattcat

SEQ ID NO: 50264 - DNA, 20 bp, Artificial Sequence
  chemically synthesized
acttctgcctgccattcatg

SEQ ID NO: 50265 - DNA, 20 bp, Artificial Sequence
  chemically synthesized
tggggcatttgtcacactgt

SEQ ID NO: 50266 - DNA, 20 bp, Artificial Sequence
  chemically synthesized
ggggcatttgtcacactgtt

SEQ ID NO: 50267 - DNA, 20 bp, Artificial Sequence
  chemically synthesized
gggcatttgtcacactgttg

SEQ ID NO: 50268 - DNA, 20 bp, Artificial Sequence
  chemically synthesized
actgttggggcttccacgtt

SEQ ID NO: 50269 - DNA, 20 bp, Artificial Sequence
  chemically synthesized
gtttagttttctctccccat

SEQ ID NO: 50270 - DNA, 20 bp, Artificial Sequence
  chemically synthesized
agttttctctccccataagc

SEQ ID NO: 50271 - DNA, 20 bp, Artificial Sequence
  chemically synthesized
ccataagctagcaattcctt

SEQ ID NO: 50272 - DNA, 20 bp, Artificial Sequence
  chemically synthesized
ataagctagcaattccttga

SEQ ID NO: 50273 - DNA, 20 bp, Artificial Sequence
  chemically synthesized
aagctagcaattccttgaga

SEQ ID NO: 50274 - DNA, 20 bp, Artificial Sequence
  chemically synthesized
agctagcaattccttgagag

SEQ ID NO: 50275 - DNA, 20 bp, Artificial Sequence
  chemically synthesized
tacttgcctttatccccgca

SEQ ID NO: 50276 - DNA, 20 bp, Artificial Sequence
  chemically synthesized
cttgcctttatccccgcaca

SEQ ID NO: 50277 - DNA, 20 bp, Artificial Sequence
  chemically synthesized
tccccgcacagagcacttca

SEQ ID NO: 50278 - DNA, 20 bp, Artificial Sequence
  chemically synthesized
ccccgcacagagcacttcac

SEQ ID NO: 50279 - DNA, 20 bp, Artificial Sequence
  chemically synthesized
gagcacttcacaggctgtgc

SEQ ID NO: 50280 - DNA, 20 bp, Artificial Sequence
  chemically synthesized
agcacttcacaggctgtgca

SEQ ID NO: 50281 - DNA, 20 bp, Artificial Sequence
  chemically synthesized
gtgcaaggtaatgctccact

SEQ ID NO: 50282 - DNA, 20 bp, Artificial Sequence
  chemically synthesized
tgcaaggtaatgctccactg

SEQ ID NO: 50283 - DNA, 20 bp, Artificial Sequence
  chemically synthesized
tgaggacacattctcgccta

SEQ ID NO: 50284 - DNA, 20 bp, Artificial Sequence
  chemically synthesized
gaggacacattctcgcctat

SEQ ID NO: 50285 - DNA, 20 bp, Artificial Sequence
  chemically synthesized
attctcgcctatgggaactc

SEQ ID NO: 50286 - DNA, 20 bp, Artificial Sequence
  chemically synthesized
tctcgcctatgggaactctg

SEQ ID NO: 50287 - DNA, 20 bp, Artificial Sequence
  chemically synthesized
ctcgcctatgggaactctgg

SEQ ID NO: 50288 - DNA, 20 bp, Artificial Sequence
  chemically synthesized
gcctatgggaactctggagg

SEQ ID NO: 50289 - DNA, 20 bp, Artificial Sequence
  chemically synthesized
cctatgggaactctggaggc

SEQ ID NO: 50290 - DNA, 20 bp, Artificial Sequence
  chemically synthesized
ctatgggaactctggaggca

SEQ ID NO: 50291 - DNA, 20 bp, Artificial Sequence
  chemically synthesized
actctggaggcagggctttg

SEQ ID NO: 50292 - DNA, 20 bp, Artificial Sequence
  chemically synthesized
tctggaggcagggctttgtg

SEQ ID NO: 50293 - DNA, 20 bp, Artificial Sequence
  chemically synthesized
ctggaggcagggctttgtgg

SEQ ID NO: 50294 - DNA, 20 bp, Artificial Sequence
  chemically synthesized
tggaggcagggctttgtgga

SEQ ID NO: 50295 - DNA, 20 bp, Artificial Sequence
  chemically synthesized
ggaggcagggctttgtggag

SEQ ID NO: 50296 - DNA, 20 bp, Artificial Sequence
  chemically synthesized
gctttgtggaggggctgcca

SEQ ID NO: 50297 - DNA, 20 bp, Artificial Sequence
  chemically synthesized
ctttgtggaggggctgccac

SEQ ID NO: 50298 - DNA, 20 bp, Artificial Sequence
  chemically synthesized
cacaggcttatgttgcctcc

SEQ ID NO: 50299 - DNA, 20 bp, Artificial Sequence
  chemically synthesized
acaggcttatgttgcctcct

SEQ ID NO: 50300 - DNA, 20 bp, Artificial Sequence
  chemically synthesized
ttgcctcctaggatttccca

SEQ ID NO: 50301 - DNA, 20 bp, Artificial Sequence
  chemically synthesized
tgcctcctaggatttcccat

SEQ ID NO: 50302 - DNA, 20 bp, Artificial Sequence
  chemically synthesized
cctaggatttcccatgggcc

SEQ ID NO: 50303 - DNA, 20 bp, Artificial Sequence
  chemically synthesized
taggatttcccatgggccaa

SEQ ID NO: 50304 - DNA, 20 bp, Artificial Sequence
  chemically synthesized
aggatttcccatgggccaag

SEQ ID NO: 50305 - DNA, 20 bp, Artificial Sequence
  chemically synthesized
ggatttcccatgggccaaga

SEQ ID NO: 50306 - DNA, 20 bp, Artificial Sequence
  chemically synthesized
ccatgggccaagagggaaaa

SEQ ID NO: 50307 - DNA, 20 bp, Artificial Sequence
  chemically synthesized
catgggccaagagggaaaat

SEQ ID NO: 50308 - DNA, 20 bp, Artificial Sequence
  chemically synthesized
atgggccaagagggaaaatg

SEQ ID NO: 50309 - DNA, 20 bp, Artificial Sequence
  chemically synthesized
tgggccaagagggaaaatgg

SEQ ID NO: 50310 - DNA, 20 bp, Artificial Sequence
  chemically synthesized
agagggaaaatgggggtcgc

SEQ ID NO: 50311 - DNA, 20 bp, Artificial Sequence
  chemically synthesized
gagggaaaatgggggtcgct

SEQ ID NO: 50312 - DNA, 20 bp, Artificial Sequence
  chemically synthesized
agggaaaatgggggtcgctg

SEQ ID NO: 50313 - DNA, 20 bp, Artificial Sequence
  chemically synthesized
gaaaatgggggtcgctgggg

SEQ ID NO: 50314 - DNA, 20 bp, Artificial Sequence
  chemically synthesized
gtcgctggggtggccatccc

SEQ ID NO: 50315 - DNA, 20 bp, Artificial Sequence
  chemically synthesized
gctggggtggccatccctgg

SEQ ID NO: 50316 - DNA, 20 bp, Artificial Sequence
  chemically synthesized
tggcccctcctcatgcatcc

SEQ ID NO: 50317 - DNA, 20 bp, Artificial Sequence
  chemically synthesized
gcccctcctcatgcatcctg

SEQ ID NO: 50318 - DNA, 20 bp, Artificial Sequence
  chemically synthesized
ccctcctcatgcatcctgga

SEQ ID NO: 50319 - DNA, 20 bp, Artificial Sequence
  chemically synthesized
tcatgcatcctggagagctg

SEQ ID NO: 50320 - DNA, 20 bp, Artificial Sequence
  chemically synthesized
catgcatcctggagagctgt

SEQ ID NO: 50321 - DNA, 20 bp, Artificial Sequence
  chemically synthesized
agctgtgggcctcctctcca

SEQ ID NO: 50322 - DNA, 20 bp, Artificial Sequence
  chemically synthesized
gctgtgggcctcctctccac

SEQ ID NO: 50323 - DNA, 20 bp, Artificial Sequence
  chemically synthesized
cctcctctccacaggctttg

SEQ ID NO: 50324 - DNA, 20 bp, Artificial Sequence
  chemically synthesized
caggctttgtggatcttctt

SEQ ID NO: 50325 - DNA, 20 bp, Artificial Sequence
  chemically synthesized
ggctttgtggatcttcttca

SEQ ID NO: 50326 - DNA, 20 bp, Artificial Sequence
  chemically synthesized
ttgtggatcttcttcagagc

SEQ ID NO: 50327 - DNA, 20 bp, Artificial Sequence
  chemically synthesized
ggatcttcttcagagccagt

SEQ ID NO: 50328 - DNA, 20 bp, Artificial Sequence
  chemically synthesized
cttcttcagagccagtgagt

SEQ ID NO: 50329 - DNA, 20 bp, Artificial Sequence
  chemically synthesized
ccagtgagtcagccttgctg

SEQ ID NO: 50330 - DNA, 20 bp, Artificial Sequence
  chemically synthesized
gtgagtcagccttgctgtgg

SEQ ID NO: 50331 - DNA, 20 bp, Artificial Sequence
  chemically synthesized
gccttgctgtggtggcccac

SEQ ID NO: 50332 - DNA, 20 bp, Artificial Sequence
  chemically synthesized
ccttgctgtggtggcccaca

SEQ ID NO: 50333 - DNA, 20 bp, Artificial Sequence
  chemically synthesized
ttgctgtggtggcccacaag

SEQ ID NO: 50334 - DNA, 20 bp, Artificial Sequence
  chemically synthesized
ctgtggtggcccacaaggag

SEQ ID NO: 50335 - DNA, 20 bp, Artificial Sequence
  chemically synthesized
gtggtggcccacaaggagtg

SEQ ID NO: 50336 - DNA, 20 bp, Artificial Sequence
  chemically synthesized
cccacaaggagtggagatga

SEQ ID NO: 50337 - DNA, 20 bp, Artificial Sequence
  chemically synthesized
cacaaggagtggagatgaca

SEQ ID NO: 50338 - DNA, 20 bp, Artificial Sequence
  chemically synthesized
acaaggagtggagatgacag

SEQ ID NO: 50339 - DNA, 20 bp, Artificial Sequence
  chemically synthesized
caaggagtggagatgacaga

SEQ ID NO: 50340 - DNA, 20 bp, Artificial Sequence
  chemically synthesized
gtggagatgacagagggcct

SEQ ID NO: 50341 - DNA, 20 bp, Artificial Sequence
  chemically synthesized
tggagatgacagagggcctt

SEQ ID NO: 50342 - DNA, 20 bp, Artificial Sequence
  chemically synthesized
ggagatgacagagggccttg

SEQ ID NO: 50343 - DNA, 20 bp, Artificial Sequence
  chemically synthesized
atgacagagggccttgggga

SEQ ID NO: 50344 - DNA, 20 bp, Artificial Sequence
  chemically synthesized
tgacagagggccttggggac

SEQ ID NO: 50345 - DNA, 20 bp, Artificial Sequence
  chemically synthesized
gacagagggccttggggaca

SEQ ID NO: 50346 - DNA, 20 bp, Artificial Sequence
  chemically synthesized
gggccttggggacagggcaa

SEQ ID NO: 50347 - DNA, 20 bp, Artificial Sequence
  chemically synthesized
cagggcaaaagctcatgtga

SEQ ID NO: 50348 - DNA, 20 bp, Artificial Sequence
  chemically synthesized
agggcaaaagctcatgtgat

SEQ ID NO: 50349 - DNA, 20 bp, Artificial Sequence
  chemically synthesized
gggcaaaagctcatgtgata

SEQ ID NO: 50350 - DNA, 20 bp, Artificial Sequence
  chemically synthesized
atgctgtctctgcaaccaca

SEQ ID NO: 50351 - DNA, 20 bp, Artificial Sequence
  chemically synthesized
tgcaaccacatggattttaa

SEQ ID NO: 50352 - DNA, 20 bp, Artificial Sequence
  chemically synthesized
tggattttaatagttaccca

SEQ ID NO: 50353 - DNA, 20 bp, Artificial Sequence
  chemically synthesized
ttttaatagttacccatggc

SEQ ID NO: 50354 - DNA, 20 bp, Artificial Sequence
  chemically synthesized
tagttacccatggctggctt

SEQ ID NO: 50355 - DNA, 20 bp, Artificial Sequence
  chemically synthesized
gcttcagctttttttgtgaa

SEQ ID NO: 50356 - DNA, 20 bp, Artificial Sequence
  chemically synthesized
tcagctttttttgtgaatgg

SEQ ID NO: 50357 - DNA, 20 bp, Artificial Sequence
  chemically synthesized
ttttgtgaatggcagccaaa

SEQ ID NO: 50358 - DNA, 20 bp, Artificial Sequence
  chemically synthesized
tgaatggcagccaaaaagtg

SEQ ID NO: 50359 - DNA, 20 bp, Artificial Sequence
  chemically synthesized
gccaaaaagtgtggtgaaaa

SEQ ID NO: 50360 - DNA, 20 bp, Artificial Sequence
  chemically synthesized
caaaaagtgtggtgaaaatg

SEQ ID NO: 50361 - DNA, 20 bp, Artificial Sequence
  chemically synthesized
aaaaagtgtggtgaaaatgg

SEQ ID NO: 50362 - DNA, 20 bp, Artificial Sequence
  chemically synthesized
aaaagtgtggtgaaaatgga

SEQ ID NO: 50363 - DNA, 20 bp, Artificial Sequence
  chemically synthesized
gtgtggtgaaaatggaggga

SEQ ID NO: 50364 - DNA, 20 bp, Artificial Sequence
  chemically synthesized
gtgaaaatggagggatagtt

SEQ ID NO: 50365 - DNA, 20 bp, Artificial Sequence
  chemically synthesized
aaaatggagggatagttcag

SEQ ID NO: 50366 - DNA, 20 bp, Artificial Sequence
  chemically synthesized
aatggagggatagttcagtg

SEQ ID NO: 50367 - DNA, 20 bp, Artificial Sequence
  chemically synthesized
gagggatagttcagtggaga

SEQ ID NO: 50368 - DNA, 20 bp, Artificial Sequence
  chemically synthesized
gggatagttcagtggagaca

SEQ ID NO: 50369 - DNA, 20 bp, Artificial Sequence
  chemically synthesized
ggatagttcagtggagacag

SEQ ID NO: 50370 - DNA, 20 bp, Artificial Sequence
  chemically synthesized
gatagttcagtggagacaga

SEQ ID NO: 50371 - DNA, 20 bp, Artificial Sequence
  chemically synthesized
atagttcagtggagacagag

SEQ ID NO: 50372 - DNA, 20 bp, Artificial Sequence
  chemically synthesized
agttcagtggagacagaggg

SEQ ID NO: 50373 - DNA, 20 bp, Artificial Sequence
  chemically synthesized
aggggagactgttgaatttg

SEQ ID NO: 50374 - DNA, 20 bp, Artificial Sequence
  chemically synthesized
gggagactgttgaatttgtg

SEQ ID NO: 50375 - DNA, 20 bp, Artificial Sequence
  chemically synthesized
tgttgaatttgtggagtttt

SEQ ID NO: 50376 - DNA, 20 bp, Artificial Sequence
  chemically synthesized
agtttttagttcttcctaaa

SEQ ID NO: 50377 - DNA, 20 bp, Artificial Sequence
  chemically synthesized
tttttagttcttcctaaaca

SEQ ID NO: 50378 - DNA, 20 bp, Artificial Sequence
  chemically synthesized
tttagttcttcctaaacaga

SEQ ID NO: 50379 - DNA, 20 bp, Artificial Sequence
  chemically synthesized
tcttcctaaacagagagcaa

SEQ ID NO: 50380 - DNA, 20 bp, Artificial Sequence
  chemically synthesized
ctaaacagagagcaacagac

SEQ ID NO: 50381 - DNA, 20 bp, Artificial Sequence
  chemically synthesized
aaacagagagcaacagacaa

SEQ ID NO: 50382 - DNA, 20 bp, Artificial Sequence
  chemically synthesized
agagcaacagacaagagtta

SEQ ID NO: 50383 - DNA, 20 bp, Artificial Sequence
  chemically synthesized
gttaatttaccctcaactac

SEQ ID NO: 50384 - DNA, 20 bp, Artificial Sequence
  chemically synthesized
tttaccctcaactactggcc

SEQ ID NO: 50385 - DNA, 20 bp, Artificial Sequence
  chemically synthesized
accctcaactactggccaag

SEQ ID NO: 50386 - DNA, 20 bp, Artificial Sequence
  chemically synthesized
ccctcaactactggccaaga

SEQ ID NO: 50387 - DNA, 20 bp, Artificial Sequence
  chemically synthesized
cctcaactactggccaagaa

SEQ ID NO: 50388 - DNA, 20 bp, Artificial Sequence
  chemically synthesized
ctcaactactggccaagaag

SEQ ID NO: 50389 - DNA, 20 bp, Artificial Sequence
  chemically synthesized
ggccaagaaggggtgtaact

SEQ ID NO: 50390 - DNA, 20 bp, Artificial Sequence
  chemically synthesized
gttttcttcttttgtgccct

SEQ ID NO: 50391 - DNA, 20 bp, Artificial Sequence
  chemically synthesized
ttcttcttttgtgccctgag

SEQ ID NO: 50392 - DNA, 20 bp, Artificial Sequence
  chemically synthesized
ttcttttgtgccctgagtag

SEQ ID NO: 50393 - DNA, 20 bp, Artificial Sequence
  chemically synthesized
tgtgccctgagtagcagacc

SEQ ID NO: 50394 - DNA, 20 bp, Artificial Sequence
  chemically synthesized
tgccctgagtagcagaccca

SEQ ID NO: 50395 - DNA, 20 bp, Artificial Sequence
  chemically synthesized
tgagtagcagacccagagtc

SEQ ID NO: 50396 - DNA, 20 bp, Artificial Sequence
  chemically synthesized
agtagcagacccagagtctg

SEQ ID NO: 50397 - DNA, 20 bp, Artificial Sequence
  chemically synthesized
agacccagagtctggagacc

SEQ ID NO: 50398 - DNA, 20 bp, Artificial Sequence
  chemically synthesized
gagtctggagacccagattc

SEQ ID NO: 50399 - DNA, 20 bp, Artificial Sequence
  chemically synthesized
agtctggagacccagattct

SEQ ID NO: 50400 - DNA, 20 bp, Artificial Sequence
  chemically synthesized
ggagacccagattctaggcc

SEQ ID NO: 50401 - DNA, 20 bp, Artificial Sequence
  chemically synthesized
cccagattctaggcctggct

SEQ ID NO: 50402 - DNA, 20 bp, Artificial Sequence
  chemically synthesized
ggcctggcttggccaacgac

SEQ ID NO: 50403 - DNA, 20 bp, Artificial Sequence
  chemically synthesized
ctggcttggccaacgacaag

SEQ ID NO: 50404 - DNA, 20 bp, Artificial Sequence
  chemically synthesized
tggcttggccaacgacaagc

SEQ ID NO: 50405 - DNA, 20 bp, Artificial Sequence
  chemically synthesized
ggcttggccaacgacaagca

SEQ ID NO: 50406 - DNA, 20 bp, Artificial Sequence
  chemically synthesized
aacgacaagcagggtgacct

SEQ ID NO: 50407 - DNA, 20 bp, Artificial Sequence
  chemically synthesized
acgacaagcagggtgacctt

SEQ ID NO: 50408 - DNA, 20 bp, Artificial Sequence
  chemically synthesized
ccttgggttaaaaaaaaaaa

SEQ ID NO: 50409 - DNA, 20 bp, Artificial Sequence
  chemically synthesized
cttgggttaaaaaaaaaaaa

SEQ ID NO: 50410 - DNA, 20 bp, Artificial Sequence
  chemically synthesized
aaaaaaaggcatcattctct

SEQ ID NO: 50411 - DNA, 20 bp, Artificial Sequence
  chemically synthesized
tctcactccctcttctcaaa

SEQ ID NO: 50412 - DNA, 20 bp, Artificial Sequence
  chemically synthesized
actccctcttctcaaaaaga

SEQ ID NO: 50413 - DNA, 20 bp, Artificial Sequence
  chemically synthesized
gatggcaattcctcccccgc

SEQ ID NO: 50414 - DNA, 20 bp, Artificial Sequence
  chemically synthesized
cctcccccgctggttttcca

SEQ ID NO: 50415 - DNA, 20 bp, Artificial Sequence
  chemically synthesized
cccgctggttttccatagtt

SEQ ID NO: 50416 - DNA, 20 bp, Artificial Sequence
  chemically synthesized
ccgctggttttccatagttg

SEQ ID NO: 50417 - DNA, 20 bp, Artificial Sequence
  chemically synthesized
ctggttttccatagttgagg

SEQ ID NO: 50418 - DNA, 20 bp, Artificial Sequence
  chemically synthesized
ttttccatagttgaggtagc

SEQ ID NO: 50419 - DNA, 20 bp, Artificial Sequence
  chemically synthesized
gaggtagcaagccaatgtgt

SEQ ID NO: 50420 - DNA, 20 bp, Artificial Sequence
  chemically synthesized
aggtagcaagccaatgtgtt

SEQ ID NO: 50421 - DNA, 20 bp, Artificial Sequence
  chemically synthesized
ggtagcaagccaatgtgttg

SEQ ID NO: 50422 - DNA, 20 bp, Artificial Sequence
  chemically synthesized
agcaagccaatgtgttgggg

SEQ ID NO: 50423 - DNA, 20 bp, Artificial Sequence
  chemically synthesized
gaaaacgccctgtgcatact

SEQ ID NO: 50424 - DNA, 20 bp, Artificial Sequence
  chemically synthesized
aaaacgccctgtgcatactg

SEQ ID NO: 50425 - DNA, 20 bp, Artificial Sequence
  chemically synthesized
atactgaggcttatgttcca

SEQ ID NO: 50426 - DNA, 20 bp, Artificial Sequence
  chemically synthesized
tactgaggcttatgttccat

SEQ ID NO: 50427 - DNA, 20 bp, Artificial Sequence
  chemically synthesized
actgaggcttatgttccatg

SEQ ID NO: 50428 - DNA, 20 bp, Artificial Sequence
  chemically synthesized
ctgaggcttatgttccatgg

SEQ ID NO: 50429 - DNA, 20 bp, Artificial Sequence
  chemically synthesized
tgaggcttatgttccatggg

SEQ ID NO: 50430 - DNA, 20 bp, Artificial Sequence
  chemically synthesized
gcttatgttccatggggggc

SEQ ID NO: 50431 - DNA, 20 bp, Artificial Sequence
  chemically synthesized
cttatgttccatggggggcc

SEQ ID NO: 50432 - DNA, 20 bp, Artificial Sequence
  chemically synthesized
ttatgttccatggggggcca

SEQ ID NO: 50433 - DNA, 20 bp, Artificial Sequence
  chemically synthesized
tatgttccatggggggccag

SEQ ID NO: 50434 - DNA, 20 bp, Artificial Sequence
  chemically synthesized
ttccatggggggccaggggc

SEQ ID NO: 50435 - DNA, 20 bp, Artificial Sequence
  chemically synthesized
tccatggggggccaggggcc

SEQ ID NO: 50436 - DNA, 20 bp, Artificial Sequence
  chemically synthesized
tggggggccaggggccagga

SEQ ID NO: 50437 - DNA, 20 bp, Artificial Sequence
  chemically synthesized
gccaggggccaggacagtga

SEQ ID NO: 50438 - DNA, 20 bp, Artificial Sequence
  chemically synthesized
ccaggggccaggacagtgat

SEQ ID NO: 50439 - DNA, 20 bp, Artificial Sequence
  chemically synthesized
aggggccaggacagtgatgg

SEQ ID NO: 50440 - DNA, 20 bp, Artificial Sequence
  chemically synthesized
ggggccaggacagtgatggg

SEQ ID NO: 50441 - DNA, 20 bp, Artificial Sequence
  chemically synthesized
ggccaggacagtgatgggag

SEQ ID NO: 50442 - DNA, 20 bp, Artificial Sequence
  chemically synthesized
ggacagtgatgggaggagac

SEQ ID NO: 50443 - DNA, 20 bp, Artificial Sequence
  chemically synthesized
gacagtgatgggaggagaca

SEQ ID NO: 50444 - DNA, 20 bp, Artificial Sequence
  chemically synthesized
agtgatgggaggagacaagg

SEQ ID NO: 50445 - DNA, 20 bp, Artificial Sequence
  chemically synthesized
gggaggagacaaggcggata

SEQ ID NO: 50446 - DNA, 20 bp, Artificial Sequence
  chemically synthesized
gaggagacaaggcggataca

SEQ ID NO: 50447 - DNA, 20 bp, Artificial Sequence
  chemically synthesized
aggagacaaggcggatacag

SEQ ID NO: 50448 - DNA, 20 bp, Artificial Sequence
  chemically synthesized
gagacaaggcggatacagag

SEQ ID NO: 50449 - DNA, 20 bp, Artificial Sequence
  chemically synthesized
acaaggcggatacagaggag

SEQ ID NO: 50450 - DNA, 20 bp, Artificial Sequence
  chemically synthesized
gaggagcagattgtcatctc

SEQ ID NO: 50451 - DNA, 20 bp, Artificial Sequence
  chemically synthesized
agcagattgtcatctccagc

SEQ ID NO: 50452 - DNA, 20 bp, Artificial Sequence
  chemically synthesized
gcagattgtcatctccagct

SEQ ID NO: 50453 - DNA, 20 bp, Artificial Sequence
  chemically synthesized
agattgtcatctccagctgg

SEQ ID NO: 50454 - DNA, 20 bp, Artificial Sequence
  chemically synthesized
gattgtcatctccagctggg

SEQ ID NO: 50455 - DNA, 20 bp, Artificial Sequence
  chemically synthesized
catctccagctgggaggtga

SEQ ID NO: 50456 - DNA, 20 bp, Artificial Sequence
  chemically synthesized
tggccatgcctgcacccctc

SEQ ID NO: 50457 - DNA, 20 bp, Artificial Sequence
  chemically synthesized
catgcctgcacccctctggc

SEQ ID NO: 50458 - DNA, 20 bp, Artificial Sequence
  chemically synthesized
gcctgcacccctctggccag

SEQ ID NO: 50459 - DNA, 20 bp, Artificial Sequence
  chemically synthesized
ctgcacccctctggccagca

SEQ ID NO: 50460 - DNA, 20 bp, Artificial Sequence
  chemically synthesized
tgcacccctctggccagcag

SEQ ID NO: 50461 - DNA, 20 bp, Artificial Sequence
  chemically synthesized
gcacccctctggccagcaga

SEQ ID NO: 50462 - DNA, 20 bp, Artificial Sequence
  chemically synthesized
cccctctggccagcagaggg

SEQ ID NO: 50463 - DNA, 20 bp, Artificial Sequence
  chemically synthesized
tctggccagcagagggtggt

SEQ ID NO: 50464 - DNA, 20 bp, Artificial Sequence
  chemically synthesized
ggccagcagagggtggtcag

SEQ ID NO: 50465 - DNA, 20 bp, Artificial Sequence
  chemically synthesized
gccagcagagggtggtcagt

SEQ ID NO: 50466 - DNA, 20 bp, Artificial Sequence
  chemically synthesized
gagggtggtcagtaggaaac

SEQ ID NO: 50467 - DNA, 20 bp, Artificial Sequence
  chemically synthesized
agggtggtcagtaggaaact

SEQ ID NO: 50468 - DNA, 20 bp, Artificial Sequence
  chemically synthesized
ggtggtcagtaggaaactgg

SEQ ID NO: 50469 - DNA, 20 bp, Artificial Sequence
  chemically synthesized
gtggtcagtaggaaactggg

SEQ ID NO: 50470 - DNA, 20 bp, Artificial Sequence
  chemically synthesized
gtaggaaactgggaggccat

SEQ ID NO: 50471 - DNA, 20 bp, Artificial Sequence
  chemically synthesized
taggaaactgggaggccatt

SEQ ID NO: 50472 - DNA, 20 bp, Artificial Sequence
  chemically synthesized
aggaaactgggaggccatta

SEQ ID NO: 50473 - DNA, 20 bp, Artificial Sequence
  chemically synthesized
ccattagggcaaccttctat

SEQ ID NO: 50474 - DNA, 20 bp, Artificial Sequence
  chemically synthesized
agggcaaccttctattggct

SEQ ID NO: 50475 - DNA, 20 bp, Artificial Sequence
  chemically synthesized
accttctattggctcagact

SEQ ID NO: 50476 - DNA, 20 bp, Artificial Sequence
  chemically synthesized
attggctcagactcagaatg

SEQ ID NO: 50477 - DNA, 20 bp, Artificial Sequence
  chemically synthesized
ggctcagactcagaatgcag

SEQ ID NO: 50478 - DNA, 20 bp, Artificial Sequence
  chemically synthesized
gcagtagaacttgtgccctg

SEQ ID NO: 50479 - DNA, 20 bp, Artificial Sequence
  chemically synthesized
cttgtgccctgtagtgttca

SEQ ID NO: 50480 - DNA, 20 bp, Artificial Sequence
  chemically synthesized
tgccctgtagtgttcatgga

SEQ ID NO: 50481 - DNA, 20 bp, Artificial Sequence
  chemically synthesized
gccctgtagtgttcatggac

SEQ ID NO: 50482 - DNA, 20 bp, Artificial Sequence
  chemically synthesized
cctgtagtgttcatggacag

SEQ ID NO: 50483 - DNA, 20 bp, Artificial Sequence
  chemically synthesized
tagtgttcatggacaggagt

SEQ ID NO: 50484 - DNA, 20 bp, Artificial Sequence
  chemically synthesized
gtgttcatggacaggagtga

SEQ ID NO: 50485 - DNA, 20 bp, Artificial Sequence
  chemically synthesized
tgttcatggacaggagtgag

SEQ ID NO: 50486 - DNA, 20 bp, Artificial Sequence
  chemically synthesized
ttcatggacaggagtgagag

SEQ ID NO: 50487 - DNA, 20 bp, Artificial Sequence
  chemically synthesized
tcatggacaggagtgagagg

SEQ ID NO: 50488 - DNA, 20 bp, Artificial Sequence
  chemically synthesized
ggacaggagtgagaggagga

SEQ ID NO: 50489 - DNA, 20 bp, Artificial Sequence
  chemically synthesized
gacaggagtgagaggaggac

SEQ ID NO: 50490 - DNA, 20 bp, Artificial Sequence
  chemically synthesized
agtgagaggaggacaggact

SEQ ID NO: 50491 - DNA, 20 bp, Artificial Sequence
  chemically synthesized
gtgagaggaggacaggactg

SEQ ID NO: 50492 - DNA, 20 bp, Artificial Sequence
  chemically synthesized
tgagaggaggacaggactga

SEQ ID NO: 50493 - DNA, 20 bp, Artificial Sequence
  chemically synthesized
gagaggaggacaggactgag

SEQ ID NO: 50494 - DNA, 20 bp, Artificial Sequence
  chemically synthesized
aggacaggactgaggggatg

SEQ ID NO: 50495 - DNA, 20 bp, Artificial Sequence
  chemically synthesized
actgaggggatgtggctgtc

SEQ ID NO: 50496 - DNA, 20 bp, Artificial Sequence
  chemically synthesized
ctgaggggatgtggctgtca

SEQ ID NO: 50497 - DNA, 20 bp, Artificial Sequence
  chemically synthesized
tgtggctgtcaaggcctttc

SEQ ID NO: 50498 - DNA, 20 bp, Artificial Sequence
  chemically synthesized
gtggctgtcaaggcctttct

SEQ ID NO: 50499 - DNA, 20 bp, Artificial Sequence
  chemically synthesized
tggctgtcaaggcctttcta

SEQ ID NO: 50500 - DNA, 20 bp, Artificial Sequence
  chemically synthesized
ggctgtcaaggcctttctag

SEQ ID NO: 50501 - DNA, 20 bp, Artificial Sequence
  chemically synthesized
gggcgatgctgtctctccct

SEQ ID NO: 50502 - DNA, 20 bp, Artificial Sequence
  chemically synthesized
atgctgtctctccctcagca

SEQ ID NO: 50503 - DNA, 20 bp, Artificial Sequence
  chemically synthesized
tgctgtctctccctcagcat

SEQ ID NO: 50504 - DNA, 20 bp, Artificial Sequence
  chemically synthesized
gctgtctctccctcagcata

SEQ ID NO: 50505 - DNA, 20 bp, Artificial Sequence
  chemically synthesized
tgtctctccctcagcatagg

SEQ ID NO: 50506 - DNA, 20 bp, Artificial Sequence
  chemically synthesized
ctctccctcagcatagggag

SEQ ID NO: 50507 - DNA, 20 bp, Artificial Sequence
  chemically synthesized
tctccctcagcatagggagt

SEQ ID NO: 50508 - DNA, 20 bp, Artificial Sequence
  chemically synthesized
ggagtgggcccttccacctc

SEQ ID NO: 50509 - DNA, 20 bp, Artificial Sequence
  chemically synthesized
cacctctggcctctctcccc

SEQ ID NO: 50510 - DNA, 20 bp, Artificial Sequence
  chemically synthesized
acctctggcctctctccccc

SEQ ID NO: 50511 - DNA, 20 bp, Artificial Sequence
  chemically synthesized
cctctggcctctctccccca

SEQ ID NO: 50512 - DNA, 20 bp, Artificial Sequence
  chemically synthesized
ctctcccccagggctgtgtc

SEQ ID NO: 50513 - DNA, 20 bp, Artificial Sequence
  chemically synthesized
gctgtccctgataaaactgt

SEQ ID NO: 50514 - DNA, 20 bp, Artificial Sequence
  chemically synthesized
tccctgataaaactgtgaga

SEQ ID NO: 50515 - DNA, 20 bp, Artificial Sequence
  chemically synthesized
taaaactgtgagatggtgtg

SEQ ID NO: 50516 - DNA, 20 bp, Artificial Sequence
  chemically synthesized
tgtgagatggtgtgcagtgt

SEQ ID NO: 50517 - DNA, 20 bp, Artificial Sequence
  chemically synthesized
tgagatggtgtgcagtgtcg

SEQ ID NO: 50518 - DNA, 20 bp, Artificial Sequence
  chemically synthesized
ggtgtgcagtgtcggagcat

SEQ ID NO: 50519 - DNA, 20 bp, Artificial Sequence
  chemically synthesized
gtgtgcagtgtcggagcatg

SEQ ID NO: 50520 - DNA, 20 bp, Artificial Sequence
  chemically synthesized
tgtcggagcatgaggccact

SEQ ID NO: 50521 - DNA, 20 bp, Artificial Sequence
  chemically synthesized
agcatgaggccactaagtgc

SEQ ID NO: 50522 - DNA, 20 bp, Artificial Sequence
  chemically synthesized
catgaggccactaagtgcca

SEQ ID NO: 50523 - DNA, 20 bp, Artificial Sequence
  chemically synthesized
agtttccgcgaccatatgaa

SEQ ID NO: 50524 - DNA, 20 bp, Artificial Sequence
  chemically synthesized
aaaagcgtcattccatccga

SEQ ID NO: 50525 - DNA, 20 bp, Artificial Sequence
  chemically synthesized
gtcattccatccgatggtcc

SEQ ID NO: 50526 - DNA, 20 bp, Artificial Sequence
  chemically synthesized
gtcccagtgttgcttgtgtg

SEQ ID NO: 50527 - DNA, 20 bp, Artificial Sequence
  chemically synthesized
cagtgttgcttgtgtgaaga

SEQ ID NO: 50528 - DNA, 20 bp, Artificial Sequence
  chemically synthesized
gcctcctaccttgattgcat

SEQ ID NO: 50529 - DNA, 20 bp, Artificial Sequence
  chemically synthesized
cctcctaccttgattgcatc

SEQ ID NO: 50530 - DNA, 20 bp, Artificial Sequence
  chemically synthesized
ctcctaccttgattgcatca

SEQ ID NO: 50531 - DNA, 20 bp, Artificial Sequence
  chemically synthesized
gcaatggccctgatgcaatc

SEQ ID NO: 50532 - DNA, 20 bp, Artificial Sequence
  chemically synthesized
caatggccctgatgcaatca

SEQ ID NO: 50533 - DNA, 20 bp, Artificial Sequence
  chemically synthesized
tggccctgatgcaatcaagg

SEQ ID NO: 50534 - DNA, 20 bp, Artificial Sequence
  chemically synthesized
ggccctgatgcaatcaaggt

SEQ ID NO: 50535 - DNA, 20 bp, Artificial Sequence
  chemically synthesized
ccctgatgcaatcaaggtag

SEQ ID NO: 50536 - DNA, 20 bp, Artificial Sequence
  chemically synthesized
cctgatgcaatcaaggtagg

SEQ ID NO: 50537 - DNA, 20 bp, Artificial Sequence
  chemically synthesized
gtaggaggctttcttcacac

SEQ ID NO: 50538 - DNA, 20 bp, Artificial Sequence
  chemically synthesized
tttcttcacacaagcaacac

SEQ ID NO: 50539 - DNA, 20 bp, Artificial Sequence
  chemically synthesized
ttcttcacacaagcaacact

SEQ ID NO: 50540 - DNA, 20 bp, Artificial Sequence
  chemically synthesized
acaagcaacactgggaccat

SEQ ID NO: 50541 - DNA, 20 bp, Artificial Sequence
  chemically synthesized
gcaacactgggaccatcgga

SEQ ID NO: 50542 - DNA, 20 bp, Artificial Sequence
  chemically synthesized
atggaatgacgcttttcata

SEQ ID NO: 50543 - DNA, 20 bp, Artificial Sequence
  chemically synthesized
tgacgcttttcatatggtcg

SEQ ID NO: 50544 - DNA, 20 bp, Artificial Sequence
  chemically synthesized
tcatatggtcgcggaaactc

SEQ ID NO: 50545 - DNA, 20 bp, Artificial Sequence
  chemically synthesized
gtcgcggaaactctggcact

SEQ ID NO: 50546 - DNA, 20 bp, Artificial Sequence
  chemically synthesized
gcggaaactctggcacttag

SEQ ID NO: 50547 - DNA, 20 bp, Artificial Sequence
  chemically synthesized
cgacactgcacaccatctca

SEQ ID NO: 50548 - DNA, 20 bp, Artificial Sequence
  chemically synthesized
acaccatctcacagttttat

SEQ ID NO: 50549 - DNA, 20 bp, Artificial Sequence
  chemically synthesized
caccatctcacagttttatc

SEQ ID NO: 50550 - DNA, 20 bp, Artificial Sequence
  chemically synthesized
accatctcacagttttatca

SEQ ID NO: 50551 - DNA, 20 bp, Artificial Sequence
  chemically synthesized
tctcacagttttatcaggga

SEQ ID NO: 50552 - DNA, 20 bp, Artificial Sequence
  chemically synthesized
acagttttatcagggacagc

SEQ ID NO: 50553 - DNA, 20 bp, Artificial Sequence
  chemically synthesized
ttatcagggacagccagaca

SEQ ID NO: 50554 - DNA, 20 bp, Artificial Sequence
  chemically synthesized
gggacagccagacacagccc

SEQ ID NO: 50555 - DNA, 20 bp, Artificial Sequence
  chemically synthesized
ggacagccagacacagccct

SEQ ID NO: 50556 - DNA, 20 bp, Artificial Sequence
  chemically synthesized
gacagccagacacagccctg

SEQ ID NO: 50557 - DNA, 20 bp, Artificial Sequence
  chemically synthesized
acagccagacacagccctgg

SEQ ID NO: 50558 - DNA, 20 bp, Artificial Sequence
  chemically synthesized
agccagacacagccctgggg

SEQ ID NO: 50559 - DNA, 20 bp, Artificial Sequence
  chemically synthesized
ccagacacagccctggggga

SEQ ID NO: 50560 - DNA, 20 bp, Artificial Sequence
  chemically synthesized
agacacagccctgggggaga

SEQ ID NO: 50561 - DNA, 20 bp, Artificial Sequence
  chemically synthesized
gacacagccctgggggagag

SEQ ID NO: 50562 - DNA, 20 bp, Artificial Sequence
  chemically synthesized
cagccctgggggagagaggc

SEQ ID NO: 50563 - DNA, 20 bp, Artificial Sequence
  chemically synthesized
gccctgggggagagaggcca

SEQ ID NO: 50564 - DNA, 20 bp, Artificial Sequence
  chemically synthesized
ccctgggggagagaggccag

SEQ ID NO: 50565 - DNA, 20 bp, Artificial Sequence
  chemically synthesized
tgggggagagaggccagagg

SEQ ID NO: 50566 - DNA, 20 bp, Artificial Sequence
  chemically synthesized
gggagagaggccagaggtgg

SEQ ID NO: 50567 - DNA, 20 bp, Artificial Sequence
  chemically synthesized
ggagagaggccagaggtgga

SEQ ID NO: 50568 - DNA, 20 bp, Artificial Sequence
  chemically synthesized
gagagaggccagaggtggaa

SEQ ID NO: 50569 - DNA, 20 bp, Artificial Sequence
  chemically synthesized
aagggcccactccctatgct

SEQ ID NO: 50570 - DNA, 20 bp, Artificial Sequence
  chemically synthesized
agggcccactccctatgctg

SEQ ID NO: 50571 - DNA, 20 bp, Artificial Sequence
  chemically synthesized
gggcccactccctatgctga

SEQ ID NO: 50572 - DNA, 20 bp, Artificial Sequence
  chemically synthesized
gcccactccctatgctgagg

SEQ ID NO: 50573 - DNA, 20 bp, Artificial Sequence
  chemically synthesized
ccactccctatgctgaggga

SEQ ID NO: 50574 - DNA, 20 bp, Artificial Sequence
  chemically synthesized
tccctatgctgagggagaga

SEQ ID NO: 50575 - DNA, 20 bp, Artificial Sequence
  chemically synthesized
gggagagacagcatcgcccc

SEQ ID NO: 50576 - DNA, 20 bp, Artificial Sequence
  chemically synthesized
gagacagcatcgcccctaga

SEQ ID NO: 50577 - DNA, 20 bp, Artificial Sequence
  chemically synthesized
agacagcatcgcccctagaa

SEQ ID NO: 50578 - DNA, 20 bp, Artificial Sequence
  chemically synthesized
cgcccctagaaaggccttga

SEQ ID NO: 50579 - DNA, 20 bp, Artificial Sequence
  chemically synthesized
ccttgacagccacatcccct

SEQ ID NO: 50580 - DNA, 20 bp, Artificial Sequence
  chemically synthesized
actcctgtccatgaacacta

SEQ ID NO: 50581 - DNA, 20 bp, Artificial Sequence
  chemically synthesized
ctcctgtccatgaacactac

SEQ ID NO: 50582 - DNA, 20 bp, Artificial Sequence
  chemically synthesized
tcctgtccatgaacactaca

SEQ ID NO: 50583 - DNA, 20 bp, Artificial Sequence
  chemically synthesized
ccatgaacactacagggcac

SEQ ID NO: 50584 - DNA, 20 bp, Artificial Sequence
  chemically synthesized
cacaagttctactgcattct

SEQ ID NO: 50585 - DNA, 20 bp, Artificial Sequence
  chemically synthesized
ttctactgcattctgagtct

SEQ ID NO: 50586 - DNA, 20 bp, Artificial Sequence
  chemically synthesized
gcattctgagtctgagccaa

SEQ ID NO: 50587 - DNA, 20 bp, Artificial Sequence
  chemically synthesized
ttctgagtctgagccaatag

SEQ ID NO: 50588 - DNA, 20 bp, Artificial Sequence
  chemically synthesized
tctgagtctgagccaataga

SEQ ID NO: 50589 - DNA, 20 bp, Artificial Sequence
  chemically synthesized
ccaatagaaggttgccctaa

SEQ ID NO: 50590 - DNA, 20 bp, Artificial Sequence
  chemically synthesized
aggttgccctaatggcctcc

SEQ ID NO: 50591 - DNA, 20 bp, Artificial Sequence
  chemically synthesized
tcctactgaccaccctctgc

SEQ ID NO: 50592 - DNA, 20 bp, Artificial Sequence
  chemically synthesized
actgaccaccctctgctggc

SEQ ID NO: 50593 - DNA, 20 bp, Artificial Sequence
  chemically synthesized
tgaccaccctctgctggcca

SEQ ID NO: 50594 - DNA, 20 bp, Artificial Sequence
  chemically synthesized
gaccaccctctgctggccag

SEQ ID NO: 50595 - DNA, 20 bp, Artificial Sequence
  chemically synthesized
accaccctctgctggccaga

SEQ ID NO: 50596 - DNA, 20 bp, Artificial Sequence
  chemically synthesized
ccaccctctgctggccagag

SEQ ID NO: 50597 - DNA, 20 bp, Artificial Sequence
  chemically synthesized
ctctgctggccagaggggtg

SEQ ID NO: 50598 - DNA, 20 bp, Artificial Sequence
  chemically synthesized
tctgctggccagaggggtgc

SEQ ID NO: 50599 - DNA, 20 bp, Artificial Sequence
  chemically synthesized
tggccagaggggtgcaggca

SEQ ID NO: 50600 - DNA, 20 bp, Artificial Sequence
  chemically synthesized
caggcatggccatcacctcc

SEQ ID NO: 50601 - DNA, 20 bp, Artificial Sequence
  chemically synthesized
catggccatcacctcccagc

SEQ ID NO: 50602 - DNA, 20 bp, Artificial Sequence
  chemically synthesized
tggccatcacctcccagctg

SEQ ID NO: 50603 - DNA, 20 bp, Artificial Sequence
  chemically synthesized
gtctcctcccatcactgtcc

SEQ ID NO: 50604 - DNA, 20 bp, Artificial Sequence
  chemically synthesized
cccatcactgtcctggcccc

SEQ ID NO: 50605 - DNA, 20 bp, Artificial Sequence
  chemically synthesized
tcctggcccctggcccccca

SEQ ID NO: 50606 - DNA, 20 bp, Artificial Sequence
  chemically synthesized
cctggccccccatggaacat

SEQ ID NO: 50607 - DNA, 20 bp, Artificial Sequence
  chemically synthesized
cccccatggaacataagcct

SEQ ID NO: 50608 - DNA, 20 bp, Artificial Sequence
  chemically synthesized
aacataagcctcagtatgca

SEQ ID NO: 50609 - DNA, 20 bp, Artificial Sequence
  chemically synthesized
acataagcctcagtatgcac

SEQ ID NO: 50610 - DNA, 20 bp, Artificial Sequence
  chemically synthesized
cataagcctcagtatgcaca

SEQ ID NO: 50611 - DNA, 20 bp, Artificial Sequence
  chemically synthesized
cagtatgcacagggcgtttt

SEQ ID NO: 50612 - DNA, 20 bp, Artificial Sequence
  chemically synthesized
tttcagctaccccaacacat

SEQ ID NO: 50613 - DNA, 20 bp, Artificial Sequence
  chemically synthesized
ttggcttgctacctcaacta

SEQ ID NO: 50614 - DNA, 20 bp, Artificial Sequence
  chemically synthesized
ctacctcaactatggaaaac

SEQ ID NO: 50615 - DNA, 20 bp, Artificial Sequence
  chemically synthesized
cctcaactatggaaaaccag

SEQ ID NO: 50616 - DNA, 20 bp, Artificial Sequence
  chemically synthesized
ctcaactatggaaaaccagc

SEQ ID NO: 50617 - DNA, 20 bp, Artificial Sequence
  chemically synthesized
tcaactatggaaaaccagcg

SEQ ID NO: 50618 - DNA, 20 bp, Artificial Sequence
  chemically synthesized
caactatggaaaaccagcgg

SEQ ID NO: 50619 - DNA, 20 bp, Artificial Sequence
  chemically synthesized
actatggaaaaccagcgggg

SEQ ID NO: 50620 - DNA, 20 bp, Artificial Sequence
  chemically synthesized
ctatggaaaaccagcggggg

SEQ ID NO: 50621 - DNA, 20 bp, Artificial Sequence
  chemically synthesized
ggaggaattgccatcttttt

SEQ ID NO: 50622 - DNA, 20 bp, Artificial Sequence
  chemically synthesized
ggaattgccatctttttgag

SEQ ID NO: 50623 - DNA, 20 bp, Artificial Sequence
  chemically synthesized
aattgccatctttttgagaa

SEQ ID NO: 50624 - DNA, 20 bp, Artificial Sequence
  chemically synthesized
attgccatctttttgagaag

SEQ ID NO: 50625 - DNA, 20 bp, Artificial Sequence
  chemically synthesized
ttgccatctttttgagaaga

SEQ ID NO: 50626 - DNA, 20 bp, Artificial Sequence
  chemically synthesized
gccatctttttgagaagagg

SEQ ID NO: 50627 - DNA, 20 bp, Artificial Sequence
  chemically synthesized
tctttttgagaagagggagt

SEQ ID NO: 50628 - DNA, 20 bp, Artificial Sequence
  chemically synthesized
tgagaagagggagtgagact

SEQ ID NO: 50629 - DNA, 20 bp, Artificial Sequence
  chemically synthesized
agaagagggagtgagactca

SEQ ID NO: 50630 - DNA, 20 bp, Artificial Sequence
  chemically synthesized
cctttttttttttttaaccc

SEQ ID NO: 50631 - DNA, 20 bp, Artificial Sequence
  chemically synthesized
ctttttttttttttaaccca

SEQ ID NO: 50632 - DNA, 20 bp, Artificial Sequence
  chemically synthesized
aaggtcaccctgcttgtcgt

SEQ ID NO: 50633 - DNA, 20 bp, Artificial Sequence
  chemically synthesized
caccctgcttgtcgttggcc

SEQ ID NO: 50634 - DNA, 20 bp, Artificial Sequence
  chemically synthesized
ctgcttgtcgttggccaagc

SEQ ID NO: 50635 - DNA, 20 bp, Artificial Sequence
  chemically synthesized
tgcttgtcgttggccaagcc

SEQ ID NO: 50636 - DNA, 20 bp, Artificial Sequence
  chemically synthesized
gtcgttggccaagccaggcc

SEQ ID NO: 50637 - DNA, 20 bp, Artificial Sequence
  chemically synthesized
gccaagccaggcctagaatc

SEQ ID NO: 50638 - DNA, 20 bp, Artificial Sequence
  chemically synthesized
ccaagccaggcctagaatct

SEQ ID NO: 50639 - DNA, 20 bp, Artificial Sequence
  chemically synthesized
aggcctagaatctgggtctc

SEQ ID NO: 50640 - DNA, 20 bp, Artificial Sequence
  chemically synthesized
gaatctgggtctccagactc

SEQ ID NO: 50641 - DNA, 20 bp, Artificial Sequence
  chemically synthesized
aatctgggtctccagactct

SEQ ID NO: 50642 - DNA, 20 bp, Artificial Sequence
  chemically synthesized
cagactctgggtctgctact

SEQ ID NO: 50643 - DNA, 20 bp, Artificial Sequence
  chemically synthesized
agactctgggtctgctactc

SEQ ID NO: 50644 - DNA, 20 bp, Artificial Sequence
  chemically synthesized
gactctgggtctgctactca

SEQ ID NO: 50645 - DNA, 20 bp, Artificial Sequence
  chemically synthesized
gtctgctactcagggcacaa

SEQ ID NO: 50646 - DNA, 20 bp, Artificial Sequence
  chemically synthesized
tgctactcagggcacaaaag

SEQ ID NO: 50647 - DNA, 20 bp, Artificial Sequence
  chemically synthesized
acaaaagaagaaaacattct

SEQ ID NO: 50648 - DNA, 20 bp, Artificial Sequence
  chemically synthesized
ttctgagttacaccccttct

SEQ ID NO: 50649 - DNA, 20 bp, Artificial Sequence
  chemically synthesized
gagttacaccccttcttggc

SEQ ID NO: 50650 - DNA, 20 bp, Artificial Sequence
  chemically synthesized
ttacaccccttcttggccag

SEQ ID NO: 50651 - DNA, 20 bp, Artificial Sequence
  chemically synthesized
ccccttcttggccagtagtt

SEQ ID NO: 50652 - DNA, 20 bp, Artificial Sequence
  chemically synthesized
cccttcttggccagtagttg

SEQ ID NO: 50653 - DNA, 20 bp, Artificial Sequence
  chemically synthesized
ccttcttggccagtagttga

SEQ ID NO: 50654 - DNA, 20 bp, Artificial Sequence
  chemically synthesized
gttgagggtaaattaacgaa

SEQ ID NO: 50655 - DNA, 20 bp, Artificial Sequence
  chemically synthesized
cttgtctgttgctctctgtt

SEQ ID NO: 50656 - DNA, 20 bp, Artificial Sequence
  chemically synthesized
ttgtctgttgctctctgttt

SEQ ID NO: 50657 - DNA, 20 bp, Artificial Sequence
  chemically synthesized
tctgttgctctctgtttagg

SEQ ID NO: 50658 - DNA, 20 bp, Artificial Sequence
  chemically synthesized
taaaaactccacaaattcaa

SEQ ID NO: 50659 - DNA, 20 bp, Artificial Sequence
  chemically synthesized
tccattttcaccacactttt

SEQ ID NO: 50660 - DNA, 20 bp, Artificial Sequence
  chemically synthesized
ttggctgccattcacaaaaa

SEQ ID NO: 50661 - DNA, 20 bp, Artificial Sequence
  chemically synthesized
gccattcacaaaaaaagctg

SEQ ID NO: 50662 - DNA, 20 bp, Artificial Sequence
  chemically synthesized
ttcacaaaaaaagctgaagc

SEQ ID NO: 50663 - DNA, 20 bp, Artificial Sequence
  chemically synthesized
aaaaaagctgaagccagcca

SEQ ID NO: 50664 - DNA, 20 bp, Artificial Sequence
  chemically synthesized
aaaaagctgaagccagccat

SEQ ID NO: 50665 - DNA, 20 bp, Artificial Sequence
  chemically synthesized
ggtaactattaaaatccatg

SEQ ID NO: 50666 - DNA, 20 bp, Artificial Sequence
  chemically synthesized
tattaaaatccatgtggttg

SEQ ID NO: 50667 - DNA, 20 bp, Artificial Sequence
  chemically synthesized
ttaaaatccatgtggttgca

SEQ ID NO: 50668 - DNA, 20 bp, Artificial Sequence
  chemically synthesized
aatccatgtggttgcagaga

SEQ ID NO: 50669 - DNA, 20 bp, Artificial Sequence
  chemically synthesized
agacagcatccctatcacat

SEQ ID NO: 50670 - DNA, 20 bp, Artificial Sequence
  chemically synthesized
tgagcttttgccctgtcccc

SEQ ID NO: 50671 - DNA, 20 bp, Artificial Sequence
  chemically synthesized
gagcttttgccctgtcccca

SEQ ID NO: 50672 - DNA, 20 bp, Artificial Sequence
  chemically synthesized
tctgtcatctccactccttg

SEQ ID NO: 50673 - DNA, 20 bp, Artificial Sequence
  chemically synthesized
ctgtcatctccactccttgt

SEQ ID NO: 50674 - DNA, 20 bp, Artificial Sequence
  chemically synthesized
ccactccttgtgggccacca

SEQ ID NO: 50675 - DNA, 20 bp, Artificial Sequence
  chemically synthesized
tccttgtgggccaccacagc

SEQ ID NO: 50676 - DNA, 20 bp, Artificial Sequence
  chemically synthesized
ccttgtgggccaccacagca

SEQ ID NO: 50677 - DNA, 20 bp, Artificial Sequence
  chemically synthesized
ccacagcaaggctgactcac

SEQ ID NO: 50678 - DNA, 20 bp, Artificial Sequence
  chemically synthesized
aggctgactcactggctctg

SEQ ID NO: 50679 - DNA, 20 bp, Artificial Sequence
  chemically synthesized
ctgactcactggctctgaag

SEQ ID NO: 50680 - DNA, 20 bp, Artificial Sequence
  chemically synthesized
ggctctgaagaagatccaca

SEQ ID NO: 50681 - DNA, 20 bp, Artificial Sequence
  chemically synthesized
aagaagatccacaaagcctg

SEQ ID NO: 50682 - DNA, 20 bp, Artificial Sequence
  chemically synthesized
gaagatccacaaagcctgtg

SEQ ID NO: 50683 - DNA, 20 bp, Artificial Sequence
  chemically synthesized
agatccacaaagcctgtgga

SEQ ID NO: 50684 - DNA, 20 bp, Artificial Sequence
  chemically synthesized
gatccacaaagcctgtggag

SEQ ID NO: 50685 - DNA, 20 bp, Artificial Sequence
  chemically synthesized
tccacaaagcctgtggagag

SEQ ID NO: 50686 - DNA, 20 bp, Artificial Sequence
  chemically synthesized
ccacaaagcctgtggagagg

SEQ ID NO: 50687 - DNA, 20 bp, Artificial Sequence
  chemically synthesized
gcctgtggagaggaggccca

SEQ ID NO: 50688 - DNA, 20 bp, Artificial Sequence
  chemically synthesized
agaggaggcccacagctctc

SEQ ID NO: 50689 - DNA, 20 bp, Artificial Sequence
  chemically synthesized
gaggaggcccacagctctcc

SEQ ID NO: 50690 - DNA, 20 bp, Artificial Sequence
  chemically synthesized
cacagctctccaggatgcat

SEQ ID NO: 50691 - DNA, 20 bp, Artificial Sequence
  chemically synthesized
acagctctccaggatgcatg

SEQ ID NO: 50692 - DNA, 20 bp, Artificial Sequence
  chemically synthesized
agctctccaggatgcatgag

SEQ ID NO: 50693 - DNA, 20 bp, Artificial Sequence
  chemically synthesized
gctctccaggatgcatgagg

SEQ ID NO: 50694 - DNA, 20 bp, Artificial Sequence
  chemically synthesized
ctctccaggatgcatgagga

SEQ ID NO: 50695 - DNA, 20 bp, Artificial Sequence
  chemically synthesized
tctccaggatgcatgaggag

SEQ ID NO: 50696 - DNA, 20 bp, Artificial Sequence
  chemically synthesized
gatgcatgaggaggggccac

SEQ ID NO: 50697 - DNA, 20 bp, Artificial Sequence
  chemically synthesized
atgcatgaggaggggccacc

SEQ ID NO: 50698 - DNA, 20 bp, Artificial Sequence
  chemically synthesized
tgcatgaggaggggccacca

SEQ ID NO: 50699 - DNA, 20 bp, Artificial Sequence
  chemically synthesized
tgaggaggggccaccaggga

SEQ ID NO: 50700 - DNA, 20 bp, Artificial Sequence
  chemically synthesized
gccaccagggatggccaccc

SEQ ID NO: 50701 - DNA, 20 bp, Artificial Sequence
  chemically synthesized
gcgacccccattttccctct

SEQ ID NO: 50702 - DNA, 20 bp, Artificial Sequence
  chemically synthesized
ccattttccctcttggccca

SEQ ID NO: 50703 - DNA, 20 bp, Artificial Sequence
  chemically synthesized
cattttccctcttggcccat

SEQ ID NO: 50704 - DNA, 20 bp, Artificial Sequence
  chemically synthesized
tcttggcccatgggaaatcc

SEQ ID NO: 50705 - DNA, 20 bp, Artificial Sequence
  chemically synthesized
cttggcccatgggaaatcct

SEQ ID NO: 50706 - DNA, 20 bp, Artificial Sequence
  chemically synthesized
tggcccatgggaaatcctag

SEQ ID NO: 50707 - DNA, 20 bp, Artificial Sequence
  chemically synthesized
ggcccatgggaaatcctagg

SEQ ID NO: 50708 - DNA, 20 bp, Artificial Sequence
  chemically synthesized
gaaatcctaggaggcaacat

SEQ ID NO: 50709 - DNA, 20 bp, Artificial Sequence
  chemically synthesized
taggaggcaacataagcctg

SEQ ID NO: 50710 - DNA, 20 bp, Artificial Sequence
  chemically synthesized
gaggcaacataagcctgtgg

SEQ ID NO: 50711 - DNA, 20 bp, Artificial Sequence
  chemically synthesized
cctgtggcagcccctccaca

SEQ ID NO: 50712 - DNA, 20 bp, Artificial Sequence
  chemically synthesized
cctccacaaagccctgcctc

SEQ ID NO: 50713 - DNA, 20 bp, Artificial Sequence
  chemically synthesized
tccacaaagccctgcctcca

SEQ ID NO: 50714 - DNA, 20 bp, Artificial Sequence
  chemically synthesized
ccctgcctccagagttccca

SEQ ID NO: 50715 - DNA, 20 bp, Artificial Sequence
  chemically synthesized
cctgcctccagagttcccat

SEQ ID NO: 50716 - DNA, 20 bp, Artificial Sequence
  chemically synthesized
cctccagagttcccataggc

SEQ ID NO: 50717 - DNA, 20 bp, Artificial Sequence
  chemically synthesized
cataggcgagaatgtgtcct

SEQ ID NO: 50718 - DNA, 20 bp, Artificial Sequence
  chemically synthesized
aggcgagaatgtgtcctcag

SEQ ID NO: 50719 - DNA, 20 bp, Artificial Sequence
  chemically synthesized
gcgagaatgtgtcctcagtg

SEQ ID NO: 50720 - DNA, 20 bp, Artificial Sequence
  chemically synthesized
cagtggagcattaccttgca

SEQ ID NO: 50721 - DNA, 20 bp, Artificial Sequence
  chemically synthesized
attaccttgcacagcctgtg

SEQ ID NO: 50722 - DNA, 20 bp, Artificial Sequence
  chemically synthesized
agcctgtgaagtgctctgtg

SEQ ID NO: 50723 - DNA, 20 bp, Artificial Sequence
  chemically synthesized
gcctgtgaagtgctctgtgc

SEQ ID NO: 50724 - DNA, 20 bp, Artificial Sequence
  chemically synthesized
cctgtgaagtgctctgtgcg

SEQ ID NO: 50725 - DNA, 20 bp, Artificial Sequence
  chemically synthesized
aagtgctctgtgcggggata

SEQ ID NO: 50726 - DNA, 20 bp, Artificial Sequence
  chemically synthesized
agtgctctgtgcggggataa

SEQ ID NO: 50727 - DNA, 20 bp, Artificial Sequence
  chemically synthesized
ctctgtgcggggataaaggc

SEQ ID NO: 50728 - DNA, 20 bp, Artificial Sequence
  chemically synthesized
ggggataaaggcaagtaacg

SEQ ID NO: 50729 - DNA, 20 bp, Artificial Sequence
  chemically synthesized
gggataaaggcaagtaacgt

SEQ ID NO: 50730 - DNA, 20 bp, Artificial Sequence
  chemically synthesized
ggataaaggcaagtaacgtg

SEQ ID NO: 50731 - DNA, 20 bp, Artificial Sequence
  chemically synthesized
gtaacgtggggtcctctctc

SEQ ID NO: 50732 - DNA, 20 bp, Artificial Sequence
  chemically synthesized
taacgtggggtcctctctca

SEQ ID NO: 50733 - DNA, 20 bp, Artificial Sequence
  chemically synthesized
gtcctctctcaaggaattgc

SEQ ID NO: 50734 - DNA, 20 bp, Artificial Sequence
  chemically synthesized
ctcaaggaattgctagctta

SEQ ID NO: 50735 - DNA, 20 bp, Artificial Sequence
  chemically synthesized
tcaaggaattgctagcttat

SEQ ID NO: 50736 - DNA, 20 bp, Artificial Sequence
  chemically synthesized
caaggaattgctagcttatg

SEQ ID NO: 50737 - DNA, 20 bp, Artificial Sequence
  chemically synthesized
aggaattgctagcttatggg

SEQ ID NO: 50738 - DNA, 20 bp, Artificial Sequence
  chemically synthesized
gaattgctagcttatgggga

SEQ ID NO: 50739 - DNA, 20 bp, Artificial Sequence
  chemically synthesized
tggggagagaaaactaaacg

SEQ ID NO: 50740 - DNA, 20 bp, Artificial Sequence
  chemically synthesized
ggagagaaaactaaacgtgg

SEQ ID NO: 50741 - DNA, 20 bp, Artificial Sequence
  chemically synthesized
actaaacgtggaagccccaa

SEQ ID NO: 50742 - DNA, 20 bp, Artificial Sequence
  chemically synthesized
tgtgacaaatgccccatgaa

SEQ ID NO: 50743 - DNA, 20 bp, Artificial Sequence
  chemically synthesized
gacaaatgccccatgaatgg

SEQ ID NO: 50744 - DNA, 20 bp, Artificial Sequence
  chemically synthesized
acaaatgccccatgaatggc

SEQ ID NO: 50745 - DNA, 20 bp, Artificial Sequence
  chemically synthesized
aatgccccatgaatggcagg

SEQ ID NO: 50746 - DNA, 20 bp, Artificial Sequence
  chemically synthesized
gccccatgaatggcaggcag

SEQ ID NO: 50747 - DNA, 20 bp, Artificial Sequence
  chemically synthesized
catgaatggcaggcagaagt

SEQ ID NO: 50748 - DNA, 20 bp, Artificial Sequence
  chemically synthesized
tgaatggcaggcagaagtta

SEQ ID NO: 50749 - DNA, 20 bp, Artificial Sequence
  chemically synthesized
caggcagaagttagagtatg

SEQ ID NO: 50750 - DNA, 20 bp, Artificial Sequence
  chemically synthesized
aggcagaagttagagtatga

SEQ ID NO: 50751 - DNA, 20 bp, Artificial Sequence
  chemically synthesized
ggcagaagttagagtatgaa

SEQ ID NO: 50752 - DNA, 20 bp, Artificial Sequence
  chemically synthesized
gcagaagttagagtatgaag

SEQ ID NO: 50753 - DNA, 20 bp, Artificial Sequence
  chemically synthesized
cagaagttagagtatgaagg

SEQ ID NO: 50754 - DNA, 20 bp, Artificial Sequence
  chemically synthesized
gtatgaagggggccccacct

SEQ ID NO: 50755 - DNA, 20 bp, Artificial Sequence
  chemically synthesized
tatgaagggggccccacctc

SEQ ID NO: 50756 - DNA, 20 bp, Artificial Sequence
  chemically synthesized
tgaagggggccccacctcag

SEQ ID NO: 50757 - DNA, 20 bp, Artificial Sequence
  chemically synthesized
gaagggggccccacctcagg

SEQ ID NO: 50758 - DNA, 20 bp, Artificial Sequence
  chemically synthesized
ggggccccacctcaggaggt

SEQ ID NO: 50759 - DNA, 20 bp, Artificial Sequence
  chemically synthesized
gggccccacctcaggaggtc

SEQ ID NO: 50760 - DNA, 20 bp, Artificial Sequence
  chemically synthesized
ggccccacctcaggaggtcg

SEQ ID NO: 50761 - DNA, 20 bp, Artificial Sequence
  chemically synthesized
ccccacctcaggaggtcggg

SEQ ID NO: 50762 - DNA, 20 bp, Artificial Sequence
  chemically synthesized
cctcaggaggtcggggagtg

SEQ ID NO: 50763 - DNA, 20 bp, Artificial Sequence
  chemically synthesized
gaggtcggggagtgtggcgt

SEQ ID NO: 50764 - DNA, 20 bp, Artificial Sequence
  chemically synthesized
tggcgtcagccactgcccca

SEQ ID NO: 50765 - DNA, 20 bp, Artificial Sequence
  chemically synthesized
cgtcagccactgccccatag

SEQ ID NO: 50766 - DNA, 20 bp, Artificial Sequence
  chemically synthesized
gtcagccactgccccatagc

SEQ ID NO: 50767 - DNA, 20 bp, Artificial Sequence
  chemically synthesized
atgtgtgcaacatctgccac

SEQ ID NO: 50768 - DNA, 20 bp, Artificial Sequence
  chemically synthesized
caacatctgccactggtact

SEQ ID NO: 50769 - DNA, 20 bp, Artificial Sequence
  chemically synthesized
tgaccctcatttgaccctcc

SEQ ID NO: 50770 - DNA, 20 bp, Artificial Sequence
  chemically synthesized
gaccctcatttgaccctccc

SEQ ID NO: 50771 - DNA, 20 bp, Artificial Sequence
  chemically synthesized
ctcatttgaccctcccaggc

SEQ ID NO: 50772 - DNA, 20 bp, Artificial Sequence
  chemically synthesized
tgctgtgatgaccccctccc

SEQ ID NO: 50773 - DNA, 20 bp, Artificial Sequence
  chemically synthesized
gtgatgaccccctccctggt

SEQ ID NO: 50774 - DNA, 20 bp, Artificial Sequence
  chemically synthesized
tgatgaccccctccctggtg

SEQ ID NO: 50775 - DNA, 20 bp, Artificial Sequence
  chemically synthesized
atgaccccctccctggtgag

SEQ ID NO: 50776 - DNA, 20 bp, Artificial Sequence
  chemically synthesized
ccccctccctggtgaggagc

SEQ ID NO: 50777 - DNA, 20 bp, Artificial Sequence
  chemically synthesized
ctccctggtgaggagccggc

SEQ ID NO: 50778 - DNA, 20 bp, Artificial Sequence
  chemically synthesized
tccctggtgaggagccggcc

SEQ ID NO: 50779 - DNA, 20 bp, Artificial Sequence
  chemically synthesized
gtgaggagccggccaggact

SEQ ID NO: 50780 - DNA, 20 bp, Artificial Sequence
  chemically synthesized
gccggccaggacttggatcc

SEQ ID NO: 50781 - DNA, 20 bp, Artificial Sequence
  chemically synthesized
ggccaggacttggatccaag

SEQ ID NO: 50782 - DNA, 20 bp, Artificial Sequence
  chemically synthesized
ggacttggatccaagaagtc

SEQ ID NO: 50783 - DNA, 20 bp, Artificial Sequence
  chemically synthesized
cccatgctctgaccgctcga

SEQ ID NO: 50784 - DNA, 20 bp, Artificial Sequence
  chemically synthesized
gctcgatggcaccgcttcct

SEQ ID NO: 50785 - DNA, 20 bp, Artificial Sequence
  chemically synthesized
cgatggcaccgcttccttgg

SEQ ID NO: 50786 - DNA, 20 bp, Artificial Sequence
  chemically synthesized
gatggcaccgcttccttggc

SEQ ID NO: 50787 - DNA, 20 bp, Artificial Sequence
  chemically synthesized
cttccttggcaggacatcta

SEQ ID NO: 50788 - DNA, 20 bp, Artificial Sequence
  chemically synthesized
ggcaggacatctacagctcc

SEQ ID NO: 50789 - DNA, 20 bp, Artificial Sequence
  chemically synthesized
gcaggacatctacagctccc

SEQ ID NO: 50790 - DNA, 20 bp, Artificial Sequence
  chemically synthesized
caggacatctacagctccca

SEQ ID NO: 50791 - DNA, 20 bp, Artificial Sequence
  chemically synthesized
tctacagctcccagggcacc

SEQ ID NO: 50792 - DNA, 20 bp, Artificial Sequence
  chemically synthesized
ctacagctcccagggcaccc

SEQ ID NO: 50793 - DNA, 20 bp, Artificial Sequence
  chemically synthesized
tacagctcccagggcaccca

SEQ ID NO: 50794 - DNA, 20 bp, Artificial Sequence
  chemically synthesized
acagctcccagggcacccag

SEQ ID NO: 50795 - DNA, 20 bp, Artificial Sequence
  chemically synthesized
ccagggcacccaggggacat

SEQ ID NO: 50796 - DNA, 20 bp, Artificial Sequence
  chemically synthesized
caggggacatcagcctctga

SEQ ID NO: 50797 - DNA, 20 bp, Artificial Sequence
  chemically synthesized
aggggacatcagcctctgaa

SEQ ID NO: 50798 - DNA, 20 bp, Artificial Sequence
  chemically synthesized
ggggacatcagcctctgaaa

SEQ ID NO: 50799 - DNA, 20 bp, Artificial Sequence
  chemically synthesized
gggacatcagcctctgaaag

SEQ ID NO: 50800 - DNA, 20 bp, Artificial Sequence
  chemically synthesized
atcagcctctgaaaggggaa

SEQ ID NO: 50801 - DNA, 20 bp, Artificial Sequence
  chemically synthesized
gcctctgaaaggggaatggt

SEQ ID NO: 50802 - DNA, 20 bp, Artificial Sequence
  chemically synthesized
gaaaggggaatggtcagacc

SEQ ID NO: 50803 - DNA, 20 bp, Artificial Sequence
  chemically synthesized
aaaggggaatggtcagaccc

SEQ ID NO: 50804 - DNA, 20 bp, Artificial Sequence
  chemically synthesized
aggggaatggtcagacccgg

SEQ ID NO: 50805 - DNA, 20 bp, Artificial Sequence
  chemically synthesized
ggggaatggtcagacccggg

SEQ ID NO: 50806 - DNA, 20 bp, Artificial Sequence
  chemically synthesized
gaggccttgaatgccatgct

SEQ ID NO: 50807 - DNA, 20 bp, Artificial Sequence
  chemically synthesized
aggccttgaatgccatgcta

SEQ ID NO: 50808 - DNA, 20 bp, Artificial Sequence
  chemically synthesized
gccttgaatgccatgctaag

SEQ ID NO: 50809 - DNA, 20 bp, Artificial Sequence
  chemically synthesized
gaatgccatgctaaggagtt

SEQ ID NO: 50810 - DNA, 20 bp, Artificial Sequence
  chemically synthesized
ctaaggagttcggacttgac

SEQ ID NO: 50811 - DNA, 20 bp, Artificial Sequence
  chemically synthesized
aaggagttcggacttgacaa

SEQ ID NO: 50812 - DNA, 20 bp, Artificial Sequence
  chemically synthesized
aggagttcggacttgacaag

SEQ ID NO: 50813 - DNA, 20 bp, Artificial Sequence
  chemically synthesized
agttcggacttgacaagagg

SEQ ID NO: 50814 - DNA, 20 bp, Artificial Sequence
  chemically synthesized
tcggacttgacaagaggcag

SEQ ID NO: 50815 - DNA, 20 bp, Artificial Sequence
  chemically synthesized
cttgacaagaggcagcagca

SEQ ID NO: 50816 - DNA, 20 bp, Artificial Sequence
  chemically synthesized
ttgacaagaggcagcagcaa

SEQ ID NO: 50817 - DNA, 20 bp, Artificial Sequence
  chemically synthesized
tgacaagaggcagcagcaaa

SEQ ID NO: 50818 - DNA, 20 bp, Artificial Sequence
  chemically synthesized
agcaaagggttttgataacc

SEQ ID NO: 50819 - DNA, 20 bp, Artificial Sequence
  chemically synthesized
aagggttttgataacctggt

SEQ ID NO: 50820 - DNA, 20 bp, Artificial Sequence
  chemically synthesized
ttattgtatttcactgctgc

SEQ ID NO: 50821 - DNA, 20 bp, Artificial Sequence
  chemically synthesized
ttcactgctgcaagatttac

SEQ ID NO: 50822 - DNA, 20 bp, Artificial Sequence
  chemically synthesized
gctgcaagatttactggaca

SEQ ID NO: 50823 - DNA, 20 bp, Artificial Sequence
  chemically synthesized
tgcaagatttactggacaaa

SEQ ID NO: 50824 - DNA, 20 bp, Artificial Sequence
  chemically synthesized
gcaagatttactggacaaag

SEQ ID NO: 50825 - DNA, 20 bp, Artificial Sequence
  chemically synthesized
aagatttactggacaaagag

SEQ ID NO: 50826 - DNA, 20 bp, Artificial Sequence
  chemically synthesized
agatttactggacaaagagg

SEQ ID NO: 50827 - DNA, 20 bp, Artificial Sequence
  chemically synthesized
atttactggacaaagaggag

SEQ ID NO: 50828 - DNA, 20 bp, Artificial Sequence
  chemically synthesized
tttactggacaaagaggagg

SEQ ID NO: 50829 - DNA, 20 bp, Artificial Sequence
  chemically synthesized
ttactggacaaagaggagga

SEQ ID NO: 50830 - DNA, 20 bp, Artificial Sequence
  chemically synthesized
tactggacaaagaggaggag

SEQ ID NO: 50831 - DNA, 20 bp, Artificial Sequence
  chemically synthesized
actggacaaagaggaggagg

SEQ ID NO: 50832 - DNA, 20 bp, Artificial Sequence
  chemically synthesized
tggacaaagaggaggagggg

SEQ ID NO: 50833 - DNA, 20 bp, Artificial Sequence
  chemically synthesized
acaaagaggaggagggggag

SEQ ID NO: 50834 - DNA, 20 bp, Artificial Sequence
  chemically synthesized
agaggaggagggggagaaga

SEQ ID NO: 50835 - DNA, 20 bp, Artificial Sequence
  chemically synthesized
gaggagggggagaagacagt

SEQ ID NO: 50836 - DNA, 20 bp, Artificial Sequence
  chemically synthesized
gggggagaagacagtgagtg

SEQ ID NO: 50837 - DNA, 20 bp, Artificial Sequence
  chemically synthesized
gaagacagtgagtgcagtga

SEQ ID NO: 50838 - DNA, 20 bp, Artificial Sequence
  chemically synthesized
aagacagtgagtgcagtgaa

SEQ ID NO: 50839 - DNA, 20 bp, Artificial Sequence
  chemically synthesized
tgagtgcagtgaaaggtgtc

SEQ ID NO: 50840 - DNA, 20 bp, Artificial Sequence
  chemically synthesized
gtgcagtgaaaggtgtctag

SEQ ID NO: 50841 - DNA, 20 bp, Artificial Sequence
  chemically synthesized
tgaaaggtgtctagaagccc

SEQ ID NO: 50842 - DNA, 20 bp, Artificial Sequence
  chemically synthesized
ggtgtctagaagcccaagca

SEQ ID NO: 50843 - DNA, 20 bp, Artificial Sequence
  chemically synthesized
gtgtctagaagcccaagcaa

SEQ ID NO: 50844 - DNA, 20 bp, Artificial Sequence
  chemically synthesized
ctagaagcccaagcaaaggc

SEQ ID NO: 50845 - DNA, 20 bp, Artificial Sequence
  chemically synthesized
tagaagcccaagcaaaggcc

SEQ ID NO: 50846 - DNA, 20 bp, Artificial Sequence
  chemically synthesized
agaagcccaagcaaaggcca

SEQ ID NO: 50847 - DNA, 20 bp, Artificial Sequence
  chemically synthesized
gaagcccaagcaaaggccag

SEQ ID NO: 50848 - DNA, 20 bp, Artificial Sequence
  chemically synthesized
gcccaagcaaaggccagggg

SEQ ID NO: 50849 - DNA, 20 bp, Artificial Sequence
  chemically synthesized
cccaagcaaaggccaggggt

SEQ ID NO: 50850 - DNA, 20 bp, Artificial Sequence
  chemically synthesized
ccaagcaaaggccaggggtg

SEQ ID NO: 50851 - DNA, 20 bp, Artificial Sequence
  chemically synthesized
caaaggccaggggtggggcg

SEQ ID NO: 50852 - DNA, 20 bp, Artificial Sequence
  chemically synthesized
aaggccaggggtggggcgta

SEQ ID NO: 50853 - DNA, 20 bp, Artificial Sequence
  chemically synthesized
ggccaggggtggggcgtaga

SEQ ID NO: 50854 - DNA, 20 bp, Artificial Sequence
  chemically synthesized
gccaggggtggggcgtagag

SEQ ID NO: 50855 - DNA, 20 bp, Artificial Sequence
  chemically synthesized
ggtggggcgtagagaggcaa

SEQ ID NO: 50856 - DNA, 20 bp, Artificial Sequence
  chemically synthesized
gggcgtagagaggcaatgga

SEQ ID NO: 50857 - DNA, 20 bp, Artificial Sequence
  chemically synthesized
ggcgtagagaggcaatggaa

SEQ ID NO: 50858 - DNA, 20 bp, Artificial Sequence
  chemically synthesized
agaggcaatggaaaggcacc

SEQ ID NO: 50859 - DNA, 20 bp, Artificial Sequence
  chemically synthesized
tggaaaggcacccagacacc

SEQ ID NO: 50860 - DNA, 20 bp, Artificial Sequence
  chemically synthesized
ggaaaggcacccagacaccc

SEQ ID NO: 50861 - DNA, 20 bp, Artificial Sequence
  chemically synthesized
cacccagacacccaggcttc

SEQ ID NO: 50862 - DNA, 20 bp, Artificial Sequence
  chemically synthesized
gacacccaggcttccagcct

SEQ ID NO: 50863 - DNA, 20 bp, Artificial Sequence
  chemically synthesized
ccaggcttccagcctgagcg

SEQ ID NO: 50864 - DNA, 20 bp, Artificial Sequence
  chemically synthesized
aggcttccagcctgagcgcg

SEQ ID NO: 50865 - DNA, 20 bp, Artificial Sequence
  chemically synthesized
gcctgagcgcggagtgcatg

SEQ ID NO: 50866 - DNA, 20 bp, Artificial Sequence
  chemically synthesized
cctgagcgcggagtgcatgc

SEQ ID NO: 50867 - DNA, 20 bp, Artificial Sequence
  chemically synthesized
cggagtgcatgcaggctgcg

SEQ ID NO: 50868 - DNA, 20 bp, Artificial Sequence
  chemically synthesized
agtgcatgcaggctgcgcgg

SEQ ID NO: 50869 - DNA, 20 bp, Artificial Sequence
  chemically synthesized
caggctgcgcggtggccgcc

SEQ ID NO: 50870 - DNA, 20 bp, Artificial Sequence
  chemically synthesized
aggctgcgcggtggccgccc

SEQ ID NO: 50871 - DNA, 20 bp, Artificial Sequence
  chemically synthesized
cgcggtggccgcccgggttg

SEQ ID NO: 50872 - DNA, 20 bp, Artificial Sequence
  chemically synthesized
gcggtggccgcccgggttgc

SEQ ID NO: 50873 - DNA, 20 bp, Artificial Sequence
  chemically synthesized
cggtggccgcccgggttgca

SEQ ID NO: 50874 - DNA, 20 bp, Artificial Sequence
  chemically synthesized
cccgggttgcagggaacgcg

SEQ ID NO: 50875 - DNA, 20 bp, Artificial Sequence
  chemically synthesized
ccgggttgcagggaacgcgc

SEQ ID NO: 50876 - DNA, 20 bp, Artificial Sequence
  chemically synthesized
gttgcagggaacgcgcgggc

SEQ ID NO: 50877 - DNA, 20 bp, Artificial Sequence
  chemically synthesized
cgcgcgggccagcgactctg

SEQ ID NO: 50878 - DNA, 20 bp, Artificial Sequence
  chemically synthesized
accccgtgcccgcactcacc

SEQ ID NO: 50879 - DNA, 20 bp, Artificial Sequence
  chemically synthesized
ccccgtgcccgcactcaccc

SEQ ID NO: 50880 - DNA, 20 bp, Artificial Sequence
  chemically synthesized
gtgcccgcactcacccagga

SEQ ID NO: 50881 - DNA, 20 bp, Artificial Sequence
  chemically synthesized
cgcactcacccaggacggcg

SEQ ID NO: 50882 - DNA, 20 bp, Artificial Sequence
  chemically synthesized
tcacccaggacggcgcagac

SEQ ID NO: 50883 - DNA, 20 bp, Artificial Sequence
  chemically synthesized
cccaggacggcgcagaccag

SEQ ID NO: 50884 - DNA, 20 bp, Artificial Sequence
  chemically synthesized
ccaggacggcgcagaccagc

SEQ ID NO: 50885 - DNA, 20 bp, Artificial Sequence
  chemically synthesized
caggacggcgcagaccagca

SEQ ID NO: 50886 - DNA, 20 bp, Artificial Sequence
  chemically synthesized
gcagaccagcagggctccca

SEQ ID NO: 50887 - DNA, 20 bp, Artificial Sequence
  chemically synthesized
accagcagggctcccacggc

SEQ ID NO: 50888 - DNA, 20 bp, Artificial Sequence
  chemically synthesized
ccacggcgagcctcatcttc

SEQ ID NO: 50889 - DNA, 20 bp, Artificial Sequence
  chemically synthesized
cacggcgagcctcatcttcc

SEQ ID NO: 50890 - DNA, 20 bp, Artificial Sequence
  chemically synthesized
cgagcctcatcttccgggtg

SEQ ID NO: 50891 - DNA, 20 bp, Artificial Sequence
  chemically synthesized
catcttccgggtgcggcgct

SEQ ID NO: 50892 - DNA, 20 bp, Artificial Sequence
  chemically synthesized
cttccgggtgcggcgctgag

SEQ ID NO: 50893 - DNA, 20 bp, Artificial Sequence
  chemically synthesized
cgggtgcggcgctgagcagc

SEQ ID NO: 50894 - DNA, 20 bp, Artificial Sequence
  chemically synthesized
gcggcgctgagcagcgagca

SEQ ID NO: 50895 - DNA, 20 bp, Artificial Sequence
  chemically synthesized
cgctgagcagcgagcacagt

SEQ ID NO: 50896 - DNA, 20 bp, Artificial Sequence
  chemically synthesized
cagtcggactcgcttctgtg

SEQ ID NO: 50897 - DNA, 20 bp, Artificial Sequence
  chemically synthesized
actcgcttctgtgcagcctc

SEQ ID NO: 50898 - DNA, 20 bp, Artificial Sequence
  chemically synthesized
gcgtccctttattccattcc

SEQ ID NO: 50899 - DNA, 20 bp, Artificial Sequence
  chemically synthesized
cctttattccattcccggcc

SEQ ID NO: 50900 - DNA, 20 bp, Artificial Sequence
  chemically synthesized
ctttattccattcccggcct

SEQ ID NO: 50901 - DNA, 20 bp, Artificial Sequence
  chemically synthesized
tattccattcccggcctggg

SEQ ID NO: 50902 - DNA, 20 bp, Artificial Sequence
  chemically synthesized
attccattcccggcctgggc

SEQ ID NO: 50903 - DNA, 20 bp, Artificial Sequence
  chemically synthesized
cattcccggcctgggcgggc

SEQ ID NO: 50904 - DNA, 20 bp, Artificial Sequence
  chemically synthesized
attcccggcctgggcgggct

SEQ ID NO: 50905 - DNA, 20 bp, Artificial Sequence
  chemically synthesized
tttgacctcccgtgtttgtg

SEQ ID NO: 50906 - DNA, 20 bp, Artificial Sequence
  chemically synthesized
acctcccgtgtttgtgcagc

SEQ ID NO: 50907 - DNA, 20 bp, Artificial Sequence
  chemically synthesized
cctcccgtgtttgtgcagcc

SEQ ID NO: 50908 - DNA, 20 bp, Artificial Sequence
  chemically synthesized
cactgatcacctcattttct

SEQ ID NO: 50909 - DNA, 20 bp, Artificial Sequence
  chemically synthesized
tcacctcattttctgagctc

SEQ ID NO: 50910 - DNA, 20 bp, Artificial Sequence
  chemically synthesized
acctcattttctgagctctg

SEQ ID NO: 50911 - DNA, 20 bp, Artificial Sequence
  chemically synthesized
gagctctggagacgacccgc

SEQ ID NO: 50912 - DNA, 20 bp, Artificial Sequence
  chemically synthesized
ctctggagacgacccgcgag

SEQ ID NO: 50913 - DNA, 20 bp, Artificial Sequence
  chemically synthesized
tggagacgacccgcgagtgg

SEQ ID NO: 50914 - DNA, 20 bp, Artificial Sequence
  chemically synthesized
ggagacgacccgcgagtgga

SEQ ID NO: 50915 - DNA, 20 bp, Artificial Sequence
  chemically synthesized
agacgacccgcgagtggaag

SEQ ID NO: 50916 - DNA, 20 bp, Artificial Sequence
  chemically synthesized
acccgcgagtggaaggagtc

SEQ ID NO: 50917 - DNA, 20 bp, Artificial Sequence
  chemically synthesized
cgagtggaaggagtccagca

SEQ ID NO: 50918 - DNA, 20 bp, Artificial Sequence
  chemically synthesized
gtccagcacagaaatgttga

SEQ ID NO: 50919 - DNA, 20 bp, Artificial Sequence
  chemically synthesized
tccagcacagaaatgttgat

SEQ ID NO: 50920 - DNA, 20 bp, Artificial Sequence
  chemically synthesized
agcacagaaatgttgatggg

SEQ ID NO: 50921 - DNA, 20 bp, Artificial Sequence
  chemically synthesized
gcacagaaatgttgatggga

SEQ ID NO: 50922 - DNA, 20 bp, Artificial Sequence
  chemically synthesized
cacagaaatgttgatgggaa

SEQ ID NO: 50923 - DNA, 20 bp, Artificial Sequence
  chemically synthesized
tgttgatgggaagggacatg

SEQ ID NO: 50924 - DNA, 20 bp, Artificial Sequence
  chemically synthesized
aagggacatgaagcacaatg

SEQ ID NO: 50925 - DNA, 20 bp, Artificial Sequence
  chemically synthesized
caatgcagccattgtcatcg

SEQ ID NO: 50926 - DNA, 20 bp, Artificial Sequence
  chemically synthesized
cattgtcatcgcggctcgct

SEQ ID NO: 50927 - DNA, 20 bp, Artificial Sequence
  chemically synthesized
gtgctggactccttccactc

SEQ ID NO: 50928 - DNA, 20 bp, Artificial Sequence
  chemically synthesized
aaaatgaggtgatcagtggg

SEQ ID NO: 50929 - DNA, 20 bp, Artificial Sequence
  chemically synthesized
cagtgggacgagtaaggaag

SEQ ID NO: 50930 - DNA, 20 bp, Artificial Sequence
  chemically synthesized
gcgcccagcccgcccaggcc

SEQ ID NO: 50931 - DNA, 20 bp, Artificial Sequence
  chemically synthesized
cagcccgcccaggccgggaa

SEQ ID NO: 50932 - DNA, 20 bp, Artificial Sequence
  chemically synthesized
gcgccggaggctgcacagaa

SEQ ID NO: 50933 - DNA, 20 bp, Artificial Sequence
  chemically synthesized
ccctgctggtctgcgccgtc

SEQ ID NO: 50934 - DNA, 20 bp, Artificial Sequence
  chemically synthesized
gctggtctgcgccgtcctgg

SEQ ID NO: 50935 - DNA, 20 bp, Artificial Sequence
  chemically synthesized
gtcctgggtgagtgcgggca

SEQ ID NO: 50936 - DNA, 20 bp, Artificial Sequence
  chemically synthesized
gcgggcacggggtagcaccg

SEQ ID NO: 50937 - DNA, 20 bp, Artificial Sequence
  chemically synthesized
tccgcgctcaggctggaagc

SEQ ID NO: 50938 - DNA, 20 bp, Artificial Sequence
  chemically synthesized
caggctggaagcctgggtgt

SEQ ID NO: 50939 - DNA, 20 bp, Artificial Sequence
  chemically synthesized
agcatggcattcaaggcctc

SEQ ID NO: 50940 - DNA, 20 bp, Artificial Sequence
  chemically synthesized
ctttcagaggctgatgtccc

SEQ ID NO: 50941 - DNA, 20 bp, Artificial Sequence
  chemically synthesized
gccatcgagcggtcagagca

SEQ ID NO: 50942 - DNA, 20 bp, Artificial Sequence
  chemically synthesized
ggggtttgaagccagacttc

SEQ ID NO: 50943 - DNA, 20 bp, Artificial Sequence
  chemically synthesized
ggccggctcctcaccaggga

SEQ ID NO: 50944 - DNA, 20 bp, Artificial Sequence
  chemically synthesized
tcatcacagcacttgcctgg

SEQ ID NO: 50945 - DNA, 20 bp, Artificial Sequence
  chemically synthesized
cttgcctgggagggtcaaat

SEQ ID NO: 50946 - DNA, 20 bp, Artificial Sequence
  chemically synthesized
ggtcagcgaggtggcagatg

SEQ ID NO: 50947 - DNA, 20 bp, Artificial Sequence
  chemically synthesized
cacaggcttatgttgcctcc

SEQ ID NO: 50948 - DNA, 20 bp, Artificial Sequence
  chemically synthesized
catgggccaagagggaaaat

SEQ ID NO: 50949 - DNA, 20 bp, Artificial Sequence
  chemically synthesized
agagggaaaatgggggtcgc

SEQ ID NO: 50950 - DNA, 20 bp, Artificial Sequence
  chemically synthesized
gcctcctctccacaggcttt

SEQ ID NO: 50951 - DNA, 20 bp, Artificial Sequence
  chemically synthesized
gtggatcttcttcagagcca

SEQ ID NO: 50952 - DNA, 20 bp, Artificial Sequence
  chemically synthesized
ccttgctgtggtggcccaca

SEQ ID NO: 50953 - DNA, 20 bp, Artificial Sequence
  chemically synthesized
agggcaaaagctcatgtgat

SEQ ID NO: 50954 - DNA, 20 bp, Artificial Sequence
  chemically synthesized
gatgctgtctctgcaaccac

SEQ ID NO: 50955 - DNA, 20 bp, Artificial Sequence
  chemically synthesized
ggctggcttcagcttttttt

SEQ ID NO: 50956 - DNA, 20 bp, Artificial Sequence
  chemically synthesized
aaaaagtgtggtgaaaatgg

SEQ ID NO: 50957 - DNA, 20 bp, Artificial Sequence
  chemically synthesized
tggagacagaggggagactg

SEQ ID NO: 50958 - DNA, 20 bp, Artificial Sequence
  chemically synthesized
aggggagactgttgaatttg

SEQ ID NO: 50959 - DNA, 20 bp, Artificial Sequence
  chemically synthesized
ctaaacagagagcaacagac

SEQ ID NO: 50960 - DNA, 20 bp, Artificial Sequence
  chemically synthesized
ccctcaactactggccaaga

SEQ ID NO: 50961 - DNA, 20 bp, Artificial Sequence
  chemically synthesized
ggccaagaaggggtgtaact

SEQ ID NO: 50962 - DNA, 20 bp, Artificial Sequence
  chemically synthesized
atgttttcttcttttgtgcc

SEQ ID NO: 50963 - DNA, 20 bp, Artificial Sequence
  chemically synthesized
tgtgccctgagtagcagacc

SEQ ID NO: 50964 - DNA, 20 bp, Artificial Sequence
  chemically synthesized
ctggcttggccaacgacaag

SEQ ID NO: 50965 - DNA, 20 bp, Artificial Sequence
  chemically synthesized
caacgacaagcagggtgacc

SEQ ID NO: 50966 - DNA, 20 bp, Artificial Sequence
  chemically synthesized
aaaaaaaaaggcatcattct

SEQ ID NO: 50967 - DNA, 20 bp, Artificial Sequence
  chemically synthesized
gaggtagcaagccaatgtgt

SEQ ID NO: 50968 - DNA, 20 bp, Artificial Sequence
  chemically synthesized
cagtgatgggaggagacaag

SEQ ID NO: 50969 - DNA, 20 bp, Artificial Sequence
  chemically synthesized
ctgcacccctctggccagca

SEQ ID NO: 50970 - DNA, 20 bp, Artificial Sequence
  chemically synthesized
accttctattggctcagact

SEQ ID NO: 50971 - DNA, 20 bp, Artificial Sequence
  chemically synthesized
gccctgtagtgttcatggac

SEQ ID NO: 50972 - DNA, 20 bp, Artificial Sequence
  chemically synthesized
tgagaggaggacaggactga

SEQ ID NO: 50973 - DNA, 20 bp, Artificial Sequence
  chemically synthesized
gctgtctctccctcagcata

SEQ ID NO: 50974 - DNA, 20 bp, Artificial Sequence
  chemically synthesized
agcatgaggccactaagtgc

SEQ ID NO: 50975 - DNA, 20 bp, Artificial Sequence
  chemically synthesized
cacaagcaacactgggacca

SEQ ID NO: 50976 - DNA, 20 bp, Artificial Sequence
  chemically synthesized
gcaacactgggaccatcgga

SEQ ID NO: 50977 - DNA, 20 bp, Artificial Sequence
  chemically synthesized
ggcacaagttctactgcatt

SEQ ID NO: 50978 - DNA, 20 bp, Artificial Sequence
  chemically synthesized
gaccaccctctgctggccag

SEQ ID NO: 50979 - DNA, 20 bp, Artificial Sequence
  chemically synthesized
ctatggaaaaccagcggggg

SEQ ID NO: 50980 - DNA, 20 bp, Artificial Sequence
  chemically synthesized
ttgccatctttttgagaaga

SEQ ID NO: 50981 - DNA, 20 bp, Artificial Sequence
  chemically synthesized
agaagagggagtgagactca

SEQ ID NO: 50982 - DNA, 20 bp, Artificial Sequence
  chemically synthesized
gtcgttggccaagccaggcc

SEQ ID NO: 50983 - DNA, 20 bp, Artificial Sequence
  chemically synthesized
ggccaagccaggcctagaat

SEQ ID NO: 50984 - DNA, 20 bp, Artificial Sequence
  chemically synthesized
agaatctgggtctccagact

SEQ ID NO: 50985 - DNA, 20 bp, Artificial Sequence
  chemically synthesized
gcacaaaagaagaaaacatt

SEQ ID NO: 50986 - DNA, 20 bp, Artificial Sequence
  chemically synthesized
ccccttcttggccagtagtt

SEQ ID NO: 50987 - DNA, 20 bp, Artificial Sequence
  chemically synthesized
gttgagggtaaattaacgaa

SEQ ID NO: 50988 - DNA, 20 bp, Artificial Sequence
  chemically synthesized
aaaaaaagctgaagccagcc

SEQ ID NO: 50989 - DNA, 20 bp, Artificial Sequence
  chemically synthesized
agaggaggcccacagctctc

SEQ ID NO: 50990 - DNA, 20 bp, Artificial Sequence
  chemically synthesized
atgcatgaggaggggccacc

SEQ ID NO: 50991 - DNA, 20 bp, Artificial Sequence
  chemically synthesized
cctccacaaagccctgcctc

SEQ ID NO: 50992 - DNA, 20 bp, Artificial Sequence
  chemically synthesized
cctccagagttcccataggc

SEQ ID NO: 50993 - DNA, 20 bp, Artificial Sequence
  chemically synthesized
gcctgtgaagtgctctgtgc

SEQ ID NO: 50994 - DNA, 20 bp, Artificial Sequence
  chemically synthesized
ggggataaaggcaagtaacg

SEQ ID NO: 50995 - DNA, 20 bp, Artificial Sequence
  chemically synthesized
taacgtggggtcctctctca

SEQ ID NO: 50996 - DNA, 20 bp, Artificial Sequence
  chemically synthesized
aacagtgtgacaaatgcccc

SEQ ID NO: 50997 - DNA, 20 bp, Artificial Sequence
  chemically synthesized
catgaatggcaggcagaagt

SEQ ID NO: 50998 - DNA, 20 bp, Artificial Sequence
  chemically synthesized
ggccccacctcaggaggtcg

SEQ ID NO: 50999 - DNA, 20 bp, Artificial Sequence
  chemically synthesized
cgtcagccactgccccatag

SEQ ID NO: 51000 - DNA, 20 bp, Artificial Sequence
  chemically synthesized
ggtgaggagccggccaggac

SEQ ID NO: 51001 - DNA, 20 bp, Artificial Sequence
  chemically synthesized
gggacatcagcctctgaaag

SEQ ID NO: 51002 - DNA, 20 bp, Artificial Sequence
  chemically synthesized
atggtcagacccgggaggcc

SEQ ID NO: 51003 - DNA, 20 bp, Artificial Sequence
  chemically synthesized
aggccttgaatgccatgcta

SEQ ID NO: 51004 - DNA, 20 bp, Artificial Sequence
  chemically synthesized
cttgacaagaggcagcagca

SEQ ID NO: 51005 - DNA, 20 bp, Artificial Sequence
  chemically synthesized
aggaggagggggagaagaca

SEQ ID NO: 51006 - DNA, 20 bp, Artificial Sequence
  chemically synthesized
tagaagcccaagcaaaggcc

SEQ ID NO: 51007 - DNA, 20 bp, Artificial Sequence
  chemically synthesized
ccaggcttccagcctgagcg

SEQ ID NO: 51008 - DNA, 20 bp, Artificial Sequence
  chemically synthesized
gcaggctgcgcggtggccgc

SEQ ID NO: 51009 - DNA, 20 bp, Artificial Sequence
  chemically synthesized
cccacggcgagcctcatctt

SEQ ID NO: 51010 - DNA, 20 bp, Artificial Sequence
  chemically synthesized
gacctcccgtgtttgtgcag

SEQ ID NO: 51011 - DNA, 20 bp, Artificial Sequence
  chemically synthesized
ctgagctctggagacgaccc

SEQ ID NO: 51012 - DNA, 20 bp, Artificial Sequence
  chemically synthesized
ggagacgacccgcgagtgga

SEQ ID NO: 51013 - DNA, 20 bp, Artificial Sequence
  chemically synthesized
tcgcgggtcgtctccagagc

SEQ ID NO: 51014 - DNA, 20 bp, Artificial Sequence
  chemically synthesized
tggccaagaaggggtgtaac

SEQ ID NO: 51015 - DNA, 20 bp, Artificial Sequence
  chemically synthesized
aaccttctattggctcagac

SEQ ID NO: 51016 - DNA, 20 bp, Artificial Sequence
  chemically synthesized
ggtcccagtgttgcttgtgt

SEQ ID NO: 51017 - DNA, 20 bp, Artificial Sequence
  chemically synthesized
agggagagacagcatcgccc

SEQ ID NO: 51018 - DNA, 20 bp, Artificial Sequence
  chemically synthesized
gagaagagggagtgagactc

SEQ ID NO: 51019 - DNA, 20 bp, Artificial Sequence
  chemically synthesized
tgtcgttggccaagccaggc

SEQ ID NO: 51020 - DNA, 20 bp, Artificial Sequence
  chemically synthesized
ctgctactcagggcacaaaa

SEQ ID NO: 51021 - DNA, 20 bp, Artificial Sequence
  chemically synthesized
agttgagggtaaattaacga

SEQ ID NO: 51022 - DNA, 20 bp, Artificial Sequence
  chemically synthesized
gcctccagagttcccatagg

SEQ ID NO: 51023 - DNA, 20 bp, Artificial Sequence
  chemically synthesized
ggaattgctagcttatgggg

SEQ ID NO: 51024 - DNA, 20 bp, Artificial Sequence
  chemically synthesized
gcgagtggaaggagtccagc

SEQ ID NO: 51025 - DNA, 20 bp, Artificial Sequence
  chemically synthesized
agcacgtctaaccaggttat

SEQ ID NO: 51026 - DNA, 20 bp, Artificial Sequence
  chemically synthesized
gccaatgtgttggggtagct

SEQ ID NO: 51027 - DNA, 20 bp, Artificial Sequence
  chemically synthesized
ctgtgtctggctgtccctga

SEQ ID NO: 51028 - DNA, 20 bp, Artificial Sequence
  chemically synthesized
ggcttgctacctcaactatg

SEQ ID NO: 51029 - DNA, 20 bp, Artificial Sequence
  chemically synthesized
ctactcagggcacaaaagaa

SEQ ID NO: 51030 - DNA, 20 bp, Artificial Sequence
  chemically synthesized
ctctctgtttaggaagaact

SEQ ID NO: 51031 - DNA, 20 bp, Artificial Sequence
  chemically synthesized
attgctagcttatggggaga

SEQ ID NO: 51032 - DNA, 20 bp, Artificial Sequence
  chemically synthesized
ccgcgatgacaatggctgca

SEQ ID NO: 51033 - DNA, 20 bp, Artificial Sequence
  chemically synthesized
aggaaggggggttgggagag

SEQ ID NO: 51034 - DNA, 20 bp, Artificial Sequence
  chemically synthesized
gctgcacaaacacgggaggt

SEQ ID NO: 51035 - DNA, 20 bp, Artificial Sequence
  chemically synthesized
ctctacgccccacccctggc

SEQ ID NO: 51036 - DNA, 20 bp, Artificial Sequence
  chemically synthesized
gccccacccctggcctttgc

SEQ ID NO: 51037 - DNA, 20 bp, Artificial Sequence
  chemically synthesized
gccatcgagcggtcagagca

SEQ ID NO: 51038 - DNA, 20 bp, Artificial Sequence
  chemically synthesized
tggggcatttgtcacactgt

SEQ ID NO: 51039 - DNA, 20 bp, Artificial Sequence
  chemically synthesized
ttgtcacactgttggggctt

SEQ ID NO: 51040 - DNA, 20 bp, Artificial Sequence
  chemically synthesized
acactgttggggcttccacg

SEQ ID NO: 51041 - DNA, 20 bp, Artificial Sequence
  chemically synthesized
gcctatgggaactctggagg

SEQ ID NO: 51042 - DNA, 20 bp, Artificial Sequence
  chemically synthesized
ggctttgtggaggggctgcc

SEQ ID NO: 51043 - DNA, 20 bp, Artificial Sequence
  chemically synthesized
ccacaggcttatgttgcctc

SEQ ID NO: 51044 - DNA, 20 bp, Artificial Sequence
  chemically synthesized
gagctgtgggcctcctctcc

SEQ ID NO: 51045 - DNA, 20 bp, Artificial Sequence
  chemically synthesized
ggatgctgtctctgcaacca

SEQ ID NO: 51046 - DNA, 20 bp, Artificial Sequence
  chemically synthesized
gattttaatagttacccatg

SEQ ID NO: 51047 - DNA, 20 bp, Artificial Sequence
  chemically synthesized
aatagttacccatggctggc

SEQ ID NO: 51048 - DNA, 20 bp, Artificial Sequence
  chemically synthesized
aggggagactgttgaatttg

SEQ ID NO: 51049 - DNA, 20 bp, Artificial Sequence
  chemically synthesized
ccaagaaggggtgtaactca

SEQ ID NO: 51050 - DNA, 20 bp, Artificial Sequence
  chemically synthesized
gcagacccagagtctggaga

SEQ ID NO: 51051 - DNA, 20 bp, Artificial Sequence
  chemically synthesized
ctggagacccagattctagg

SEQ ID NO: 51052 - DNA, 20 bp, Artificial Sequence
  chemically synthesized
aagatggcaattcctccccc

SEQ ID NO: 51053 - DNA, 20 bp, Artificial Sequence
  chemically synthesized
tgaaaacgccctgtgcatac

SEQ ID NO: 51054 - DNA, 20 bp, Artificial Sequence
  chemically synthesized
agacaaggcggatacagagg

SEQ ID NO: 51055 - DNA, 20 bp, Artificial Sequence
  chemically synthesized
agcatgaggccactaagtgc

SEQ ID NO: 51056 - DNA, 20 bp, Artificial Sequence
  chemically synthesized
attccatccgatggtcccag

SEQ ID NO: 51057 - DNA, 20 bp, Artificial Sequence
  chemically synthesized
tgtgtgaagaaagcctccta

SEQ ID NO: 51058 - DNA, 20 bp, Artificial Sequence
  chemically synthesized
gccctgatgcaatcaaggta

SEQ ID NO: 51059 - DNA, 20 bp, Artificial Sequence
  chemically synthesized
actgggaccatcggatggaa

SEQ ID NO: 51060 - DNA, 20 bp, Artificial Sequence
  chemically synthesized
tccgacactgcacaccatct

SEQ ID NO: 51061 - DNA, 20 bp, Artificial Sequence
  chemically synthesized
gaaggttgccctaatggcct

SEQ ID NO: 51062 - DNA, 20 bp, Artificial Sequence
  chemically synthesized
cataagcctcagtatgcaca

SEQ ID NO: 51063 - DNA, 20 bp, Artificial Sequence
  chemically synthesized
gttttcagctaccccaacac

SEQ ID NO: 51064 - DNA, 20 bp, Artificial Sequence
  chemically synthesized
ttttttttaacccaaggtca

SEQ ID NO: 51065 - DNA, 20 bp, Artificial Sequence
  chemically synthesized
tgtaactcttgtctgttgct

SEQ ID NO: 51066 - DNA, 20 bp, Artificial Sequence
  chemically synthesized
agagacagcatccctatcac

SEQ ID NO: 51067 - DNA, 20 bp, Artificial Sequence
  chemically synthesized
gggtcctctctcaaggaatt

SEQ ID NO: 51068 - DNA, 20 bp, Artificial Sequence
  chemically synthesized
caggacttggatccaagaag

SEQ ID NO: 51069 - DNA, 20 bp, Artificial Sequence
  chemically synthesized
atgctctgaccgctcgatgg

SEQ ID NO: 51070 - DNA, 20 bp, Artificial Sequence
  chemically synthesized
cttgacaagaggcagcagca

SEQ ID NO: 51071 - DNA, 20 bp, Artificial Sequence
  chemically synthesized
tgataacctggttagacgtg

SEQ ID NO: 51072 - DNA, 20 bp, Artificial Sequence
  chemically synthesized
atttattgtatttcactgct

SEQ ID NO: 51073 - DNA, 20 bp, Artificial Sequence
  chemically synthesized
atggaaaggcacccagacac

SEQ ID NO: 51074 - DNA, 20 bp, Artificial Sequence
  chemically synthesized
tgagcagcgagcacagtcgg

SEQ ID NO: 51075 - DNA, 20 bp, Artificial Sequence
  chemically synthesized
tgggcgcaatctttgacctc

SEQ ID NO: 51076 - DNA, 22 bp, Artificial Sequence
  chemically synthesized
cattgtgcttcatgtcccttcc

SEQ ID NO: 51077 - DNA, 22 bp, Artificial Sequence
  chemically synthesized
tgcttcatgtcccttcccatca

SEQ ID NO: 51078 - DNA, 22 bp, Artificial Sequence
  chemically synthesized
catgtcccttcccatcaacatt

SEQ ID NO: 51079 - DNA, 22 bp, Artificial Sequence
  chemically synthesized
atgtcccttcccatcaacattt

SEQ ID NO: 51080 - DNA, 22 bp, Artificial Sequence
  chemically synthesized
cccatcaacatttctgtgctgg

SEQ ID NO: 51081 - DNA, 22 bp, Artificial Sequence
  chemically synthesized
ccatcaacatttctgtgctgga

SEQ ID NO: 51082 - DNA, 22 bp, Artificial Sequence
  chemically synthesized
ctgtgctggactccttccactc

SEQ ID NO: 51083 - DNA, 22 bp, Artificial Sequence
  chemically synthesized
tgtgctggactccttccactcg

SEQ ID NO: 51084 - DNA, 22 bp, Artificial Sequence
  chemically synthesized
tgctggactccttccactcgcg

SEQ ID NO: 51085 - DNA, 22 bp, Artificial Sequence
  chemically synthesized
gactccttccactcgcgggtcg

SEQ ID NO: 51086 - DNA, 22 bp, Artificial Sequence
  chemically synthesized
cttccactcgcgggtcgtctcc

SEQ ID NO: 51087 - DNA, 22 bp, Artificial Sequence
  chemically synthesized
ccactcgcgggtcgtctccaga

SEQ ID NO: 51088 - DNA, 22 bp, Artificial Sequence
  chemically synthesized
cactcgcgggtcgtctccagag

SEQ ID NO: 51089 - DNA, 22 bp, Artificial Sequence
  chemically synthesized
gcgggtcgtctccagagctcag

SEQ ID NO: 51090 - DNA, 22 bp, Artificial Sequence
  chemically synthesized
cagagctcagaaaatgaggtga

SEQ ID NO: 51091 - DNA, 22 bp, Artificial Sequence
  chemically synthesized
agaaaatgaggtgatcagtggg

SEQ ID NO: 51092 - DNA, 22 bp, Artificial Sequence
  chemically synthesized
ggagaggggcgattgggcaacc

SEQ ID NO: 51093 - DNA, 22 bp, Artificial Sequence
  chemically synthesized
ggcaacccggctgcacaaacac

SEQ ID NO: 51094 - DNA, 22 bp, Artificial Sequence
  chemically synthesized
cacaaacacgggaggtcaaaga

SEQ ID NO: 51095 - DNA, 22 bp, Artificial Sequence
  chemically synthesized
cgcccagcccgcccaggccggg

SEQ ID NO: 51096 - DNA, 22 bp, Artificial Sequence
  chemically synthesized
cacagaagcgagtccgactgtg

SEQ ID NO: 51097 - DNA, 22 bp, Artificial Sequence
  chemically synthesized
tgctcgctgctcagcgccgcac

SEQ ID NO: 51098 - DNA, 22 bp, Artificial Sequence
  chemically synthesized
gctgctcagcgccgcacccgga

SEQ ID NO: 51099 - DNA, 22 bp, Artificial Sequence
  chemically synthesized
ctcagcgccgcacccggaagat

SEQ ID NO: 51100 - DNA, 22 bp, Artificial Sequence
  chemically synthesized
agcgccgcacccggaagatgag

SEQ ID NO: 51101 - DNA, 22 bp, Artificial Sequence
  chemically synthesized
gccgtgggagccctgctggtct

SEQ ID NO: 51102 - DNA, 22 bp, Artificial Sequence
  chemically synthesized
ctggtctgcgccgtcctgggtg

SEQ ID NO: 51103 - DNA, 22 bp, Artificial Sequence
  chemically synthesized
gtctgcgccgtcctgggtgagt

SEQ ID NO: 51104 - DNA, 22 bp, Artificial Sequence
  chemically synthesized
cgccgtcctgggtgagtgcggg

SEQ ID NO: 51105 - DNA, 22 bp, Artificial Sequence
  chemically synthesized
ggtgagtgcgggcacggggtag

SEQ ID NO: 51106 - DNA, 22 bp, Artificial Sequence
  chemically synthesized
gcccgcgcgttccctgcaaccc

SEQ ID NO: 51107 - DNA, 22 bp, Artificial Sequence
  chemically synthesized
cctgcaacccgggcggccaccg

SEQ ID NO: 51108 - DNA, 22 bp, Artificial Sequence
  chemically synthesized
caacccgggcggccaccgcgca

SEQ ID NO: 51109 - DNA, 22 bp, Artificial Sequence
  chemically synthesized
catgcactccgcgctcaggctg

SEQ ID NO: 51110 - DNA, 22 bp, Artificial Sequence
  chemically synthesized
cgcgctcaggctggaagcctgg

SEQ ID NO: 51111 - DNA, 22 bp, Artificial Sequence
  chemically synthesized
aggctggaagcctgggtgtctg

SEQ ID NO: 51112 - DNA, 22 bp, Artificial Sequence
  chemically synthesized
gaagcctgggtgtctgggtgcc

SEQ ID NO: 51113 - DNA, 22 bp, Artificial Sequence
  chemically synthesized
ggtgtctgggtgcctttccatt

SEQ ID NO: 51114 - DNA, 22 bp, Artificial Sequence
  chemically synthesized
ggtgcctttccattgcctctct

SEQ ID NO: 51115 - DNA, 22 bp, Artificial Sequence
  chemically synthesized
tccattgcctctctacgcccca

SEQ ID NO: 51116 - DNA, 22 bp, Artificial Sequence
  chemically synthesized
ccattgcctctctacgccccac

SEQ ID NO: 51117 - DNA, 22 bp, Artificial Sequence
  chemically synthesized
cattgcctctctacgccccacc

SEQ ID NO: 51118 - DNA, 22 bp, Artificial Sequence
  chemically synthesized
cctctctacgccccacccctgg

SEQ ID NO: 51119 - DNA, 22 bp, Artificial Sequence
  chemically synthesized
tctacgccccacccctggcctt

SEQ ID NO: 51120 - DNA, 22 bp, Artificial Sequence
  chemically synthesized
tacgccccacccctggcctttg

SEQ ID NO: 51121 - DNA, 22 bp, Artificial Sequence
  chemically synthesized
cgccccacccctggcctttgct

SEQ ID NO: 51122 - DNA, 22 bp, Artificial Sequence
  chemically synthesized
gcctttgcttgggcttctagac

SEQ ID NO: 51123 - DNA, 22 bp, Artificial Sequence
  chemically synthesized
tgcttgggcttctagacacctt

SEQ ID NO: 51124 - DNA, 22 bp, Artificial Sequence
  chemically synthesized
gcttgggcttctagacaccttt

SEQ ID NO: 51125 - DNA, 22 bp, Artificial Sequence
  chemically synthesized
cttgggcttctagacacctttc

SEQ ID NO: 51126 - DNA, 22 bp, Artificial Sequence
  chemically synthesized
gggcttctagacacctttcact

SEQ ID NO: 51127 - DNA, 22 bp, Artificial Sequence
  chemically synthesized
ggcttctagacacctttcactg

SEQ ID NO: 51128 - DNA, 22 bp, Artificial Sequence
  chemically synthesized
ctagacacctttcactgcactc

SEQ ID NO: 51129 - DNA, 22 bp, Artificial Sequence
  chemically synthesized
tagacacctttcactgcactca

SEQ ID NO: 51130 - DNA, 22 bp, Artificial Sequence
  chemically synthesized
gacacctttcactgcactcact

SEQ ID NO: 51131 - DNA, 22 bp, Artificial Sequence
  chemically synthesized
tcactgcactcactgtcttctc

SEQ ID NO: 51132 - DNA, 22 bp, Artificial Sequence
  chemically synthesized
cactgcactcactgtcttctcc

SEQ ID NO: 51133 - DNA, 22 bp, Artificial Sequence
  chemically synthesized
actgcactcactgtcttctccc

SEQ ID NO: 51134 - DNA, 22 bp, Artificial Sequence
  chemically synthesized
cactcactgtcttctccccctc

SEQ ID NO: 51135 - DNA, 22 bp, Artificial Sequence
  chemically synthesized
actgtcttctccccctcctcct

SEQ ID NO: 51136 - DNA, 22 bp, Artificial Sequence
  chemically synthesized
tcttctccccctcctcctcttt

SEQ ID NO: 51137 - DNA, 22 bp, Artificial Sequence
  chemically synthesized
ctccccctcctcctctttgtcc

SEQ ID NO: 51138 - DNA, 22 bp, Artificial Sequence
  chemically synthesized
tccccctcctcctctttgtcca

SEQ ID NO: 51139 - DNA, 22 bp, Artificial Sequence
  chemically synthesized
cccctcctcctctttgtccagt

SEQ ID NO: 51140 - DNA, 22 bp, Artificial Sequence
  chemically synthesized
ctcctctttgtccagtaaatct

SEQ ID NO: 51141 - DNA, 22 bp, Artificial Sequence
  chemically synthesized
ctctttgtccagtaaatcttgc

SEQ ID NO: 51142 - DNA, 22 bp, Artificial Sequence
  chemically synthesized
tttgtccagtaaatcttgcagc

SEQ ID NO: 51143 - DNA, 22 bp, Artificial Sequence
  chemically synthesized
tgtccagtaaatcttgcagcag

SEQ ID NO: 51144 - DNA, 22 bp, Artificial Sequence
  chemically synthesized
gtccagtaaatcttgcagcagt

SEQ ID NO: 51145 - DNA, 22 bp, Artificial Sequence
  chemically synthesized
tccagtaaatcttgcagcagtg

SEQ ID NO: 51146 - DNA, 22 bp, Artificial Sequence
  chemically synthesized
gcagcagtgaaatacaataaat

SEQ ID NO: 51147 - DNA, 22 bp, Artificial Sequence
  chemically synthesized
cagcagtgaaatacaataaatc

SEQ ID NO: 51148 - DNA, 22 bp, Artificial Sequence
  chemically synthesized
accaggttatcaaaaccctttg

SEQ ID NO: 51149 - DNA, 22 bp, Artificial Sequence
  chemically synthesized
tcaaaaccctttgctgctgcct

SEQ ID NO: 51150 - DNA, 22 bp, Artificial Sequence
  chemically synthesized
tgctgctgcctcttgtcaagtc

SEQ ID NO: 51151 - DNA, 22 bp, Artificial Sequence
  chemically synthesized
gctgctgcctcttgtcaagtcc

SEQ ID NO: 51152 - DNA, 22 bp, Artificial Sequence
  chemically synthesized
ctgctgcctcttgtcaagtccg

SEQ ID NO: 51153 - DNA, 22 bp, Artificial Sequence
  chemically synthesized
ctgcctcttgtcaagtccgaac

SEQ ID NO: 51154 - DNA, 22 bp, Artificial Sequence
  chemically synthesized
cctcttgtcaagtccgaactcc

SEQ ID NO: 51155 - DNA, 22 bp, Artificial Sequence
  chemically synthesized
ttgtcaagtccgaactccttag

SEQ ID NO: 51156 - DNA, 22 bp, Artificial Sequence
  chemically synthesized
gtcaagtccgaactccttagca

SEQ ID NO: 51157 - DNA, 22 bp, Artificial Sequence
  chemically synthesized
tcaagtccgaactccttagcat

SEQ ID NO: 51158 - DNA, 22 bp, Artificial Sequence
  chemically synthesized
cttagcatggcattcaaggcct

SEQ ID NO: 51159 - DNA, 22 bp, Artificial Sequence
  chemically synthesized
agcatggcattcaaggcctccc

SEQ ID NO: 51160 - DNA, 22 bp, Artificial Sequence
  chemically synthesized
gcatggcattcaaggcctcccg

SEQ ID NO: 51161 - DNA, 22 bp, Artificial Sequence
  chemically synthesized
aaggcctcccgggtctgaccat

SEQ ID NO: 51162 - DNA, 22 bp, Artificial Sequence
  chemically synthesized
ccgggtctgaccattccccttt

SEQ ID NO: 51163 - DNA, 22 bp, Artificial Sequence
  chemically synthesized
accattcccctttcagaggctg

SEQ ID NO: 51164 - DNA, 22 bp, Artificial Sequence
  chemically synthesized
ccctttcagaggctgatgtccc

SEQ ID NO: 51165 - DNA, 22 bp, Artificial Sequence
  chemically synthesized
tcagaggctgatgtcccctggg

SEQ ID NO: 51166 - DNA, 22 bp, Artificial Sequence
  chemically synthesized
cagaggctgatgtcccctgggt

SEQ ID NO: 51167 - DNA, 22 bp, Artificial Sequence
  chemically synthesized
agaggctgatgtcccctgggtg

SEQ ID NO: 51168 - DNA, 22 bp, Artificial Sequence
  chemically synthesized
atgtcccctgggtgccctggga

SEQ ID NO: 51169 - DNA, 22 bp, Artificial Sequence
  chemically synthesized
ggtgccctgggagctgtagatg

SEQ ID NO: 51170 - DNA, 22 bp, Artificial Sequence
  chemically synthesized
ggagctgtagatgtcctgccaa

SEQ ID NO: 51171 - DNA, 22 bp, Artificial Sequence
  chemically synthesized
tagatgtcctgccaaggaagcg

SEQ ID NO: 51172 - DNA, 22 bp, Artificial Sequence
  chemically synthesized
ccaaggaagcggtgccatcgag

SEQ ID NO: 51173 - DNA, 22 bp, Artificial Sequence
  chemically synthesized
gaagccagacttcttggatcca

SEQ ID NO: 51174 - DNA, 22 bp, Artificial Sequence
  chemically synthesized
aagccagacttcttggatccaa

SEQ ID NO: 51175 - DNA, 22 bp, Artificial Sequence
  chemically synthesized
cttggatccaagtcctggccgg

SEQ ID NO: 51176 - DNA, 22 bp, Artificial Sequence
  chemically synthesized
ttggatccaagtcctggccggc

SEQ ID NO: 51177 - DNA, 22 bp, Artificial Sequence
  chemically synthesized
ggatccaagtcctggccggctc

SEQ ID NO: 51178 - DNA, 22 bp, Artificial Sequence
  chemically synthesized
gatccaagtcctggccggctcc

SEQ ID NO: 51179 - DNA, 22 bp, Artificial Sequence
  chemically synthesized
gccggctcctcaccagggaggg

SEQ ID NO: 51180 - DNA, 22 bp, Artificial Sequence
  chemically synthesized
ctcaccagggagggggtcatca

SEQ ID NO: 51181 - DNA, 22 bp, Artificial Sequence
  chemically synthesized
accagggagggggtcatcacag

SEQ ID NO: 51182 - DNA, 22 bp, Artificial Sequence
  chemically synthesized
gcctgggagggtcaaatgaggg

SEQ ID NO: 51183 - DNA, 22 bp, Artificial Sequence
  chemically synthesized
cctgggagggtcaaatgagggt

SEQ ID NO: 51184 - DNA, 22 bp, Artificial Sequence
  chemically synthesized
ggagggtcaaatgagggtcagc

SEQ ID NO: 51185 - DNA, 22 bp, Artificial Sequence
  chemically synthesized
agtaccagtggcagatgttgca

SEQ ID NO: 51186 - DNA, 22 bp, Artificial Sequence
  chemically synthesized
cacacatcctgctatggggcag

SEQ ID NO: 51187 - DNA, 22 bp, Artificial Sequence
  chemically synthesized
ctatggggcagtggctgacgcc

SEQ ID NO: 51188 - DNA, 22 bp, Artificial Sequence
  chemically synthesized
tggggcagtggctgacgccaca

SEQ ID NO: 51189 - DNA, 22 bp, Artificial Sequence
  chemically synthesized
acgccacactccccgacctcct

SEQ ID NO: 51190 - DNA, 22 bp, Artificial Sequence
  chemically synthesized
cccgacctcctgaggtggggcc

SEQ ID NO: 51191 - DNA, 22 bp, Artificial Sequence
  chemically synthesized
ctgaggtggggcccccttcata

SEQ ID NO: 51192 - DNA, 22 bp, Artificial Sequence
  chemically synthesized
aggtggggcccccttcatactc

SEQ ID NO: 51193 - DNA, 22 bp, Artificial Sequence
  chemically synthesized
catactctaacttctgcctgcc

SEQ ID NO: 51194 - DNA, 22 bp, Artificial Sequence
  chemically synthesized
atactctaacttctgcctgcca

SEQ ID NO: 51195 - DNA, 22 bp, Artificial Sequence
  chemically synthesized
taacttctgcctgccattcatg

SEQ ID NO: 51196 - DNA, 22 bp, Artificial Sequence
  chemically synthesized
acttctgcctgccattcatggg

SEQ ID NO: 51197 - DNA, 22 bp, Artificial Sequence
  chemically synthesized
ctgcctgccattcatggggcat

SEQ ID NO: 51198 - DNA, 22 bp, Artificial Sequence
  chemically synthesized
tgcctgccattcatggggcatt

SEQ ID NO: 51199 - DNA, 22 bp, Artificial Sequence
  chemically synthesized
cctgccattcatggggcatttg

SEQ ID NO: 51200 - DNA, 22 bp, Artificial Sequence
  chemically synthesized
ccattcatggggcatttgtcac

SEQ ID NO: 51201 - DNA, 22 bp, Artificial Sequence
  chemically synthesized
atggggcatttgtcacactgtt

SEQ ID NO: 51202 - DNA, 22 bp, Artificial Sequence
  chemically synthesized
gtcacactgttggggcttccac

SEQ ID NO: 51203 - DNA, 22 bp, Artificial Sequence
  chemically synthesized
tcacactgttggggcttccacg

SEQ ID NO: 51204 - DNA, 22 bp, Artificial Sequence
  chemically synthesized
ttggggcttccacgtttagttt

SEQ ID NO: 51205 - DNA, 22 bp, Artificial Sequence
  chemically synthesized
gggcttccacgtttagttttct

SEQ ID NO: 51206 - DNA, 22 bp, Artificial Sequence
  chemically synthesized
ccacgtttagttttctctcccc

SEQ ID NO: 51207 - DNA, 22 bp, Artificial Sequence
  chemically synthesized
cacgtttagttttctctcccca

SEQ ID NO: 51208 - DNA, 22 bp, Artificial Sequence
  chemically synthesized
agttttctctccccataagcta

SEQ ID NO: 51209 - DNA, 22 bp, Artificial Sequence
  chemically synthesized
gttttctctccccataagctag

SEQ ID NO: 51210 - DNA, 22 bp, Artificial Sequence
  chemically synthesized
tctctccccataagctagcaat

SEQ ID NO: 51211 - DNA, 22 bp, Artificial Sequence
  chemically synthesized
ctctccccataagctagcaatt

SEQ ID NO: 51212 - DNA, 22 bp, Artificial Sequence
  chemically synthesized
tctccccataagctagcaattc

SEQ ID NO: 51213 - DNA, 22 bp, Artificial Sequence
  chemically synthesized
tccccataagctagcaattcct

SEQ ID NO: 51214 - DNA, 22 bp, Artificial Sequence
  chemically synthesized
cccataagctagcaattccttg

SEQ ID NO: 51215 - DNA, 22 bp, Artificial Sequence
  chemically synthesized
gcaattccttgagagaggaccc

SEQ ID NO: 51216 - DNA, 22 bp, Artificial Sequence
  chemically synthesized
cttgagagaggaccccacgtta

SEQ ID NO: 51217 - DNA, 22 bp, Artificial Sequence
  chemically synthesized
gagagaggaccccacgttactt

SEQ ID NO: 51218 - DNA, 22 bp, Artificial Sequence
  chemically synthesized
agagaggaccccacgttacttg

SEQ ID NO: 51219 - DNA, 22 bp, Artificial Sequence
  chemically synthesized
cttgcctttatccccgcacaga

SEQ ID NO: 51220 - DNA, 22 bp, Artificial Sequence
  chemically synthesized
gcctttatccccgcacagagca

SEQ ID NO: 51221 - DNA, 22 bp, Artificial Sequence
  chemically synthesized
cctttatccccgcacagagcac

SEQ ID NO: 51222 - DNA, 22 bp, Artificial Sequence
  chemically synthesized
tatccccgcacagagcacttca

SEQ ID NO: 51223 - DNA, 22 bp, Artificial Sequence
  chemically synthesized
atccccgcacagagcacttcac

SEQ ID NO: 51224 - DNA, 22 bp, Artificial Sequence
  chemically synthesized
tccccgcacagagcacttcaca

SEQ ID NO: 51225 - DNA, 22 bp, Artificial Sequence
  chemically synthesized
cacaggctgtgcaaggtaatgc

SEQ ID NO: 51226 - DNA, 22 bp, Artificial Sequence
  chemically synthesized
acaggctgtgcaaggtaatgct

SEQ ID NO: 51227 - DNA, 22 bp, Artificial Sequence
  chemically synthesized
tgcaaggtaatgctccactgag

SEQ ID NO: 51228 - DNA, 22 bp, Artificial Sequence
  chemically synthesized
cactgaggacacattctcgcct

SEQ ID NO: 51229 - DNA, 22 bp, Artificial Sequence
  chemically synthesized
aggacacattctcgcctatggg

SEQ ID NO: 51230 - DNA, 22 bp, Artificial Sequence
  chemically synthesized
tcgcctatgggaactctggagg

SEQ ID NO: 51231 - DNA, 22 bp, Artificial Sequence
  chemically synthesized
gcctatgggaactctggaggca

SEQ ID NO: 51232 - DNA, 22 bp, Artificial Sequence
  chemically synthesized
tgggaactctggaggcagggct

SEQ ID NO: 51233 - DNA, 22 bp, Artificial Sequence
  chemically synthesized
tggaggcagggctttgtggagg

SEQ ID NO: 51234 - DNA, 22 bp, Artificial Sequence
  chemically synthesized
gaggcagggctttgtggagggg

SEQ ID NO: 51235 - DNA, 22 bp, Artificial Sequence
  chemically synthesized
tgtggaggggctgccacaggct

SEQ ID NO: 51236 - DNA, 22 bp, Artificial Sequence
  chemically synthesized
gtggaggggctgccacaggctt

SEQ ID NO: 51237 - DNA, 22 bp, Artificial Sequence
  chemically synthesized
tggaggggctgccacaggctta

SEQ ID NO: 51238 - DNA, 22 bp, Artificial Sequence
  chemically synthesized
ccacaggcttatgttgcctcct

SEQ ID NO: 51239 - DNA, 22 bp, Artificial Sequence
  chemically synthesized
atgttgcctcctaggatttccc

SEQ ID NO: 51240 - DNA, 22 bp, Artificial Sequence
  chemically synthesized
tgttgcctcctaggatttccca

SEQ ID NO: 51241 - DNA, 22 bp, Artificial Sequence
  chemically synthesized
cctcctaggatttcccatgggc

SEQ ID NO: 51242 - DNA, 22 bp, Artificial Sequence
  chemically synthesized
ctaggatttcccatgggccaag

SEQ ID NO: 51243 - DNA, 22 bp, Artificial Sequence
  chemically synthesized
ggatttcccatgggccaagagg

SEQ ID NO: 51244 - DNA, 22 bp, Artificial Sequence
  chemically synthesized
cccatgggccaagagggaaaat

SEQ ID NO: 51245 - DNA, 22 bp, Artificial Sequence
  chemically synthesized
ccatgggccaagagggaaaatg

SEQ ID NO: 51246 - DNA, 22 bp, Artificial Sequence
  chemically synthesized
gggtggccatccctggtggccc

SEQ ID NO: 51247 - DNA, 22 bp, Artificial Sequence
  chemically synthesized
gtggcccctcctcatgcatcct

SEQ ID NO: 51248 - DNA, 22 bp, Artificial Sequence
  chemically synthesized
ctcatgcatcctggagagctgt

SEQ ID NO: 51249 - DNA, 22 bp, Artificial Sequence
  chemically synthesized
atgcatcctggagagctgtggg

SEQ ID NO: 51250 - DNA, 22 bp, Artificial Sequence
  chemically synthesized
gagagctgtgggcctcctctcc

SEQ ID NO: 51251 - DNA, 22 bp, Artificial Sequence
  chemically synthesized
tgggcctcctctccacaggctt

SEQ ID NO: 51252 - DNA, 22 bp, Artificial Sequence
  chemically synthesized
ctctccacaggctttgtggatc

SEQ ID NO: 51253 - DNA, 22 bp, Artificial Sequence
  chemically synthesized
tccacaggctttgtggatcttc

SEQ ID NO: 51254 - DNA, 22 bp, Artificial Sequence
  chemically synthesized
cacaggctttgtggatcttctt

SEQ ID NO: 51255 - DNA, 22 bp, Artificial Sequence
  chemically synthesized
tgtggatcttcttcagagccag

SEQ ID NO: 51256 - DNA, 22 bp, Artificial Sequence
  chemically synthesized
gtggatcttcttcagagccagt

SEQ ID NO: 51257 - DNA, 22 bp, Artificial Sequence
  chemically synthesized
tggatcttcttcagagccagtg

SEQ ID NO: 51258 - DNA, 22 bp, Artificial Sequence
  chemically synthesized
cttcagagccagtgagtcagcc

SEQ ID NO: 51259 - DNA, 22 bp, Artificial Sequence
  chemically synthesized
ttcagagccagtgagtcagcct

SEQ ID NO: 51260 - DNA, 22 bp, Artificial Sequence
  chemically synthesized
cagagccagtgagtcagccttg

SEQ ID NO: 51261 - DNA, 22 bp, Artificial Sequence
  chemically synthesized
agagccagtgagtcagccttgc

SEQ ID NO: 51262 - DNA, 22 bp, Artificial Sequence
  chemically synthesized
gctgtggtggcccacaaggagt

SEQ ID NO: 51263 - DNA, 22 bp, Artificial Sequence
  chemically synthesized
ctgtggtggcccacaaggagtg

SEQ ID NO: 51264 - DNA, 22 bp, Artificial Sequence
  chemically synthesized
tggtggcccacaaggagtggag

SEQ ID NO: 51265 - DNA, 22 bp, Artificial Sequence
  chemically synthesized
ggggacagggcaaaagctcatg

SEQ ID NO: 51266 - DNA, 22 bp, Artificial Sequence
  chemically synthesized
gggacagggcaaaagctcatgt

SEQ ID NO: 51267 - DNA, 22 bp, Artificial Sequence
  chemically synthesized
atgtgatagggatgctgtctct

SEQ ID NO: 51268 - DNA, 22 bp, Artificial Sequence
  chemically synthesized
tctctgcaaccacatggatttt

SEQ ID NO: 51269 - DNA, 22 bp, Artificial Sequence
  chemically synthesized
tgcaaccacatggattttaata

SEQ ID NO: 51270 - DNA, 22 bp, Artificial Sequence
  chemically synthesized
caaccacatggattttaatagt

SEQ ID NO: 51271 - DNA, 22 bp, Artificial Sequence
  chemically synthesized
taatagttacccatggctggct

SEQ ID NO: 51272 - DNA, 22 bp, Artificial Sequence
  chemically synthesized
aatagttacccatggctggctt

SEQ ID NO: 51273 - DNA, 22 bp, Artificial Sequence
  chemically synthesized
atagttacccatggctggcttc

SEQ ID NO: 51274 - DNA, 22 bp, Artificial Sequence
  chemically synthesized
cccatggctggcttcagctttt

SEQ ID NO: 51275 - DNA, 22 bp, Artificial Sequence
  chemically synthesized
gcttcagctttttttgtgaatg

SEQ ID NO: 51276 - DNA, 22 bp, Artificial Sequence
  chemically synthesized
cagctttttttgtgaatggcag

SEQ ID NO: 51277 - DNA, 22 bp, Artificial Sequence
  chemically synthesized
agctttttttgtgaatggcagc

SEQ ID NO: 51278 - DNA, 22 bp, Artificial Sequence
  chemically synthesized
tttttgtgaatggcagccaaaa

SEQ ID NO: 51279 - DNA, 22 bp, Artificial Sequence
  chemically synthesized
ttttgtgaatggcagccaaaaa

SEQ ID NO: 51280 - DNA, 22 bp, Artificial Sequence
  chemically synthesized
tttgtgaatggcagccaaaaag

SEQ ID NO: 51281 - DNA, 22 bp, Artificial Sequence
  chemically synthesized
ttgtgaatggcagccaaaaagt

SEQ ID NO: 51282 - DNA, 22 bp, Artificial Sequence
  chemically synthesized
tgtgaatggcagccaaaaagtg

SEQ ID NO: 51283 - DNA, 22 bp, Artificial Sequence
  chemically synthesized
gtgaatggcagccaaaaagtgt

SEQ ID NO: 51284 - DNA, 22 bp, Artificial Sequence
  chemically synthesized
tgaatggcagccaaaaagtgtg

SEQ ID NO: 51285 - DNA, 22 bp, Artificial Sequence
  chemically synthesized
agtggagacagaggggagactg

SEQ ID NO: 51286 - DNA, 22 bp, Artificial Sequence
  chemically synthesized
ttgaatttgtggagtttttagt

SEQ ID NO: 51287 - DNA, 22 bp, Artificial Sequence
  chemically synthesized
aatttgtggagtttttagttct

SEQ ID NO: 51288 - DNA, 22 bp, Artificial Sequence
  chemically synthesized
gtggagtttttagttcttccta

SEQ ID NO: 51289 - DNA, 22 bp, Artificial Sequence
  chemically synthesized
tggagtttttagttcttcctaa

SEQ ID NO: 51290 - DNA, 22 bp, Artificial Sequence
  chemically synthesized
ttagttcttcctaaacagagag

SEQ ID NO: 51291 - DNA, 22 bp, Artificial Sequence
  chemically synthesized
tagttcttcctaaacagagagc

SEQ ID NO: 51292 - DNA, 22 bp, Artificial Sequence
  chemically synthesized
agttcttcctaaacagagagca

SEQ ID NO: 51293 - DNA, 22 bp, Artificial Sequence
  chemically synthesized
gttcttcctaaacagagagcaa

SEQ ID NO: 51294 - DNA, 22 bp, Artificial Sequence
  chemically synthesized
ttcctaaacagagagcaacaga

SEQ ID NO: 51295 - DNA, 22 bp, Artificial Sequence
  chemically synthesized
cctaaacagagagcaacagaca

SEQ ID NO: 51296 - DNA, 22 bp, Artificial Sequence
  chemically synthesized
ctaaacagagagcaacagacaa

SEQ ID NO: 51297 - DNA, 22 bp, Artificial Sequence
  chemically synthesized
aacagagagcaacagacaagag

SEQ ID NO: 51298 - DNA, 22 bp, Artificial Sequence
  chemically synthesized
cagacaaattaattcttttcgt

SEQ ID NO: 51299 - DNA, 22 bp, Artificial Sequence
  chemically synthesized
attcttttcgttaatttaccct

SEQ ID NO: 51300 - DNA, 22 bp, Artificial Sequence
  chemically synthesized
ttttcgttaatttaccctcaac

SEQ ID NO: 51301 - DNA, 22 bp, Artificial Sequence
  chemically synthesized
ttcgttaatttaccctcaacta

SEQ ID NO: 51302 - DNA, 22 bp, Artificial Sequence
  chemically synthesized
tcgttaatttaccctcaactac

SEQ ID NO: 51303 - DNA, 22 bp, Artificial Sequence
  chemically synthesized
cgttaatttaccctcaactact

SEQ ID NO: 51304 - DNA, 22 bp, Artificial Sequence
  chemically synthesized
gttaatttaccctcaactactg

SEQ ID NO: 51305 - DNA, 22 bp, Artificial Sequence
  chemically synthesized
atttaccctcaactactggcca

SEQ ID NO: 51306 - DNA, 22 bp, Artificial Sequence
  chemically synthesized
accctcaactactggccaagaa

SEQ ID NO: 51307 - DNA, 22 bp, Artificial Sequence
  chemically synthesized
ccctcaactactggccaagaag

SEQ ID NO: 51308 - DNA, 22 bp, Artificial Sequence
  chemically synthesized
aactactggccaagaaggggtg

SEQ ID NO: 51309 - DNA, 22 bp, Artificial Sequence
  chemically synthesized
ctggccaagaaggggtgtaact

SEQ ID NO: 51310 - DNA, 22 bp, Artificial Sequence
  chemically synthesized
gccaagaaggggtgtaactcag

SEQ ID NO: 51311 - DNA, 22 bp, Artificial Sequence
  chemically synthesized
agaatgttttcttcttttgtgc

SEQ ID NO: 51312 - DNA, 22 bp, Artificial Sequence
  chemically synthesized
tcttcttttgtgccctgagtag

SEQ ID NO: 51313 - DNA, 22 bp, Artificial Sequence
  chemically synthesized
cttcttttgtgccctgagtagc

SEQ ID NO: 51314 - DNA, 22 bp, Artificial Sequence
  chemically synthesized
ttcttttgtgccctgagtagca

SEQ ID NO: 51315 - DNA, 22 bp, Artificial Sequence
  chemically synthesized
cttttgtgccctgagtagcaga

SEQ ID NO: 51316 - DNA, 22 bp, Artificial Sequence
  chemically synthesized
ttttgtgccctgagtagcagac

SEQ ID NO: 51317 - DNA, 22 bp, Artificial Sequence
  chemically synthesized
ttgtgccctgagtagcagaccc

SEQ ID NO: 51318 - DNA, 22 bp, Artificial Sequence
  chemically synthesized
tgtgccctgagtagcagaccca

SEQ ID NO: 51319 - DNA, 22 bp, Artificial Sequence
  chemically synthesized
gtgccctgagtagcagacccag

SEQ ID NO: 51320 - DNA, 22 bp, Artificial Sequence
  chemically synthesized
tgccctgagtagcagacccaga

SEQ ID NO: 51321 - DNA, 22 bp, Artificial Sequence
  chemically synthesized
agtagcagacccagagtctgga

SEQ ID NO: 51322 - DNA, 22 bp, Artificial Sequence
  chemically synthesized
gagacccagattctaggcctgg

SEQ ID NO: 51323 - DNA, 22 bp, Artificial Sequence
  chemically synthesized
taggcctggcttggccaacgac

SEQ ID NO: 51324 - DNA, 22 bp, Artificial Sequence
  chemically synthesized
ggcctggcttggccaacgacaa

SEQ ID NO: 51325 - DNA, 22 bp, Artificial Sequence
  chemically synthesized
gcttggccaacgacaagcaggg

SEQ ID NO: 51326 - DNA, 22 bp, Artificial Sequence
  chemically synthesized
ggccaacgacaagcagggtgac

SEQ ID NO: 51327 - DNA, 22 bp, Artificial Sequence
  chemically synthesized
gccaacgacaagcagggtgacc

SEQ ID NO: 51328 - DNA, 22 bp, Artificial Sequence
  chemically synthesized
gggttaaaaaaaaaaaaaggca

SEQ ID NO: 51329 - DNA, 22 bp, Artificial Sequence
  chemically synthesized
ggttaaaaaaaaaaaaaggcat

SEQ ID NO: 51330 - DNA, 22 bp, Artificial Sequence
  chemically synthesized
aaaaaaaaaaaaggcatcattc

SEQ ID NO: 51331 - DNA, 22 bp, Artificial Sequence
  chemically synthesized
tctgagtctcactccctcttct

SEQ ID NO: 51332 - DNA, 22 bp, Artificial Sequence
  chemically synthesized
tgagtctcactccctcttctca

SEQ ID NO: 51333 - DNA, 22 bp, Artificial Sequence
  chemically synthesized
agtctcactccctcttctcaaa

SEQ ID NO: 51334 - DNA, 22 bp, Artificial Sequence
  chemically synthesized
actccctcttctcaaaaagatg

SEQ ID NO: 51335 - DNA, 22 bp, Artificial Sequence
  chemically synthesized
cctcttctcaaaaagatggcaa

SEQ ID NO: 51336 - DNA, 22 bp, Artificial Sequence
  chemically synthesized
ttctcaaaaagatggcaattcc

SEQ ID NO: 51337 - DNA, 22 bp, Artificial Sequence
  chemically synthesized
ctcaaaaagatggcaattcctc

SEQ ID NO: 51338 - DNA, 22 bp, Artificial Sequence
  chemically synthesized
tcaaaaagatggcaattcctcc

SEQ ID NO: 51339 - DNA, 22 bp, Artificial Sequence
  chemically synthesized
aaaaagatggcaattcctcccc

SEQ ID NO: 51340 - DNA, 22 bp, Artificial Sequence
  chemically synthesized
ctcccccgctggttttccatag

SEQ ID NO: 51341 - DNA, 22 bp, Artificial Sequence
  chemically synthesized
ccccgctggttttccatagttg

SEQ ID NO: 51342 - DNA, 22 bp, Artificial Sequence
  chemically synthesized
gttttccatagttgaggtagca

SEQ ID NO: 51343 - DNA, 22 bp, Artificial Sequence
  chemically synthesized
tccatagttgaggtagcaagcc

SEQ ID NO: 51344 - DNA, 22 bp, Artificial Sequence
  chemically synthesized
ccatagttgaggtagcaagcca

SEQ ID NO: 51345 - DNA, 22 bp, Artificial Sequence
  chemically synthesized
catagttgaggtagcaagccaa

SEQ ID NO: 51346 - DNA, 22 bp, Artificial Sequence
  chemically synthesized
aggtagcaagccaatgtgttgg

SEQ ID NO: 51347 - DNA, 22 bp, Artificial Sequence
  chemically synthesized
gggtagctgaaaacgccctgtg

SEQ ID NO: 51348 - DNA, 22 bp, Artificial Sequence
  chemically synthesized
aaaacgccctgtgcatactgag

SEQ ID NO: 51349 - DNA, 22 bp, Artificial Sequence
  chemically synthesized
tgcatactgaggcttatgttcc

SEQ ID NO: 51350 - DNA, 22 bp, Artificial Sequence
  chemically synthesized
aggcttatgttccatggggggc

SEQ ID NO: 51351 - DNA, 22 bp, Artificial Sequence
  chemically synthesized
atgttccatggggggccagggg

SEQ ID NO: 51352 - DNA, 22 bp, Artificial Sequence
  chemically synthesized
tgttccatggggggccaggggc

SEQ ID NO: 51353 - DNA, 22 bp, Artificial Sequence
  chemically synthesized
catggggggccaggggccagga

SEQ ID NO: 51354 - DNA, 22 bp, Artificial Sequence
  chemically synthesized
tcatctccagctgggaggtgat

SEQ ID NO: 51355 - DNA, 22 bp, Artificial Sequence
  chemically synthesized
cagctgggaggtgatggccatg

SEQ ID NO: 51356 - DNA, 22 bp, Artificial Sequence
  chemically synthesized
ggaggtgatggccatgcctgca

SEQ ID NO: 51357 - DNA, 22 bp, Artificial Sequence
  chemically synthesized
cacccctctggccagcagaggg

SEQ ID NO: 51358 - DNA, 22 bp, Artificial Sequence
  chemically synthesized
tggccagcagagggtggtcagt

SEQ ID NO: 51359 - DNA, 22 bp, Artificial Sequence
  chemically synthesized
gccagcagagggtggtcagtag

SEQ ID NO: 51360 - DNA, 22 bp, Artificial Sequence
  chemically synthesized
ggaggccattagggcaaccttc

SEQ ID NO: 51361 - DNA, 22 bp, Artificial Sequence
  chemically synthesized
gggcaaccttctattggctcag

SEQ ID NO: 51362 - DNA, 22 bp, Artificial Sequence
  chemically synthesized
ctattggctcagactcagaatg

SEQ ID NO: 51363 - DNA, 22 bp, Artificial Sequence
  chemically synthesized
tattggctcagactcagaatgc

SEQ ID NO: 51364 - DNA, 22 bp, Artificial Sequence
  chemically synthesized
ttggctcagactcagaatgcag

SEQ ID NO: 51365 - DNA, 22 bp, Artificial Sequence
  chemically synthesized
gctcagactcagaatgcagtag

SEQ ID NO: 51366 - DNA, 22 bp, Artificial Sequence
  chemically synthesized
agactcagaatgcagtagaact

SEQ ID NO: 51367 - DNA, 22 bp, Artificial Sequence
  chemically synthesized
agaatgcagtagaacttgtgcc

SEQ ID NO: 51368 - DNA, 22 bp, Artificial Sequence
  chemically synthesized
gtgccctgtagtgttcatggac

SEQ ID NO: 51369 - DNA, 22 bp, Artificial Sequence
  chemically synthesized
tgccctgtagtgttcatggaca

SEQ ID NO: 51370 - DNA, 22 bp, Artificial Sequence
  chemically synthesized
tagtgttcatggacaggagtga

SEQ ID NO: 51371 - DNA, 22 bp, Artificial Sequence
  chemically synthesized
atggacaggagtgagaggagga

SEQ ID NO: 51372 - DNA, 22 bp, Artificial Sequence
  chemically synthesized
aggggatgtggctgtcaaggcc

SEQ ID NO: 51373 - DNA, 22 bp, Artificial Sequence
  chemically synthesized
tcaaggcctttctaggggcgat

SEQ ID NO: 51374 - DNA, 22 bp, Artificial Sequence
  chemically synthesized
tctaggggcgatgctgtctctc

SEQ ID NO: 51375 - DNA, 22 bp, Artificial Sequence
  chemically synthesized
ctaggggcgatgctgtctctcc

SEQ ID NO: 51376 - DNA, 22 bp, Artificial Sequence
  chemically synthesized
taggggcgatgctgtctctccc

SEQ ID NO: 51377 - DNA, 22 bp, Artificial Sequence
  chemically synthesized
ggggcgatgctgtctctccctc

SEQ ID NO: 51378 - DNA, 22 bp, Artificial Sequence
  chemically synthesized
tctctccctcagcatagggagt

SEQ ID NO: 51379 - DNA, 22 bp, Artificial Sequence
  chemically synthesized
tccctcagcatagggagtgggc

SEQ ID NO: 51380 - DNA, 22 bp, Artificial Sequence
  chemically synthesized
cctcagcatagggagtgggccc

SEQ ID NO: 51381 - DNA, 22 bp, Artificial Sequence
  chemically synthesized
agcatagggagtgggcccttcc

SEQ ID NO: 51382 - DNA, 22 bp, Artificial Sequence
  chemically synthesized
ccacctctggcctctctccccc

SEQ ID NO: 51383 - DNA, 22 bp, Artificial Sequence
  chemically synthesized
cacctctggcctctctccccca

SEQ ID NO: 51384 - DNA, 22 bp, Artificial Sequence
  chemically synthesized
tggcctctctcccccagggctg

SEQ ID NO: 51385 - DNA, 22 bp, Artificial Sequence
  chemically synthesized
gcctctctcccccagggctgtg

SEQ ID NO: 51386 - DNA, 22 bp, Artificial Sequence
  chemically synthesized
tctcccccagggctgtgtctgg

SEQ ID NO: 51387 - DNA, 22 bp, Artificial Sequence
  chemically synthesized
tcccccagggctgtgtctggct

SEQ ID NO: 51388 - DNA, 22 bp, Artificial Sequence
  chemically synthesized
ccccagggctgtgtctggctgt

SEQ ID NO: 51389 - DNA, 22 bp, Artificial Sequence
  chemically synthesized
tgtctggctgtccctgataaaa

SEQ ID NO: 51390 - DNA, 22 bp, Artificial Sequence
  chemically synthesized
gctgtccctgataaaactgtga

SEQ ID NO: 51391 - DNA, 22 bp, Artificial Sequence
  chemically synthesized
tccctgataaaactgtgagatg

SEQ ID NO: 51392 - DNA, 22 bp, Artificial Sequence
  chemically synthesized
ataaaactgtgagatggtgtgc

SEQ ID NO: 51393 - DNA, 22 bp, Artificial Sequence
  chemically synthesized
tgagatggtgtgcagtgtcgga

SEQ ID NO: 51394 - DNA, 22 bp, Artificial Sequence
  chemically synthesized
agtgccagagtttccgcgacca

SEQ ID NO: 51395 - DNA, 22 bp, Artificial Sequence
  chemically synthesized
ccgcgaccatatgaaaagcgtc

SEQ ID NO: 51396 - DNA, 22 bp, Artificial Sequence
  chemically synthesized
cgcgaccatatgaaaagcgtca

SEQ ID NO: 51397 - DNA, 22 bp, Artificial Sequence
  chemically synthesized
catccgatggtcccagtgttgc

SEQ ID NO: 51398 - DNA, 22 bp, Artificial Sequence
  chemically synthesized
cttgtgtgaagaaagcctccta

SEQ ID NO: 51399 - DNA, 22 bp, Artificial Sequence
  chemically synthesized
gtgtgaagaaagcctcctacct

SEQ ID NO: 51400 - DNA, 22 bp, Artificial Sequence
  chemically synthesized
tgtgaagaaagcctcctacctt

SEQ ID NO: 51401 - DNA, 22 bp, Artificial Sequence
  chemically synthesized
ctaccttgattgcatcagggcc

SEQ ID NO: 51402 - DNA, 22 bp, Artificial Sequence
  chemically synthesized
ccttgattgcatcagggccatt

SEQ ID NO: 51403 - DNA, 22 bp, Artificial Sequence
  chemically synthesized
atgcaatcaaggtaggaggctt

SEQ ID NO: 51404 - DNA, 22 bp, Artificial Sequence
  chemically synthesized
tcttcacacaagcaacactggg

SEQ ID NO: 51405 - DNA, 22 bp, Artificial Sequence
  chemically synthesized
cttcacacaagcaacactggga

SEQ ID NO: 51406 - DNA, 22 bp, Artificial Sequence
  chemically synthesized
ttcacacaagcaacactgggac

SEQ ID NO: 51407 - DNA, 22 bp, Artificial Sequence
  chemically synthesized
cacacaagcaacactgggacca

SEQ ID NO: 51408 - DNA, 22 bp, Artificial Sequence
  chemically synthesized
acacaagcaacactgggaccat

SEQ ID NO: 51409 - DNA, 22 bp, Artificial Sequence
  chemically synthesized
ggaccatcggatggaatgacgc

SEQ ID NO: 51410 - DNA, 22 bp, Artificial Sequence
  chemically synthesized
ttcatatggtcgcggaaactct

SEQ ID NO: 51411 - DNA, 22 bp, Artificial Sequence
  chemically synthesized
tcatatggtcgcggaaactctg

SEQ ID NO: 51412 - DNA, 22 bp, Artificial Sequence
  chemically synthesized
catatggtcgcggaaactctgg

SEQ ID NO: 51413 - DNA, 22 bp, Artificial Sequence
  chemically synthesized
atatggtcgcggaaactctggc

SEQ ID NO: 51414 - DNA, 22 bp, Artificial Sequence
  chemically synthesized
tggcacttagtggcctcatgct

SEQ ID NO: 51415 - DNA, 22 bp, Artificial Sequence
  chemically synthesized
gcacttagtggcctcatgctcc

SEQ ID NO: 51416 - DNA, 22 bp, Artificial Sequence
  chemically synthesized
agtggcctcatgctccgacact

SEQ ID NO: 51417 - DNA, 22 bp, Artificial Sequence
  chemically synthesized
gtggcctcatgctccgacactg

SEQ ID NO: 51418 - DNA, 22 bp, Artificial Sequence
  chemically synthesized
atgctccgacactgcacaccat

SEQ ID NO: 51419 - DNA, 22 bp, Artificial Sequence
  chemically synthesized
cgacactgcacaccatctcaca

SEQ ID NO: 51420 - DNA, 22 bp, Artificial Sequence
  chemically synthesized
cacaccatctcacagttttatc

SEQ ID NO: 51421 - DNA, 22 bp, Artificial Sequence
  chemically synthesized
acagttttatcagggacagcca

SEQ ID NO: 51422 - DNA, 22 bp, Artificial Sequence
  chemically synthesized
tatcagggacagccagacacag

SEQ ID NO: 51423 - DNA, 22 bp, Artificial Sequence
  chemically synthesized
atcagggacagccagacacagc

SEQ ID NO: 51424 - DNA, 22 bp, Artificial Sequence
  chemically synthesized
tcagggacagccagacacagcc

SEQ ID NO: 51425 - DNA, 22 bp, Artificial Sequence
  chemically synthesized
ggggagagaggccagaggtgga

SEQ ID NO: 51426 - DNA, 22 bp, Artificial Sequence
  chemically synthesized
cctatgctgagggagagacagc

SEQ ID NO: 51427 - DNA, 22 bp, Artificial Sequence
  chemically synthesized
tgctgagggagagacagcatcg

SEQ ID NO: 51428 - DNA, 22 bp, Artificial Sequence
  chemically synthesized
agggagagacagcatcgcccct

SEQ ID NO: 51429 - DNA, 22 bp, Artificial Sequence
  chemically synthesized
gaaaggccttgacagccacatc

SEQ ID NO: 51430 - DNA, 22 bp, Artificial Sequence
  chemically synthesized
gacagccacatcccctcagtcc

SEQ ID NO: 51431 - DNA, 22 bp, Artificial Sequence
  chemically synthesized
acagccacatcccctcagtcct

SEQ ID NO: 51432 - DNA, 22 bp, Artificial Sequence
  chemically synthesized
agtcctgtcctcctctcactcc

SEQ ID NO: 51433 - DNA, 22 bp, Artificial Sequence
  chemically synthesized
tcctcctctcactcctgtccat

SEQ ID NO: 51434 - DNA, 22 bp, Artificial Sequence
  chemically synthesized
ctctcactcctgtccatgaaca

SEQ ID NO: 51435 - DNA, 22 bp, Artificial Sequence
  chemically synthesized
tcactcctgtccatgaacacta

SEQ ID NO: 51436 - DNA, 22 bp, Artificial Sequence
  chemically synthesized
actcctgtccatgaacactaca

SEQ ID NO: 51437 - DNA, 22 bp, Artificial Sequence
  chemically synthesized
ctgtccatgaacactacagggc

SEQ ID NO: 51438 - DNA, 22 bp, Artificial Sequence
  chemically synthesized
tccatgaacactacagggcaca

SEQ ID NO: 51439 - DNA, 22 bp, Artificial Sequence
  chemically synthesized
cagggcacaagttctactgcat

SEQ ID NO: 51440 - DNA, 22 bp, Artificial Sequence
  chemically synthesized
tactgcattctgagtctgagcc

SEQ ID NO: 51441 - DNA, 22 bp, Artificial Sequence
  chemically synthesized
ctgcattctgagtctgagccaa

SEQ ID NO: 51442 - DNA, 22 bp, Artificial Sequence
  chemically synthesized
cattctgagtctgagccaatag

SEQ ID NO: 51443 - DNA, 22 bp, Artificial Sequence
  chemically synthesized
tgagtctgagccaatagaaggt

SEQ ID NO: 51444 - DNA, 22 bp, Artificial Sequence
  chemically synthesized
agtctgagccaatagaaggttg

SEQ ID NO: 51445 - DNA, 22 bp, Artificial Sequence
  chemically synthesized
agccaatagaaggttgccctaa

SEQ ID NO: 51446 - DNA, 22 bp, Artificial Sequence
  chemically synthesized
ccctaatggcctcccagtttcc

SEQ ID NO: 51447 - DNA, 22 bp, Artificial Sequence
  chemically synthesized
atggcctcccagtttcctactg

SEQ ID NO: 51448 - DNA, 22 bp, Artificial Sequence
  chemically synthesized
ccagtttcctactgaccaccct

SEQ ID NO: 51449 - DNA, 22 bp, Artificial Sequence
  chemically synthesized
cctactgaccaccctctgctgg

SEQ ID NO: 51450 - DNA, 22 bp, Artificial Sequence
  chemically synthesized
ctactgaccaccctctgctggc

SEQ ID NO: 51451 - DNA, 22 bp, Artificial Sequence
  chemically synthesized
ctgaccaccctctgctggccag

SEQ ID NO: 51452 - DNA, 22 bp, Artificial Sequence
  chemically synthesized
accaccctctgctggccagagg

SEQ ID NO: 51453 - DNA, 22 bp, Artificial Sequence
  chemically synthesized
tgctggccagaggggtgcaggc

SEQ ID NO: 51454 - DNA, 22 bp, Artificial Sequence
  chemically synthesized
ctggccagaggggtgcaggcat

SEQ ID NO: 51455 - DNA, 22 bp, Artificial Sequence
  chemically synthesized
gccagaggggtgcaggcatggc

SEQ ID NO: 51456 - DNA, 22 bp, Artificial Sequence
  chemically synthesized
ccagctggagatgacaatctgc

SEQ ID NO: 51457 - DNA, 22 bp, Artificial Sequence
  chemically synthesized
gagatgacaatctgctcctctg

SEQ ID NO: 51458 - DNA, 22 bp, Artificial Sequence
  chemically synthesized
ctcctctgtatccgccttgtct

SEQ ID NO: 51459 - DNA, 22 bp, Artificial Sequence
  chemically synthesized
ctctgtatccgccttgtctcct

SEQ ID NO: 51460 - DNA, 22 bp, Artificial Sequence
  chemically synthesized
tgtatccgccttgtctcctccc

SEQ ID NO: 51461 - DNA, 22 bp, Artificial Sequence
  chemically synthesized
tatccgccttgtctcctcccat

SEQ ID NO: 51462 - DNA, 22 bp, Artificial Sequence
  chemically synthesized
gtctcctcccatcactgtcctg

SEQ ID NO: 51463 - DNA, 22 bp, Artificial Sequence
  chemically synthesized
tctcctcccatcactgtcctgg

SEQ ID NO: 51464 - DNA, 22 bp, Artificial Sequence
  chemically synthesized
ctcccatcactgtcctggcccc

SEQ ID NO: 51465 - DNA, 22 bp, Artificial Sequence
  chemically synthesized
ccatcactgtcctggcccctgg

SEQ ID NO: 51466 - DNA, 22 bp, Artificial Sequence
  chemically synthesized
tcctggcccctggccccccatg

SEQ ID NO: 51467 - DNA, 22 bp, Artificial Sequence
  chemically synthesized
gcccctggccccccatggaaca

SEQ ID NO: 51468 - DNA, 22 bp, Artificial Sequence
  chemically synthesized
gccccccatggaacataagcct

SEQ ID NO: 51469 - DNA, 22 bp, Artificial Sequence
  chemically synthesized
agtatgcacagggcgttttcag

SEQ ID NO: 51470 - DNA, 22 bp, Artificial Sequence
  chemically synthesized
tcagctaccccaacacattggc

SEQ ID NO: 51471 - DNA, 22 bp, Artificial Sequence
  chemically synthesized
cagctaccccaacacattggct

SEQ ID NO: 51472 - DNA, 22 bp, Artificial Sequence
  chemically synthesized
agctaccccaacacattggctt

SEQ ID NO: 51473 - DNA, 22 bp, Artificial Sequence
  chemically synthesized
ccccaacacattggcttgctac

SEQ ID NO: 51474 - DNA, 22 bp, Artificial Sequence
  chemically synthesized
gcttgctacctcaactatggaa

SEQ ID NO: 51475 - DNA, 22 bp, Artificial Sequence
  chemically synthesized
gctacctcaactatggaaaacc

SEQ ID NO: 51476 - DNA, 22 bp, Artificial Sequence
  chemically synthesized
ctacctcaactatggaaaacca

SEQ ID NO: 51477 - DNA, 22 bp, Artificial Sequence
  chemically synthesized
cctcaactatggaaaaccagcg

SEQ ID NO: 51478 - DNA, 22 bp, Artificial Sequence
  chemically synthesized
aactatggaaaaccagcggggg

SEQ ID NO: 51479 - DNA, 22 bp, Artificial Sequence
  chemically synthesized
tggaaaaccagcgggggaggaa

SEQ ID NO: 51480 - DNA, 22 bp, Artificial Sequence
  chemically synthesized
ccatctttttgagaagagggag

SEQ ID NO: 51481 - DNA, 22 bp, Artificial Sequence
  chemically synthesized
tttgagaagagggagtgagact

SEQ ID NO: 51482 - DNA, 22 bp, Artificial Sequence
  chemically synthesized
ttgagaagagggagtgagactc

SEQ ID NO: 51483 - DNA, 22 bp, Artificial Sequence
  chemically synthesized
tgagaagagggagtgagactca

SEQ ID NO: 51484 - DNA, 22 bp, Artificial Sequence
  chemically synthesized
gagaagagggagtgagactcag

SEQ ID NO: 51485 - DNA, 22 bp, Artificial Sequence
  chemically synthesized
agaagagggagtgagactcaga

SEQ ID NO: 51486 - DNA, 22 bp, Artificial Sequence
  chemically synthesized
agagaatgatgccttttttttt

SEQ ID NO: 51487 - DNA, 22 bp, Artificial Sequence
  chemically synthesized
tttttttttttaacccaaggtc

SEQ ID NO: 51488 - DNA, 22 bp, Artificial Sequence
  chemically synthesized
ttttttttttaacccaaggtca

SEQ ID NO: 51489 - DNA, 22 bp, Artificial Sequence
  chemically synthesized
tttttttttaacccaaggtcac

SEQ ID NO: 51490 - DNA, 22 bp, Artificial Sequence
  chemically synthesized
ttttttttaacccaaggtcacc

SEQ ID NO: 51491 - DNA, 22 bp, Artificial Sequence
  chemically synthesized
tttttttaacccaaggtcaccc

SEQ ID NO: 51492 - DNA, 22 bp, Artificial Sequence
  chemically synthesized
ttttttaacccaaggtcaccct

SEQ ID NO: 51493 - DNA, 22 bp, Artificial Sequence
  chemically synthesized
tttttaacccaaggtcaccctg

SEQ ID NO: 51494 - DNA, 22 bp, Artificial Sequence
  chemically synthesized
ttttaacccaaggtcaccctgc

SEQ ID NO: 51495 - DNA, 22 bp, Artificial Sequence
  chemically synthesized
tttaacccaaggtcaccctgct

SEQ ID NO: 51496 - DNA, 22 bp, Artificial Sequence
  chemically synthesized
ttaacccaaggtcaccctgctt

SEQ ID NO: 51497 - DNA, 22 bp, Artificial Sequence
  chemically synthesized
taacccaaggtcaccctgcttg

SEQ ID NO: 51498 - DNA, 22 bp, Artificial Sequence
  chemically synthesized
aacccaaggtcaccctgcttgt

SEQ ID NO: 51499 - DNA, 22 bp, Artificial Sequence
  chemically synthesized
acccaaggtcaccctgcttgtc

SEQ ID NO: 51500 - DNA, 22 bp, Artificial Sequence
  chemically synthesized
cttgtcgttggccaagccaggc

SEQ ID NO: 51501 - DNA, 22 bp, Artificial Sequence
  chemically synthesized
gtcgttggccaagccaggccta

SEQ ID NO: 51502 - DNA, 22 bp, Artificial Sequence
  chemically synthesized
tcgttggccaagccaggcctag

SEQ ID NO: 51503 - DNA, 22 bp, Artificial Sequence
  chemically synthesized
gccaagccaggcctagaatctg

SEQ ID NO: 51504 - DNA, 22 bp, Artificial Sequence
  chemically synthesized
gaatctgggtctccagactctg

SEQ ID NO: 51505 - DNA, 22 bp, Artificial Sequence
  chemically synthesized
ggtctccagactctgggtctgc

SEQ ID NO: 51506 - DNA, 22 bp, Artificial Sequence
  chemically synthesized
cagactctgggtctgctactca

SEQ ID NO: 51507 - DNA, 22 bp, Artificial Sequence
  chemically synthesized
tgggtctgctactcagggcaca

SEQ ID NO: 51508 - DNA, 22 bp, Artificial Sequence
  chemically synthesized
ggtctgctactcagggcacaaa

SEQ ID NO: 51509 - DNA, 22 bp, Artificial Sequence
  chemically synthesized
ctactcagggcacaaaagaaga

SEQ ID NO: 51510 - DNA, 22 bp, Artificial Sequence
  chemically synthesized
ctcagggcacaaaagaagaaaa

SEQ ID NO: 51511 - DNA, 22 bp, Artificial Sequence
  chemically synthesized
agggcacaaaagaagaaaacat

SEQ ID NO: 51512 - DNA, 22 bp, Artificial Sequence
  chemically synthesized
tgagttacaccccttcttggcc

SEQ ID NO: 51513 - DNA, 22 bp, Artificial Sequence
  chemically synthesized
agttacaccccttcttggccag

SEQ ID NO: 51514 - DNA, 22 bp, Artificial Sequence
  chemically synthesized
caccccttcttggccagtagtt

SEQ ID NO: 51515 - DNA, 22 bp, Artificial Sequence
  chemically synthesized
cttggccagtagttgagggtaa

SEQ ID NO: 51516 - DNA, 22 bp, Artificial Sequence
  chemically synthesized
ttggccagtagttgagggtaaa

SEQ ID NO: 51517 - DNA, 22 bp, Artificial Sequence
  chemically synthesized
ggccagtagttgagggtaaatt

SEQ ID NO: 51518 - DNA, 22 bp, Artificial Sequence
  chemically synthesized
gccagtagttgagggtaaatta

SEQ ID NO: 51519 - DNA, 22 bp, Artificial Sequence
  chemically synthesized
agggtaaattaacgaaaagaat

SEQ ID NO: 51520 - DNA, 22 bp, Artificial Sequence
  chemically synthesized
acgaaaagaattaatttgtctg

SEQ ID NO: 51521 - DNA, 22 bp, Artificial Sequence
  chemically synthesized
atttgtctgtaactcttgtctg

SEQ ID NO: 51522 - DNA, 22 bp, Artificial Sequence
  chemically synthesized
gtctgtaactcttgtctgttgc

SEQ ID NO: 51523 - DNA, 22 bp, Artificial Sequence
  chemically synthesized
tctgtaactcttgtctgttgct

SEQ ID NO: 51524 - DNA, 22 bp, Artificial Sequence
  chemically synthesized
taactcttgtctgttgctctct

SEQ ID NO: 51525 - DNA, 22 bp, Artificial Sequence
  chemically synthesized
ttgtctgttgctctctgtttag

SEQ ID NO: 51526 - DNA, 22 bp, Artificial Sequence
  chemically synthesized
gtctgttgctctctgtttagga

SEQ ID NO: 51527 - DNA, 22 bp, Artificial Sequence
  chemically synthesized
tctgttgctctctgtttaggaa

SEQ ID NO: 51528 - DNA, 22 bp, Artificial Sequence
  chemically synthesized
ttgctctctgtttaggaagaac

SEQ ID NO: 51529 - DNA, 22 bp, Artificial Sequence
  chemically synthesized
ctctctgtttaggaagaactaa

SEQ ID NO: 51530 - DNA, 22 bp, Artificial Sequence
  chemically synthesized
tctgtttaggaagaactaaaaa

SEQ ID NO: 51531 - DNA, 22 bp, Artificial Sequence
  chemically synthesized
tgtttaggaagaactaaaaact

SEQ ID NO: 51532 - DNA, 22 bp, Artificial Sequence
  chemically synthesized
tttaggaagaactaaaaactcc

SEQ ID NO: 51533 - DNA, 22 bp, Artificial Sequence
  chemically synthesized
aggaagaactaaaaactccaca

SEQ ID NO: 51534 - DNA, 22 bp, Artificial Sequence
  chemically synthesized
ggaagaactaaaaactccacaa

SEQ ID NO: 51535 - DNA, 22 bp, Artificial Sequence
  chemically synthesized
aaaactccacaaattcaacagt

SEQ ID NO: 51536 - DNA, 22 bp, Artificial Sequence
  chemically synthesized
cacaaattcaacagtctcccct

SEQ ID NO: 51537 - DNA, 22 bp, Artificial Sequence
  chemically synthesized
aacagtctcccctctgtctcca

SEQ ID NO: 51538 - DNA, 22 bp, Artificial Sequence
  chemically synthesized
ccctctgtctccactgaactat

SEQ ID NO: 51539 - DNA, 22 bp, Artificial Sequence
  chemically synthesized
tgtctccactgaactatccctc

SEQ ID NO: 51540 - DNA, 22 bp, Artificial Sequence
  chemically synthesized
tctccactgaactatccctcca

SEQ ID NO: 51541 - DNA, 22 bp, Artificial Sequence
  chemically synthesized
cactgaactatccctccatttt

SEQ ID NO: 51542 - DNA, 22 bp, Artificial Sequence
  chemically synthesized
aactatccctccattttcacca

SEQ ID NO: 51543 - DNA, 22 bp, Artificial Sequence
  chemically synthesized
tccctccattttcaccacactt

SEQ ID NO: 51544 - DNA, 22 bp, Artificial Sequence
  chemically synthesized
cattttcaccacactttttggc

SEQ ID NO: 51545 - DNA, 22 bp, Artificial Sequence
  chemically synthesized
tcaccacactttttggctgcca

SEQ ID NO: 51546 - DNA, 22 bp, Artificial Sequence
  chemically synthesized
caccacactttttggctgccat

SEQ ID NO: 51547 - DNA, 22 bp, Artificial Sequence
  chemically synthesized
accacactttttggctgccatt

SEQ ID NO: 51548 - DNA, 22 bp, Artificial Sequence
  chemically synthesized
tttggctgccattcacaaaaaa

SEQ ID NO: 51549 - DNA, 22 bp, Artificial Sequence
  chemically synthesized
ttggctgccattcacaaaaaaa

SEQ ID NO: 51550 - DNA, 22 bp, Artificial Sequence
  chemically synthesized
tggctgccattcacaaaaaaag

SEQ ID NO: 51551 - DNA, 22 bp, Artificial Sequence
  chemically synthesized
ggctgccattcacaaaaaaagc

SEQ ID NO: 51552 - DNA, 22 bp, Artificial Sequence
  chemically synthesized
gctgccattcacaaaaaaagct

SEQ ID NO: 51553 - DNA, 22 bp, Artificial Sequence
  chemically synthesized
ccattcacaaaaaaagctgaag

SEQ ID NO: 51554 - DNA, 22 bp, Artificial Sequence
  chemically synthesized
acaaaaaaagctgaagccagcc

SEQ ID NO: 51555 - DNA, 22 bp, Artificial Sequence
  chemically synthesized
aagccagccatgggtaactatt

SEQ ID NO: 51556 - DNA, 22 bp, Artificial Sequence
  chemically synthesized
ttaaaatccatgtggttgcaga

SEQ ID NO: 51557 - DNA, 22 bp, Artificial Sequence
  chemically synthesized
aaatccatgtggttgcagagac

SEQ ID NO: 51558 - DNA, 22 bp, Artificial Sequence
  chemically synthesized
cagagacagcatccctatcaca

SEQ ID NO: 51559 - DNA, 22 bp, Artificial Sequence
  chemically synthesized
tcacatgagcttttgccctgtc

SEQ ID NO: 51560 - DNA, 22 bp, Artificial Sequence
  chemically synthesized
ttgccctgtccccaaggccctc

SEQ ID NO: 51561 - DNA, 22 bp, Artificial Sequence
  chemically synthesized
tgccctgtccccaaggccctct

SEQ ID NO: 51562 - DNA, 22 bp, Artificial Sequence
  chemically synthesized
gccctgtccccaaggccctctg

SEQ ID NO: 51563 - DNA, 22 bp, Artificial Sequence
  chemically synthesized
ccctgtccccaaggccctctgt

SEQ ID NO: 51564 - DNA, 22 bp, Artificial Sequence
  chemically synthesized
tccccaaggccctctgtcatct

SEQ ID NO: 51565 - DNA, 22 bp, Artificial Sequence
  chemically synthesized
tgtcatctccactccttgtggg

SEQ ID NO: 51566 - DNA, 22 bp, Artificial Sequence
  chemically synthesized
tcatctccactccttgtgggcc

SEQ ID NO: 51567 - DNA, 22 bp, Artificial Sequence
  chemically synthesized
cactccttgtgggccaccacag

SEQ ID NO: 51568 - DNA, 22 bp, Artificial Sequence
  chemically synthesized
cttgtgggccaccacagcaagg

SEQ ID NO: 51569 - DNA, 22 bp, Artificial Sequence
  chemically synthesized
gtgggccaccacagcaaggctg

SEQ ID NO: 51570 - DNA, 22 bp, Artificial Sequence
  chemically synthesized
tgggccaccacagcaaggctga

SEQ ID NO: 51571 - DNA, 22 bp, Artificial Sequence
  chemically synthesized
actcactggctctgaagaagat

SEQ ID NO: 51572 - DNA, 22 bp, Artificial Sequence
  chemically synthesized
actggctctgaagaagatccac

SEQ ID NO: 51573 - DNA, 22 bp, Artificial Sequence
  chemically synthesized
gctctgaagaagatccacaaag

SEQ ID NO: 51574 - DNA, 22 bp, Artificial Sequence
  chemically synthesized
tgaagaagatccacaaagcctg

SEQ ID NO: 51575 - DNA, 22 bp, Artificial Sequence
  chemically synthesized
aagaagatccacaaagcctgtg

SEQ ID NO: 51576 - DNA, 22 bp, Artificial Sequence
  chemically synthesized
tggagaggaggcccacagctct

SEQ ID NO: 51577 - DNA, 22 bp, Artificial Sequence
  chemically synthesized
tccaggatgcatgaggaggggc

SEQ ID NO: 51578 - DNA, 22 bp, Artificial Sequence
  chemically synthesized
caggatgcatgaggaggggcca

SEQ ID NO: 51579 - DNA, 22 bp, Artificial Sequence
  chemically synthesized
tccctcttggcccatgggaaat

SEQ ID NO: 51580 - DNA, 22 bp, Artificial Sequence
  chemically synthesized
ccctcttggcccatgggaaatc

SEQ ID NO: 51581 - DNA, 22 bp, Artificial Sequence
  chemically synthesized
cctcttggcccatgggaaatcc

SEQ ID NO: 51582 - DNA, 22 bp, Artificial Sequence
  chemically synthesized
ttggcccatgggaaatcctagg

SEQ ID NO: 51583 - DNA, 22 bp, Artificial Sequence
  chemically synthesized
ggcccatgggaaatcctaggag

SEQ ID NO: 51584 - DNA, 22 bp, Artificial Sequence
  chemically synthesized
gcccatgggaaatcctaggagg

SEQ ID NO: 51585 - DNA, 22 bp, Artificial Sequence
  chemically synthesized
ggaggcaacataagcctgtggc

SEQ ID NO: 51586 - DNA, 22 bp, Artificial Sequence
  chemically synthesized
tggcagcccctccacaaagccc

SEQ ID NO: 51587 - DNA, 22 bp, Artificial Sequence
  chemically synthesized
cacaaagccctgcctccagagt

SEQ ID NO: 51588 - DNA, 22 bp, Artificial Sequence
  chemically synthesized
cctccagagttcccataggcga

SEQ ID NO: 51589 - DNA, 22 bp, Artificial Sequence
  chemically synthesized
cagagttcccataggcgagaat

SEQ ID NO: 51590 - DNA, 22 bp, Artificial Sequence
  chemically synthesized
ccataggcgagaatgtgtcctc

SEQ ID NO: 51591 - DNA, 22 bp, Artificial Sequence
  chemically synthesized
agtggagcattaccttgcacag

SEQ ID NO: 51592 - DNA, 22 bp, Artificial Sequence
  chemically synthesized
ccttgcacagcctgtgaagtgc

SEQ ID NO: 51593 - DNA, 22 bp, Artificial Sequence
  chemically synthesized
gcacagcctgtgaagtgctctg

SEQ ID NO: 51594 - DNA, 22 bp, Artificial Sequence
  chemically synthesized
cacagcctgtgaagtgctctgt

SEQ ID NO: 51595 - DNA, 22 bp, Artificial Sequence
  chemically synthesized
tgaagtgctctgtgcggggata

SEQ ID NO: 51596 - DNA, 22 bp, Artificial Sequence
  chemically synthesized
tgtgcggggataaaggcaagta

SEQ ID NO: 51597 - DNA, 22 bp, Artificial Sequence
  chemically synthesized
tgcggggataaaggcaagtaac

SEQ ID NO: 51598 - DNA, 22 bp, Artificial Sequence
  chemically synthesized
tctcaaggaattgctagcttat

SEQ ID NO: 51599 - DNA, 22 bp, Artificial Sequence
  chemically synthesized
tcaaggaattgctagcttatgg

SEQ ID NO: 51600 - DNA, 22 bp, Artificial Sequence
  chemically synthesized
aaggaattgctagcttatgggg

SEQ ID NO: 51601 - DNA, 22 bp, Artificial Sequence
  chemically synthesized
ctagcttatggggagagaaaac

SEQ ID NO: 51602 - DNA, 22 bp, Artificial Sequence
  chemically synthesized
gcttatggggagagaaaactaa

SEQ ID NO: 51603 - DNA, 22 bp, Artificial Sequence
  chemically synthesized
atggggagagaaaactaaacgt

SEQ ID NO: 51604 - DNA, 22 bp, Artificial Sequence
  chemically synthesized
tggggagagaaaactaaacgtg

SEQ ID NO: 51605 - DNA, 22 bp, Artificial Sequence
  chemically synthesized
aacgtggaagccccaacagtgt

SEQ ID NO: 51606 - DNA, 22 bp, Artificial Sequence
  chemically synthesized
gagtatgaagggggccccacct

SEQ ID NO: 51607 - DNA, 22 bp, Artificial Sequence
  chemically synthesized
aggaggtcggggagtgtggcgt

SEQ ID NO: 51608 - DNA, 22 bp, Artificial Sequence
  chemically synthesized
ccccatagcaggatgtgtgcaa

SEQ ID NO: 51609 - DNA, 22 bp, Artificial Sequence
  chemically synthesized
ccactggtactcagcatctgcc

SEQ ID NO: 51610 - DNA, 22 bp, Artificial Sequence
  chemically synthesized
gtactcagcatctgccacctcg

SEQ ID NO: 51611 - DNA, 22 bp, Artificial Sequence
  chemically synthesized
agcatctgccacctcgctgacc

SEQ ID NO: 51612 - DNA, 22 bp, Artificial Sequence
  chemically synthesized
ccacctcgctgaccctcatttg

SEQ ID NO: 51613 - DNA, 22 bp, Artificial Sequence
  chemically synthesized
gctgaccctcatttgaccctcc

SEQ ID NO: 51614 - DNA, 22 bp, Artificial Sequence
  chemically synthesized
accctcatttgaccctcccagg

SEQ ID NO: 51615 - DNA, 22 bp, Artificial Sequence
  chemically synthesized
atttgaccctcccaggcaagtg

SEQ ID NO: 51616 - DNA, 22 bp, Artificial Sequence
  chemically synthesized
gaccctcccaggcaagtgctgt

SEQ ID NO: 51617 - DNA, 22 bp, Artificial Sequence
  chemically synthesized
accctcccaggcaagtgctgtg

SEQ ID NO: 51618 - DNA, 22 bp, Artificial Sequence
  chemically synthesized
ccaggcaagtgctgtgatgacc

SEQ ID NO: 51619 - DNA, 22 bp, Artificial Sequence
  chemically synthesized
tgatgaccccctccctggtgag

SEQ ID NO: 51620 - DNA, 22 bp, Artificial Sequence
  chemically synthesized
cctggtgaggagccggccagga

SEQ ID NO: 51621 - DNA, 22 bp, Artificial Sequence
  chemically synthesized
gtgaggagccggccaggacttg

SEQ ID NO: 51622 - DNA, 22 bp, Artificial Sequence
  chemically synthesized
ggatccaagaagtctggcttca

SEQ ID NO: 51623 - DNA, 22 bp, Artificial Sequence
  chemically synthesized
gatccaagaagtctggcttcaa

SEQ ID NO: 51624 - DNA, 22 bp, Artificial Sequence
  chemically synthesized
gcttcaaaccccatgctctgac

SEQ ID NO: 51625 - DNA, 22 bp, Artificial Sequence
  chemically synthesized
caaaccccatgctctgaccgct

SEQ ID NO: 51626 - DNA, 22 bp, Artificial Sequence
  chemically synthesized
aaaccccatgctctgaccgctc

SEQ ID NO: 51627 - DNA, 22 bp, Artificial Sequence
  chemically synthesized
tgaccgctcgatggcaccgctt

SEQ ID NO: 51628 - DNA, 22 bp, Artificial Sequence
  chemically synthesized
accgctcgatggcaccgcttcc

SEQ ID NO: 51629 - DNA, 22 bp, Artificial Sequence
  chemically synthesized
gatggcaccgcttccttggcag

SEQ ID NO: 51630 - DNA, 22 bp, Artificial Sequence
  chemically synthesized
ccttggcaggacatctacagct

SEQ ID NO: 51631 - DNA, 22 bp, Artificial Sequence
  chemically synthesized
cttggcaggacatctacagctc

SEQ ID NO: 51632 - DNA, 22 bp, Artificial Sequence
  chemically synthesized
ggcaggacatctacagctccca

SEQ ID NO: 51633 - DNA, 22 bp, Artificial Sequence
  chemically synthesized
gcaggacatctacagctcccag

SEQ ID NO: 51634 - DNA, 22 bp, Artificial Sequence
  chemically synthesized
cagctcccagggcacccagggg

SEQ ID NO: 51635 - DNA, 22 bp, Artificial Sequence
  chemically synthesized
ccagggcacccaggggacatca

SEQ ID NO: 51636 - DNA, 22 bp, Artificial Sequence
  chemically synthesized
tgaaaggggaatggtcagaccc

SEQ ID NO: 51637 - DNA, 22 bp, Artificial Sequence
  chemically synthesized
aaaggggaatggtcagacccgg

SEQ ID NO: 51638 - DNA, 22 bp, Artificial Sequence
  chemically synthesized
gaatgccatgctaaggagttcg

SEQ ID NO: 51639 - DNA, 22 bp, Artificial Sequence
  chemically synthesized
aatgccatgctaaggagttcgg

SEQ ID NO: 51640 - DNA, 22 bp, Artificial Sequence
  chemically synthesized
aggagttcggacttgacaagag

SEQ ID NO: 51641 - DNA, 22 bp, Artificial Sequence
  chemically synthesized
ggacttgacaagaggcagcagc

SEQ ID NO: 51642 - DNA, 22 bp, Artificial Sequence
  chemically synthesized
gacaagaggcagcagcaaaggg

SEQ ID NO: 51643 - DNA, 22 bp, Artificial Sequence
  chemically synthesized
acaagaggcagcagcaaagggt

SEQ ID NO: 51644 - DNA, 22 bp, Artificial Sequence
  chemically synthesized
tgataacctggttagacgtgct

SEQ ID NO: 51645 - DNA, 22 bp, Artificial Sequence
  chemically synthesized
gataacctggttagacgtgctc

SEQ ID NO: 51646 - DNA, 22 bp, Artificial Sequence
  chemically synthesized
ataacctggttagacgtgctct

SEQ ID NO: 51647 - DNA, 22 bp, Artificial Sequence
  chemically synthesized
gttagacgtgctctgatttatt

SEQ ID NO: 51648 - DNA, 22 bp, Artificial Sequence
  chemically synthesized
gacgtgctctgatttattgtat

SEQ ID NO: 51649 - DNA, 22 bp, Artificial Sequence
  chemically synthesized
tgatttattgtatttcactgct

SEQ ID NO: 51650 - DNA, 22 bp, Artificial Sequence
  chemically synthesized
atttattgtatttcactgctgc

SEQ ID NO: 51651 - DNA, 22 bp, Artificial Sequence
  chemically synthesized
attgtatttcactgctgcaaga

SEQ ID NO: 51652 - DNA, 22 bp, Artificial Sequence
  chemically synthesized
ttgtatttcactgctgcaagat

SEQ ID NO: 51653 - DNA, 22 bp, Artificial Sequence
  chemically synthesized
tatttcactgctgcaagattta

SEQ ID NO: 51654 - DNA, 22 bp, Artificial Sequence
  chemically synthesized
cactgctgcaagatttactgga

SEQ ID NO: 51655 - DNA, 22 bp, Artificial Sequence
  chemically synthesized
actgctgcaagatttactggac

SEQ ID NO: 51656 - DNA, 22 bp, Artificial Sequence
  chemically synthesized
ctgcaagatttactggacaaag

SEQ ID NO: 51657 - DNA, 22 bp, Artificial Sequence
  chemically synthesized
caagatttactggacaaagagg

SEQ ID NO: 51658 - DNA, 22 bp, Artificial Sequence
  chemically synthesized
actggacaaagaggaggagggg

SEQ ID NO: 51659 - DNA, 22 bp, Artificial Sequence
  chemically synthesized
ctggacaaagaggaggaggggg

SEQ ID NO: 51660 - DNA, 22 bp, Artificial Sequence
  chemically synthesized
gacaaagaggaggagggggaga

SEQ ID NO: 51661 - DNA, 22 bp, Artificial Sequence
  chemically synthesized
gaagcccaagcaaaggccaggg

SEQ ID NO: 51662 - DNA, 22 bp, Artificial Sequence
  chemically synthesized
ccagcctgagcgcggagtgcat

SEQ ID NO: 51663 - DNA, 22 bp, Artificial Sequence
  chemically synthesized
cagcctgagcgcggagtgcatg

SEQ ID NO: 51664 - DNA, 22 bp, Artificial Sequence
  chemically synthesized
agcgcggagtgcatgcaggctg

SEQ ID NO: 51665 - DNA, 22 bp, Artificial Sequence
  chemically synthesized
cgcggtggccgcccgggttgca

SEQ ID NO: 51666 - DNA, 22 bp, Artificial Sequence
  chemically synthesized
cagggaacgcgcgggccagcga

SEQ ID NO: 51667 - DNA, 22 bp, Artificial Sequence
  chemically synthesized
tgcggtgctaccccgtgcccgc

SEQ ID NO: 51668 - DNA, 22 bp, Artificial Sequence
  chemically synthesized
cggtgctaccccgtgcccgcac

SEQ ID NO: 51669 - DNA, 22 bp, Artificial Sequence
  chemically synthesized
ccccgtgcccgcactcacccag

SEQ ID NO: 51670 - DNA, 22 bp, Artificial Sequence
  chemically synthesized
acccaggacggcgcagaccagc

SEQ ID NO: 51671 - DNA, 22 bp, Artificial Sequence
  chemically synthesized
ccacggcgagcctcatcttccg

SEQ ID NO: 51672 - DNA, 22 bp, Artificial Sequence
  chemically synthesized
atcttccgggtgcggcgctgag

SEQ ID NO: 51673 - DNA, 22 bp, Artificial Sequence
  chemically synthesized
ccgggtgcggcgctgagcagcg

SEQ ID NO: 51674 - DNA, 22 bp, Artificial Sequence
  chemically synthesized
cgggtgcggcgctgagcagcga

SEQ ID NO: 51675 - DNA, 22 bp, Artificial Sequence
  chemically synthesized
agcagcgagcacagtcggactc

SEQ ID NO: 51676 - DNA, 22 bp, Artificial Sequence
  chemically synthesized
gcttctgtgcagcctccggcgc

SEQ ID NO: 51677 - DNA, 22 bp, Artificial Sequence
  chemically synthesized
ctgtgcagcctccggcgccccg

SEQ ID NO: 51678 - DNA, 22 bp, Artificial Sequence
  chemically synthesized
tgtgcagcctccggcgccccgc

SEQ ID NO: 51679 - DNA, 22 bp, Artificial Sequence
  chemically synthesized
tgcagcctccggcgccccgcgt

SEQ ID NO: 51680 - DNA, 22 bp, Artificial Sequence
  chemically synthesized
cggcgccccgcgtccctttatt

SEQ ID NO: 51681 - DNA, 22 bp, Artificial Sequence
  chemically synthesized
tattccattcccggcctgggcg

SEQ ID NO: 51682 - DNA, 22 bp, Artificial Sequence
  chemically synthesized
attccattcccggcctgggcgg

SEQ ID NO: 51683 - DNA, 22 bp, Artificial Sequence
  chemically synthesized
ttccattcccggcctgggcggg

SEQ ID NO: 51684 - DNA, 22 bp, Artificial Sequence
  chemically synthesized
cattcccggcctgggcgggctg

SEQ ID NO: 51685 - DNA, 22 bp, Artificial Sequence
  chemically synthesized
ccggcctgggcgggctgggcgc

SEQ ID NO: 51686 - DNA, 22 bp, Artificial Sequence
  chemically synthesized
ggcgggctgggcgcaatctttg

SEQ ID NO: 51687 - DNA, 22 bp, Artificial Sequence
  chemically synthesized
ggcgcaatctttgacctcccgt

SEQ ID NO: 51688 - DNA, 22 bp, Artificial Sequence
  chemically synthesized
tgacctcccgtgtttgtgcagc

SEQ ID NO: 51689 - DNA, 22 bp, Artificial Sequence
  chemically synthesized
gacctcccgtgtttgtgcagcc

SEQ ID NO: 51690 - DNA, 22 bp, Artificial Sequence
  chemically synthesized
acctcccgtgtttgtgcagccg

SEQ ID NO: 51691 - DNA, 22 bp, Artificial Sequence
  chemically synthesized
ccgtgtttgtgcagccgggttg

SEQ ID NO: 51692 - DNA, 22 bp, Artificial Sequence
  chemically synthesized
gtgcagccgggttgcccaatcg

SEQ ID NO: 51693 - DNA, 22 bp, Artificial Sequence
  chemically synthesized
tgcagccgggttgcccaatcgc

SEQ ID NO: 51694 - DNA, 22 bp, Artificial Sequence
  chemically synthesized
cccaatcgcccctctcccaacc

SEQ ID NO: 51695 - DNA, 22 bp, Artificial Sequence
  chemically synthesized
tcccaaccccccttccttactc

SEQ ID NO: 51696 - DNA, 22 bp, Artificial Sequence
  chemically synthesized
ccaaccccccttccttactcgt

SEQ ID NO: 51697 - DNA, 22 bp, Artificial Sequence
  chemically synthesized
ccttactcgtcccactgatcac

SEQ ID NO: 51698 - DNA, 22 bp, Artificial Sequence
  chemically synthesized
cttactcgtcccactgatcacc

SEQ ID NO: 51699 - DNA, 22 bp, Artificial Sequence
  chemically synthesized
actcgtcccactgatcacctca

SEQ ID NO: 51700 - DNA, 22 bp, Artificial Sequence
  chemically synthesized
ctcgtcccactgatcacctcat

SEQ ID NO: 51701 - DNA, 22 bp, Artificial Sequence
  chemically synthesized
gtcccactgatcacctcatttt

SEQ ID NO: 51702 - DNA, 22 bp, Artificial Sequence
  chemically synthesized
atcacctcattttctgagctct

SEQ ID NO: 51703 - DNA, 22 bp, Artificial Sequence
  chemically synthesized
attttctgagctctggagacga

SEQ ID NO: 51704 - DNA, 22 bp, Artificial Sequence
  chemically synthesized
tctgagctctggagacgacccg

SEQ ID NO: 51705 - DNA, 22 bp, Artificial Sequence
  chemically synthesized
ctgagctctggagacgacccgc

SEQ ID NO: 51706 - DNA, 22 bp, Artificial Sequence
  chemically synthesized
tgagctctggagacgacccgcg

SEQ ID NO: 51707 - DNA, 22 bp, Artificial Sequence
  chemically synthesized
agctctggagacgacccgcgag

SEQ ID NO: 51708 - DNA, 22 bp, Artificial Sequence
  chemically synthesized
tggagacgacccgcgagtggaa

SEQ ID NO: 51709 - DNA, 22 bp, Artificial Sequence
  chemically synthesized
gagacgacccgcgagtggaagg

SEQ ID NO: 51710 - DNA, 22 bp, Artificial Sequence
  chemically synthesized
atgggaagggacatgaagcaca

SEQ ID NO: 51711 - DNA, 22 bp, Artificial Sequence
  chemically synthesized
tcatcgcggctcgctcggtgcc

SEQ ID NO: 51712 - DNA, 20 bp, Artificial Sequence
  chemically synthesized
actaagtcaataatcagaat

SEQ ID NO: 51713 - DNA, 20 bp, Artificial Sequence
  chemically synthesized
aagtcaataatcagaatcag

SEQ ID NO: 51714 - DNA, 20 bp, Artificial Sequence
  chemically synthesized
agtcaataatcagaatcagc

SEQ ID NO: 51715 - DNA, 20 bp, Artificial Sequence
  chemically synthesized
aatcagaatcagcaggtttg

SEQ ID NO: 51716 - DNA, 20 bp, Artificial Sequence
  chemically synthesized
agaatcagcaggtttgcagt

SEQ ID NO: 51717 - DNA, 20 bp, Artificial Sequence
  chemically synthesized
cagcaggtttgcagtcagat

SEQ ID NO: 51718 - DNA, 20 bp, Artificial Sequence
  chemically synthesized
caggtttgcagtcagattgg

SEQ ID NO: 51719 - DNA, 20 bp, Artificial Sequence
  chemically synthesized
aggtttgcagtcagattggc

SEQ ID NO: 51720 - DNA, 20 bp, Artificial Sequence
  chemically synthesized
ggtttgcagtcagattggca

SEQ ID NO: 51721 - DNA, 20 bp, Artificial Sequence
  chemically synthesized
gcagtcagattggcagggat

SEQ ID NO: 51722 - DNA, 20 bp, Artificial Sequence
  chemically synthesized
gtcagattggcagggataag

SEQ ID NO: 51723 - DNA, 20 bp, Artificial Sequence
  chemically synthesized
attggcagggataagcagcc

SEQ ID NO: 51724 - DNA, 20 bp, Artificial Sequence
  chemically synthesized
cagggataagcagcctagct

SEQ ID NO: 51725 - DNA, 20 bp, Artificial Sequence
  chemically synthesized
agggataagcagcctagctc

SEQ ID NO: 51726 - DNA, 20 bp, Artificial Sequence
  chemically synthesized
ggataagcagcctagctcag

SEQ ID NO: 51727 - DNA, 20 bp, Artificial Sequence
  chemically synthesized
taagcagcctagctcaggag

SEQ ID NO: 51728 - DNA, 20 bp, Artificial Sequence
  chemically synthesized
cagcctagctcaggagaagt

SEQ ID NO: 51729 - DNA, 20 bp, Artificial Sequence
  chemically synthesized
ctcaggagaagtgagtataa

SEQ ID NO: 51730 - DNA, 20 bp, Artificial Sequence
  chemically synthesized
agaagtgagtataaaagccc

SEQ ID NO: 51731 - DNA, 20 bp, Artificial Sequence
  chemically synthesized
gaagtgagtataaaagcccc

SEQ ID NO: 51732 - DNA, 20 bp, Artificial Sequence
  chemically synthesized
tgagtataaaagccccaggc

SEQ ID NO: 51733 - DNA, 20 bp, Artificial Sequence
  chemically synthesized
gagtataaaagccccaggct

SEQ ID NO: 51734 - DNA, 20 bp, Artificial Sequence
  chemically synthesized
gtataaaagccccaggctgg

SEQ ID NO: 51735 - DNA, 20 bp, Artificial Sequence
  chemically synthesized
taaaagccccaggctgggag

SEQ ID NO: 51736 - DNA, 20 bp, Artificial Sequence
  chemically synthesized
caggctgggagcagccatca

SEQ ID NO: 51737 - DNA, 20 bp, Artificial Sequence
  chemically synthesized
gctgggagcagccatcacag

SEQ ID NO: 51738 - DNA, 20 bp, Artificial Sequence
  chemically synthesized
cacagaagtccactcattct

SEQ ID NO: 51739 - DNA, 20 bp, Artificial Sequence
  chemically synthesized
agaagtccactcattcttgg

SEQ ID NO: 51740 - DNA, 20 bp, Artificial Sequence
  chemically synthesized
gaagtccactcattcttggc

SEQ ID NO: 51741 - DNA, 20 bp, Artificial Sequence
  chemically synthesized
tccactcattcttggcagga

SEQ ID NO: 51742 - DNA, 20 bp, Artificial Sequence
  chemically synthesized
ctgctcctcctctgccttgc

SEQ ID NO: 51743 - DNA, 20 bp, Artificial Sequence
  chemically synthesized
cctcctctgccttgctggac

SEQ ID NO: 51744 - DNA, 20 bp, Artificial Sequence
  chemically synthesized
ctggactggtatttgtgtct

SEQ ID NO: 51745 - DNA, 20 bp, Artificial Sequence
  chemically synthesized
tggactggtatttgtgtctg

SEQ ID NO: 51746 - DNA, 20 bp, Artificial Sequence
  chemically synthesized
ctggtatttgtgtctgaggc

SEQ ID NO: 51747 - DNA, 20 bp, Artificial Sequence
  chemically synthesized
tgtgtctgaggctggcccta

SEQ ID NO: 51748 - DNA, 20 bp, Artificial Sequence
  chemically synthesized
tctgaggctggccctacggt

SEQ ID NO: 51749 - DNA, 20 bp, Artificial Sequence
  chemically synthesized
gacatcccattcctacattt

SEQ ID NO: 51750 - DNA, 20 bp, Artificial Sequence
  chemically synthesized
tttaagattcacgctaaatg

SEQ ID NO: 51751 - DNA, 20 bp, Artificial Sequence
  chemically synthesized
aagattcacgctaaatgaag

SEQ ID NO: 51752 - DNA, 20 bp, Artificial Sequence
  chemically synthesized
attcacgctaaatgaagtag

SEQ ID NO: 51753 - DNA, 20 bp, Artificial Sequence
  chemically synthesized
gaagtagaagtgactccttc

SEQ ID NO: 51754 - DNA, 20 bp, Artificial Sequence
  chemically synthesized
ctccttccagctttgccaac

SEQ ID NO: 51755 - DNA, 20 bp, Artificial Sequence
  chemically synthesized
tgccaaccagcttttattac

SEQ ID NO: 51756 - DNA, 20 bp, Artificial Sequence
  chemically synthesized
gccaaccagcttttattact

SEQ ID NO: 51757 - DNA, 20 bp, Artificial Sequence
  chemically synthesized
ccaaccagcttttattacta

SEQ ID NO: 51758 - DNA, 20 bp, Artificial Sequence
  chemically synthesized
ccagcttttattactagggc

SEQ ID NO: 51759 - DNA, 20 bp, Artificial Sequence
  chemically synthesized
cagcttttattactagggca

SEQ ID NO: 51760 - DNA, 20 bp, Artificial Sequence
  chemically synthesized
agcttttattactagggcaa

SEQ ID NO: 51761 - DNA, 20 bp, Artificial Sequence
  chemically synthesized
attactagggcaagggtacc

SEQ ID NO: 51762 - DNA, 20 bp, Artificial Sequence
  chemically synthesized
taattaattcaaacttcaaa

SEQ ID NO: 51763 - DNA, 20 bp, Artificial Sequence
  chemically synthesized
ttcaaacttcaaaaagaatg

SEQ ID NO: 51764 - DNA, 20 bp, Artificial Sequence
  chemically synthesized
aaaaagaatgaagttccact

SEQ ID NO: 51765 - DNA, 20 bp, Artificial Sequence
  chemically synthesized
gaagttccactgagcttact

SEQ ID NO: 51766 - DNA, 20 bp, Artificial Sequence
  chemically synthesized
ttccactgagcttactgagc

SEQ ID NO: 51767 - DNA, 20 bp, Artificial Sequence
  chemically synthesized
tccactgagcttactgagct

SEQ ID NO: 51768 - DNA, 20 bp, Artificial Sequence
  chemically synthesized
tgagctgggacttgaactct

SEQ ID NO: 51769 - DNA, 20 bp, Artificial Sequence
  chemically synthesized
agcattctacctcattgctt

SEQ ID NO: 51770 - DNA, 20 bp, Artificial Sequence
  chemically synthesized
acctcattgctttggtgcat

SEQ ID NO: 51771 - DNA, 20 bp, Artificial Sequence
  chemically synthesized
cctcattgctttggtgcatt

SEQ ID NO: 51772 - DNA, 20 bp, Artificial Sequence
  chemically synthesized
tgcattaggtttgtaatatc

SEQ ID NO: 51773 - DNA, 20 bp, Artificial Sequence
  chemically synthesized
atctggtacctctgtttcct

SEQ ID NO: 51774 - DNA, 20 bp, Artificial Sequence
  chemically synthesized
ggtacctctgtttcctcaga

SEQ ID NO: 51775 - DNA, 20 bp, Artificial Sequence
  chemically synthesized
ctgtttcctcagatagatga

SEQ ID NO: 51776 - DNA, 20 bp, Artificial Sequence
  chemically synthesized
tcagatagatgatagaaata

SEQ ID NO: 51777 - DNA, 20 bp, Artificial Sequence
  chemically synthesized
agaaataaagatatgatatt

SEQ ID NO: 51778 - DNA, 20 bp, Artificial Sequence
  chemically synthesized
gaaataaagatatgatatta

SEQ ID NO: 51779 - DNA, 20 bp, Artificial Sequence
  chemically synthesized
ataaagatatgatattaagg

SEQ ID NO: 51780 - DNA, 20 bp, Artificial Sequence
  chemically synthesized
agctgttaatactgaatttt

SEQ ID NO: 51781 - DNA, 20 bp, Artificial Sequence
  chemically synthesized
ttaatactgaattttcagaa

SEQ ID NO: 51782 - DNA, 20 bp, Artificial Sequence
  chemically synthesized
atccctccataaaatgtatt

SEQ ID NO: 51783 - DNA, 20 bp, Artificial Sequence
  chemically synthesized
tccctccataaaatgtattt

SEQ ID NO: 51784 - DNA, 20 bp, Artificial Sequence
  chemically synthesized
ccctccataaaatgtatttg

SEQ ID NO: 51785 - DNA, 20 bp, Artificial Sequence
  chemically synthesized
cctccataaaatgtatttgg

SEQ ID NO: 51786 - DNA, 20 bp, Artificial Sequence
  chemically synthesized
tgtatttgggggacaaactg

SEQ ID NO: 51787 - DNA, 20 bp, Artificial Sequence
  chemically synthesized
gtatttgggggacaaactgc

SEQ ID NO: 51788 - DNA, 20 bp, Artificial Sequence
  chemically synthesized
atttgggggacaaactgcag

SEQ ID NO: 51789 - DNA, 20 bp, Artificial Sequence
  chemically synthesized
aactgcaggagattatattc

SEQ ID NO: 51790 - DNA, 20 bp, Artificial Sequence
  chemically synthesized
gagattatattctggcccta

SEQ ID NO: 51791 - DNA, 20 bp, Artificial Sequence
  chemically synthesized
atttattgattaatctttaa

SEQ ID NO: 51792 - DNA, 20 bp, Artificial Sequence
  chemically synthesized
tttattgattaatctttaaa

SEQ ID NO: 51793 - DNA, 20 bp, Artificial Sequence
  chemically synthesized
tgattaatctttaaaaggct

SEQ ID NO: 51794 - DNA, 20 bp, Artificial Sequence
  chemically synthesized
aggcttagtgaacaatattc

SEQ ID NO: 51795 - DNA, 20 bp, Artificial Sequence
  chemically synthesized
ttagtgaacaatattctagt

SEQ ID NO: 51796 - DNA, 20 bp, Artificial Sequence
  chemically synthesized
tatctaattcttaaatcctc

SEQ ID NO: 51797 - DNA, 20 bp, Artificial Sequence
  chemically synthesized
ctaattcttaaatcctctag

SEQ ID NO: 51798 - DNA, 20 bp, Artificial Sequence
  chemically synthesized
aattaactaatactataaaa

SEQ ID NO: 51799 - DNA, 20 bp, Artificial Sequence
  chemically synthesized
attaactaatactataaaat

SEQ ID NO: 51800 - DNA, 20 bp, Artificial Sequence
  chemically synthesized
ctaatactataaaatgggtc

SEQ ID NO: 51801 - DNA, 20 bp, Artificial Sequence
  chemically synthesized
ctataaaatgggtctggatg

SEQ ID NO: 51802 - DNA, 20 bp, Artificial Sequence
  chemically synthesized
tgacattattttataacaac

SEQ ID NO: 51803 - DNA, 20 bp, Artificial Sequence
  chemically synthesized
attattttataacaactggt

SEQ ID NO: 51804 - DNA, 20 bp, Artificial Sequence
  chemically synthesized
tattttataacaactggtaa

SEQ ID NO: 51805 - DNA, 20 bp, Artificial Sequence
  chemically synthesized
attttataacaactggtaag

SEQ ID NO: 51806 - DNA, 20 bp, Artificial Sequence
  chemically synthesized
ttttataacaactggtaaga

SEQ ID NO: 51807 - DNA, 20 bp, Artificial Sequence
  chemically synthesized
ttataacaactggtaagagg

SEQ ID NO: 51808 - DNA, 20 bp, Artificial Sequence
  chemically synthesized
ctggtaagagggagtgacta

SEQ ID NO: 51809 - DNA, 20 bp, Artificial Sequence
  chemically synthesized
agcaacaactaaaatgatct

SEQ ID NO: 51810 - DNA, 20 bp, Artificial Sequence
  chemically synthesized
gcaacaactaaaatgatctc

SEQ ID NO: 51811 - DNA, 20 bp, Artificial Sequence
  chemically synthesized
tgatctcaggaaaacctgtt

SEQ ID NO: 51812 - DNA, 20 bp, Artificial Sequence
  chemically synthesized
aacctgtttggccctatgta

SEQ ID NO: 51813 - DNA, 20 bp, Artificial Sequence
  chemically synthesized
tatggtacattacatctttt

SEQ ID NO: 51814 - DNA, 20 bp, Artificial Sequence
  chemically synthesized
tttcagtaattccactcaaa

SEQ ID NO: 51815 - DNA, 20 bp, Artificial Sequence
  chemically synthesized
tcagtaattccactcaaatg

SEQ ID NO: 51816 - DNA, 20 bp, Artificial Sequence
  chemically synthesized
tcaaatggagacttttaaca

SEQ ID NO: 51817 - DNA, 20 bp, Artificial Sequence
  chemically synthesized
tttaacaaagcaactgttct

SEQ ID NO: 51818 - DNA, 20 bp, Artificial Sequence
  chemically synthesized
ttaacaaagcaactgttctc

SEQ ID NO: 51819 - DNA, 20 bp, Artificial Sequence
  chemically synthesized
taacaaagcaactgttctca

SEQ ID NO: 51820 - DNA, 20 bp, Artificial Sequence
  chemically synthesized
aacaaagcaactgttctcag

SEQ ID NO: 51821 - DNA, 20 bp, Artificial Sequence
  chemically synthesized
aaattcattatacacatccc

SEQ ID NO: 51822 - DNA, 20 bp, Artificial Sequence
  chemically synthesized
ttatacacatccctggttga

SEQ ID NO: 51823 - DNA, 20 bp, Artificial Sequence
  chemically synthesized
tacacatccctggttgatag

SEQ ID NO: 51824 - DNA, 20 bp, Artificial Sequence
  chemically synthesized
ctggttgatagcagtgtgtc

SEQ ID NO: 51825 - DNA, 20 bp, Artificial Sequence
  chemically synthesized
ggttgatagcagtgtgtctg

SEQ ID NO: 51826 - DNA, 20 bp, Artificial Sequence
  chemically synthesized
gttgatagcagtgtgtctgg

SEQ ID NO: 51827 - DNA, 20 bp, Artificial Sequence
  chemically synthesized
gatagcagtgtgtctggagg

SEQ ID NO: 51828 - DNA, 20 bp, Artificial Sequence
  chemically synthesized
ggcagaaaccattcttgctt

SEQ ID NO: 51829 - DNA, 20 bp, Artificial Sequence
  chemically synthesized
aattacgtctgtgttatact

SEQ ID NO: 51830 - DNA, 20 bp, Artificial Sequence
  chemically synthesized
tacgtctgtgttatactgag

SEQ ID NO: 51831 - DNA, 20 bp, Artificial Sequence
  chemically synthesized
acgtctgtgttatactgagt

SEQ ID NO: 51832 - DNA, 20 bp, Artificial Sequence
  chemically synthesized
cgtctgtgttatactgagta

SEQ ID NO: 51833 - DNA, 20 bp, Artificial Sequence
  chemically synthesized
ctgtgttatactgagtaggg

SEQ ID NO: 51834 - DNA, 20 bp, Artificial Sequence
  chemically synthesized
gacacttacgttcctgataa

SEQ ID NO: 51835 - DNA, 20 bp, Artificial Sequence
  chemically synthesized
acacttacgttcctgataat

SEQ ID NO: 51836 - DNA, 20 bp, Artificial Sequence
  chemically synthesized
tacgttcctgataatgggat

SEQ ID NO: 51837 - DNA, 20 bp, Artificial Sequence
  chemically synthesized
gtgtaattcttgtttcgctc

SEQ ID NO: 51838 - DNA, 20 bp, Artificial Sequence
  chemically synthesized
tccagatttctaataccaca

SEQ ID NO: 51839 - DNA, 20 bp, Artificial Sequence
  chemically synthesized
tcacgtgtcttctctacacc

SEQ ID NO: 51840 - DNA, 20 bp, Artificial Sequence
  chemically synthesized
cacgtgtcttctctacaccc

SEQ ID NO: 51841 - DNA, 20 bp, Artificial Sequence
  chemically synthesized
acgtgtcttctctacaccca

SEQ ID NO: 51842 - DNA, 20 bp, Artificial Sequence
  chemically synthesized
cttctctacacccagggcac

SEQ ID NO: 51843 - DNA, 20 bp, Artificial Sequence
  chemically synthesized
cccagggcaccggtgaatcc

SEQ ID NO: 51844 - DNA, 20 bp, Artificial Sequence
  chemically synthesized
tgaatccaagtgtcctctga

SEQ ID NO: 51845 - DNA, 20 bp, Artificial Sequence
  chemically synthesized
caagtgtcctctgatggtca

SEQ ID NO: 51846 - DNA, 20 bp, Artificial Sequence
  chemically synthesized
tcctctgatggtcaaagttc

SEQ ID NO: 51847 - DNA, 20 bp, Artificial Sequence
  chemically synthesized
caaagttctagatgctgtcc

SEQ ID NO: 51848 - DNA, 20 bp, Artificial Sequence
  chemically synthesized
aaagttctagatgctgtccg

SEQ ID NO: 51849 - DNA, 20 bp, Artificial Sequence
  chemically synthesized
gttctagatgctgtccgagg

SEQ ID NO: 51850 - DNA, 20 bp, Artificial Sequence
  chemically synthesized
aggcagtcctgccatcaatg

SEQ ID NO: 51851 - DNA, 20 bp, Artificial Sequence
  chemically synthesized
aatgtggccgtgcatgtgtt

SEQ ID NO: 51852 - DNA, 20 bp, Artificial Sequence
  chemically synthesized
tggccgtgcatgtgttcaga

SEQ ID NO: 51853 - DNA, 20 bp, Artificial Sequence
  chemically synthesized
ggccgtgcatgtgttcagaa

SEQ ID NO: 51854 - DNA, 20 bp, Artificial Sequence
  chemically synthesized
gaaaggctgctgatgacacc

SEQ ID NO: 51855 - DNA, 20 bp, Artificial Sequence
  chemically synthesized
aaaggctgctgatgacacct

SEQ ID NO: 51856 - DNA, 20 bp, Artificial Sequence
  chemically synthesized
aggctgctgatgacacctgg

SEQ ID NO: 51857 - DNA, 20 bp, Artificial Sequence
  chemically synthesized
acctgggagccatttgcctc

SEQ ID NO: 51858 - DNA, 20 bp, Artificial Sequence
  chemically synthesized
aaatggctcccaggtgtcat

SEQ ID NO: 51859 - DNA, 20 bp, Artificial Sequence
  chemically synthesized
tggctcccaggtgtcatcag

SEQ ID NO: 51860 - DNA, 20 bp, Artificial Sequence
  chemically synthesized
agcctttctgaacacatgca

SEQ ID NO: 51861 - DNA, 20 bp, Artificial Sequence
  chemically synthesized
cacatgcacggccacattga

SEQ ID NO: 51862 - DNA, 20 bp, Artificial Sequence
  chemically synthesized
atgcacggccacattgatgg

SEQ ID NO: 51863 - DNA, 20 bp, Artificial Sequence
  chemically synthesized
tgcacggccacattgatggc

SEQ ID NO: 51864 - DNA, 20 bp, Artificial Sequence
  chemically synthesized
cattgatggcaggactgcct

SEQ ID NO: 51865 - DNA, 20 bp, Artificial Sequence
  chemically synthesized
gatggcaggactgcctcgga

SEQ ID NO: 51866 - DNA, 20 bp, Artificial Sequence
  chemically synthesized
ggactgcctcggacagcatc

SEQ ID NO: 51867 - DNA, 20 bp, Artificial Sequence
  chemically synthesized
gcatctagaactttgaccat

SEQ ID NO: 51868 - DNA, 20 bp, Artificial Sequence
  chemically synthesized
atctagaactttgaccatca

SEQ ID NO: 51869 - DNA, 20 bp, Artificial Sequence
  chemically synthesized
tctagaactttgaccatcag

SEQ ID NO: 51870 - DNA, 20 bp, Artificial Sequence
  chemically synthesized
tttgaccatcagaggacact

SEQ ID NO: 51871 - DNA, 20 bp, Artificial Sequence
  chemically synthesized
cagaggacacttggattcac

SEQ ID NO: 51872 - DNA, 20 bp, Artificial Sequence
  chemically synthesized
acttggattcaccggtgccc

SEQ ID NO: 51873 - DNA, 20 bp, Artificial Sequence
  chemically synthesized
cttggattcaccggtgccct

SEQ ID NO: 51874 - DNA, 20 bp, Artificial Sequence
  chemically synthesized
attcaccggtgccctgggtg

SEQ ID NO: 51875 - DNA, 20 bp, Artificial Sequence
  chemically synthesized
tcaccggtgccctgggtgta

SEQ ID NO: 51876 - DNA, 20 bp, Artificial Sequence
  chemically synthesized
ccggtgccctgggtgtagag

SEQ ID NO: 51877 - DNA, 20 bp, Artificial Sequence
  chemically synthesized
tgggtgtagagaagacacgt

SEQ ID NO: 51878 - DNA, 20 bp, Artificial Sequence
  chemically synthesized
gtgtagagaagacacgtgag

SEQ ID NO: 51879 - DNA, 20 bp, Artificial Sequence
  chemically synthesized
gagaagttaacaaaattgat

SEQ ID NO: 51880 - DNA, 20 bp, Artificial Sequence
  chemically synthesized
gaagttaacaaaattgatca

SEQ ID NO: 51881 - DNA, 20 bp, Artificial Sequence
  chemically synthesized
aacaaaattgatcagagtga

SEQ ID NO: 51882 - DNA, 20 bp, Artificial Sequence
  chemically synthesized
acaaaattgatcagagtgaa

SEQ ID NO: 51883 - DNA, 20 bp, Artificial Sequence
  chemically synthesized
gtgaaaggatttattctttg

SEQ ID NO: 51884 - DNA, 20 bp, Artificial Sequence
  chemically synthesized
ggatttattctttgtggtat

SEQ ID NO: 51885 - DNA, 20 bp, Artificial Sequence
  chemically synthesized
tctttgtggtattagaaatc

SEQ ID NO: 51886 - DNA, 20 bp, Artificial Sequence
  chemically synthesized
tttgtggtattagaaatctg

SEQ ID NO: 51887 - DNA, 20 bp, Artificial Sequence
  chemically synthesized
ttagaaatctggagcgaaac

SEQ ID NO: 51888 - DNA, 20 bp, Artificial Sequence
  chemically synthesized
ttacacactgatcccattat

SEQ ID NO: 51889 - DNA, 20 bp, Artificial Sequence
  chemically synthesized
tacacactgatcccattatc

SEQ ID NO: 51890 - DNA, 20 bp, Artificial Sequence
  chemically synthesized
gatcccattatcaggaacgt

SEQ ID NO: 51891 - DNA, 20 bp, Artificial Sequence
  chemically synthesized
cgtaagtgtcgacaattaat

SEQ ID NO: 51892 - DNA, 20 bp, Artificial Sequence
  chemically synthesized
aattaatgagcttccctact

SEQ ID NO: 51893 - DNA, 20 bp, Artificial Sequence
  chemically synthesized
cttccctactcagtataaca

SEQ ID NO: 51894 - DNA, 20 bp, Artificial Sequence
  chemically synthesized
cacagacgtaattgtttcca

SEQ ID NO: 51895 - DNA, 20 bp, Artificial Sequence
  chemically synthesized
gacgtaattgtttccaaagc

SEQ ID NO: 51896 - DNA, 20 bp, Artificial Sequence
  chemically synthesized
aattgtttccaaagcaagaa

SEQ ID NO: 51897 - DNA, 20 bp, Artificial Sequence
  chemically synthesized
gcaagaatggtttctgcctc

SEQ ID NO: 51898 - DNA, 20 bp, Artificial Sequence
  chemically synthesized
ccagacacactgctatcaac

SEQ ID NO: 51899 - DNA, 20 bp, Artificial Sequence
  chemically synthesized
cagacacactgctatcaacc

SEQ ID NO: 51900 - DNA, 20 bp, Artificial Sequence
  chemically synthesized
agacacactgctatcaacca

SEQ ID NO: 51901 - DNA, 20 bp, Artificial Sequence
  chemically synthesized
ggatgtgtataatgaatttt

SEQ ID NO: 51902 - DNA, 20 bp, Artificial Sequence
  chemically synthesized
gatgtgtataatgaatttta

SEQ ID NO: 51903 - DNA, 20 bp, Artificial Sequence
  chemically synthesized
atgtgtataatgaattttaa

SEQ ID NO: 51904 - DNA, 20 bp, Artificial Sequence
  chemically synthesized
gtgtataatgaattttaagg

SEQ ID NO: 51905 - DNA, 20 bp, Artificial Sequence
  chemically synthesized
atgaattttaagggagaaaa

SEQ ID NO: 51906 - DNA, 20 bp, Artificial Sequence
  chemically synthesized
tgaattttaagggagaaaat

SEQ ID NO: 51907 - DNA, 20 bp, Artificial Sequence
  chemically synthesized
agggagaaaataggtcccct

SEQ ID NO: 51908 - DNA, 20 bp, Artificial Sequence
  chemically synthesized
gaaaataggtcccctgagaa

SEQ ID NO: 51909 - DNA, 20 bp, Artificial Sequence
  chemically synthesized
gagaacagttgctttgttaa

SEQ ID NO: 51910 - DNA, 20 bp, Artificial Sequence
  chemically synthesized
tttgttaaaagtctccattt

SEQ ID NO: 51911 - DNA, 20 bp, Artificial Sequence
  chemically synthesized
gttaaaagtctccatttgag

SEQ ID NO: 51912 - DNA, 20 bp, Artificial Sequence
  chemically synthesized
atttgagtggaattactgaa

SEQ ID NO: 51913 - DNA, 20 bp, Artificial Sequence
  chemically synthesized
aagatgtaatgtaccataca

SEQ ID NO: 51914 - DNA, 20 bp, Artificial Sequence
  chemically synthesized
agatgtaatgtaccatacat

SEQ ID NO: 51915 - DNA, 20 bp, Artificial Sequence
  chemically synthesized
gatgtaatgtaccatacata

SEQ ID NO: 51916 - DNA, 20 bp, Artificial Sequence
  chemically synthesized
gtaccatacatagggccaaa

SEQ ID NO: 51917 - DNA, 20 bp, Artificial Sequence
  chemically synthesized
taccatacatagggccaaac

SEQ ID NO: 51918 - DNA, 20 bp, Artificial Sequence
  chemically synthesized
agggccaaacaggttttcct

SEQ ID NO: 51919 - DNA, 20 bp, Artificial Sequence
  chemically synthesized
aggttttcctgagatcattt

SEQ ID NO: 51920 - DNA, 20 bp, Artificial Sequence
  chemically synthesized
gatcattttagttgttgcta

SEQ ID NO: 51921 - DNA, 20 bp, Artificial Sequence
  chemically synthesized
ctatagtcactccctcttac

SEQ ID NO: 51922 - DNA, 20 bp, Artificial Sequence
  chemically synthesized
cagttgttataaaataatgt

SEQ ID NO: 51923 - DNA, 20 bp, Artificial Sequence
  chemically synthesized
aataatgtcagaactacatc

SEQ ID NO: 51924 - DNA, 20 bp, Artificial Sequence
  chemically synthesized
ctacatccagacccatttta

SEQ ID NO: 51925 - DNA, 20 bp, Artificial Sequence
  chemically synthesized
ccagacccattttatagtat

SEQ ID NO: 51926 - DNA, 20 bp, Artificial Sequence
  chemically synthesized
atagtattagttaattcttc

SEQ ID NO: 51927 - DNA, 20 bp, Artificial Sequence
  chemically synthesized
agtattagttaattcttcta

SEQ ID NO: 51928 - DNA, 20 bp, Artificial Sequence
  chemically synthesized
gtattagttaattcttctag

SEQ ID NO: 51929 - DNA, 20 bp, Artificial Sequence
  chemically synthesized
ttaattcttctagaggattt

SEQ ID NO: 51930 - DNA, 20 bp, Artificial Sequence
  chemically synthesized
cttctagaggatttaagaat

SEQ ID NO: 51931 - DNA, 20 bp, Artificial Sequence
  chemically synthesized
ttaagaattagatatctgac

SEQ ID NO: 51932 - DNA, 20 bp, Artificial Sequence
  chemically synthesized
tgactagaatattgttcact

SEQ ID NO: 51933 - DNA, 20 bp, Artificial Sequence
  chemically synthesized
attgttcactaagcctttta

SEQ ID NO: 51934 - DNA, 20 bp, Artificial Sequence
  chemically synthesized
aaatacgttttgaataacta

SEQ ID NO: 51935 - DNA, 20 bp, Artificial Sequence
  chemically synthesized
aatacgttttgaataactat

SEQ ID NO: 51936 - DNA, 20 bp, Artificial Sequence
  chemically synthesized
atacgttttgaataactata

SEQ ID NO: 51937 - DNA, 20 bp, Artificial Sequence
  chemically synthesized
gttttgaataactatagggc

SEQ ID NO: 51938 - DNA, 20 bp, Artificial Sequence
  chemically synthesized
ggccagaatataatctcctg

SEQ ID NO: 51939 - DNA, 20 bp, Artificial Sequence
  chemically synthesized
tgtcccccaaatacatttta

SEQ ID NO: 51940 - DNA, 20 bp, Artificial Sequence
  chemically synthesized
tcccccaaatacattttatg

SEQ ID NO: 51941 - DNA, 20 bp, Artificial Sequence
  chemically synthesized
cccccaaatacattttatgg

SEQ ID NO: 51942 - DNA, 20 bp, Artificial Sequence
  chemically synthesized
ccccaaatacattttatgga

SEQ ID NO: 51943 - DNA, 20 bp, Artificial Sequence
  chemically synthesized
gggatacttttctgaaaatt

SEQ ID NO: 51944 - DNA, 20 bp, Artificial Sequence
  chemically synthesized
ttctgaaaattcagtattaa

SEQ ID NO: 51945 - DNA, 20 bp, Artificial Sequence
  chemically synthesized
tttatttctatcatctatct

SEQ ID NO: 51946 - DNA, 20 bp, Artificial Sequence
  chemically synthesized
ttatttctatcatctatctg

SEQ ID NO: 51947 - DNA, 20 bp, Artificial Sequence
  chemically synthesized
ctatcatctatctgaggaaa

SEQ ID NO: 51948 - DNA, 20 bp, Artificial Sequence
  chemically synthesized
atcatctatctgaggaaaca

SEQ ID NO: 51949 - DNA, 20 bp, Artificial Sequence
  chemically synthesized
tcatctatctgaggaaacag

SEQ ID NO: 51950 - DNA, 20 bp, Artificial Sequence
  chemically synthesized
atctgaggaaacagaggtac

SEQ ID NO: 51951 - DNA, 20 bp, Artificial Sequence
  chemically synthesized
attacaaacctaatgcacca

SEQ ID NO: 51952 - DNA, 20 bp, Artificial Sequence
  chemically synthesized
acctaatgcaccaaagcaat

SEQ ID NO: 51953 - DNA, 20 bp, Artificial Sequence
  chemically synthesized
cctaatgcaccaaagcaatg

SEQ ID NO: 51954 - DNA, 20 bp, Artificial Sequence
  chemically synthesized
aatgcaccaaagcaatgagg

SEQ ID NO: 51955 - DNA, 20 bp, Artificial Sequence
  chemically synthesized
aagcaatgaggtagaatgct

SEQ ID NO: 51956 - DNA, 20 bp, Artificial Sequence
  chemically synthesized
gcaatgaggtagaatgctca

SEQ ID NO: 51957 - DNA, 20 bp, Artificial Sequence
  chemically synthesized
aggtagaatgctcagagttc

SEQ ID NO: 51958 - DNA, 20 bp, Artificial Sequence
  chemically synthesized
aatgctcagagttcaagtcc

SEQ ID NO: 51959 - DNA, 20 bp, Artificial Sequence
  chemically synthesized
tcagagttcaagtcccagct

SEQ ID NO: 51960 - DNA, 20 bp, Artificial Sequence
  chemically synthesized
agttcaagtcccagctcagt

SEQ ID NO: 51961 - DNA, 20 bp, Artificial Sequence
  chemically synthesized
aagtcccagctcagtaagct

SEQ ID NO: 51962 - DNA, 20 bp, Artificial Sequence
  chemically synthesized
tcccagctcagtaagctcag

SEQ ID NO: 51963 - DNA, 20 bp, Artificial Sequence
  chemically synthesized
gtggaacttcattctttttg

SEQ ID NO: 51964 - DNA, 20 bp, Artificial Sequence
  chemically synthesized
tgaattaattatattaaaaa

SEQ ID NO: 51965 - DNA, 20 bp, Artificial Sequence
  chemically synthesized
attatattaaaaatagatgc

SEQ ID NO: 51966 - DNA, 20 bp, Artificial Sequence
  chemically synthesized
ttatattaaaaatagatgct

SEQ ID NO: 51967 - DNA, 20 bp, Artificial Sequence
  chemically synthesized
gatgctgggtacccttgccc

SEQ ID NO: 51968 - DNA, 20 bp, Artificial Sequence
  chemically synthesized
tacccttgccctagtaataa

SEQ ID NO: 51969 - DNA, 20 bp, Artificial Sequence
  chemically synthesized
cttgccctagtaataaaagc

SEQ ID NO: 51970 - DNA, 20 bp, Artificial Sequence
  chemically synthesized
ccctagtaataaaagctggt

SEQ ID NO: 51971 - DNA, 20 bp, Artificial Sequence
  chemically synthesized
gtaataaaagctggttggca

SEQ ID NO: 51972 - DNA, 20 bp, Artificial Sequence
  chemically synthesized
taaaagctggttggcaaagc

SEQ ID NO: 51973 - DNA, 20 bp, Artificial Sequence
  chemically synthesized
aagctggttggcaaagctgg

SEQ ID NO: 51974 - DNA, 20 bp, Artificial Sequence
  chemically synthesized
agctggttggcaaagctgga

SEQ ID NO: 51975 - DNA, 20 bp, Artificial Sequence
  chemically synthesized
ctggttggcaaagctggaag

SEQ ID NO: 51976 - DNA, 20 bp, Artificial Sequence
  chemically synthesized
ggagtcacttctacttcatt

SEQ ID NO: 51977 - DNA, 20 bp, Artificial Sequence
  chemically synthesized
tttagcgtgaatcttaaatg

SEQ ID NO: 51978 - DNA, 20 bp, Artificial Sequence
  chemically synthesized
ttagcgtgaatcttaaatgt

SEQ ID NO: 51979 - DNA, 20 bp, Artificial Sequence
  chemically synthesized
gtgaatcttaaatgtaggaa

SEQ ID NO: 51980 - DNA, 20 bp, Artificial Sequence
  chemically synthesized
tgaatcttaaatgtaggaat

SEQ ID NO: 51981 - DNA, 20 bp, Artificial Sequence
  chemically synthesized
aatgtaggaatgggatgtca

SEQ ID NO: 51982 - DNA, 20 bp, Artificial Sequence
  chemically synthesized
tgtcacagaaacactcaccg

SEQ ID NO: 51983 - DNA, 20 bp, Artificial Sequence
  chemically synthesized
gtcacagaaacactcaccgt

SEQ ID NO: 51984 - DNA, 20 bp, Artificial Sequence
  chemically synthesized
tcacagaaacactcaccgta

SEQ ID NO: 51985 - DNA, 20 bp, Artificial Sequence
  chemically synthesized
agaaacactcaccgtagggc

SEQ ID NO: 51986 - DNA, 20 bp, Artificial Sequence
  chemically synthesized
actcaccgtagggccagcct

SEQ ID NO: 51987 - DNA, 20 bp, Artificial Sequence
  chemically synthesized
ccagcctcagacacaaatac

SEQ ID NO: 51988 - DNA, 20 bp, Artificial Sequence
  chemically synthesized
ctcagacacaaataccagtc

SEQ ID NO: 51989 - DNA, 20 bp, Artificial Sequence
  chemically synthesized
gacacaaataccagtccagc

SEQ ID NO: 51990 - DNA, 20 bp, Artificial Sequence
  chemically synthesized
acacaaataccagtccagca

SEQ ID NO: 51991 - DNA, 20 bp, Artificial Sequence
  chemically synthesized
caaataccagtccagcaagg

SEQ ID NO: 51992 - DNA, 20 bp, Artificial Sequence
  chemically synthesized
aataccagtccagcaaggca

SEQ ID NO: 51993 - DNA, 20 bp, Artificial Sequence
  chemically synthesized
ataccagtccagcaaggcag

SEQ ID NO: 51994 - DNA, 20 bp, Artificial Sequence
  chemically synthesized
accagtccagcaaggcagag

SEQ ID NO: 51995 - DNA, 20 bp, Artificial Sequence
  chemically synthesized
ccagtccagcaaggcagagg

SEQ ID NO: 51996 - DNA, 20 bp, Artificial Sequence
  chemically synthesized
agtccagcaaggcagaggag

SEQ ID NO: 51997 - DNA, 20 bp, Artificial Sequence
  chemically synthesized
ccagcaaggcagaggaggag

SEQ ID NO: 51998 - DNA, 20 bp, Artificial Sequence
  chemically synthesized
gcagaggaggagcagacgat

SEQ ID NO: 51999 - DNA, 20 bp, Artificial Sequence
  chemically synthesized
gaggaggagcagacgatgag

SEQ ID NO: 52000 - DNA, 20 bp, Artificial Sequence
  chemically synthesized
cgatgagaagccatcctgcc

SEQ ID NO: 52001 - DNA, 20 bp, Artificial Sequence
  chemically synthesized
gaagccatcctgccaagaat

SEQ ID NO: 52002 - DNA, 20 bp, Artificial Sequence
  chemically synthesized
gccatcctgccaagaatgag

SEQ ID NO: 52003 - DNA, 20 bp, Artificial Sequence
  chemically synthesized
gaatgagtggacttctgtga

SEQ ID NO: 52004 - DNA, 20 bp, Artificial Sequence
  chemically synthesized
acttctgtgatggctgctcc

SEQ ID NO: 52005 - DNA, 20 bp, Artificial Sequence
  chemically synthesized
tgtgatggctgctcccagcc

SEQ ID NO: 52006 - DNA, 20 bp, Artificial Sequence
  chemically synthesized
gtgatggctgctcccagcct

SEQ ID NO: 52007 - DNA, 20 bp, Artificial Sequence
  chemically synthesized
tgatggctgctcccagcctg

SEQ ID NO: 52008 - DNA, 20 bp, Artificial Sequence
  chemically synthesized
cttttatactcacttctcct

SEQ ID NO: 52009 - DNA, 20 bp, Artificial Sequence
  chemically synthesized
tatactcacttctcctgagc

SEQ ID NO: 52010 - DNA, 20 bp, Artificial Sequence
  chemically synthesized
atactcacttctcctgagct

SEQ ID NO: 52011 - DNA, 20 bp, Artificial Sequence
  chemically synthesized
gctgattctgattattgact

SEQ ID NO: 52012 - DNA, 20 bp, Artificial Sequence
  chemically synthesized
aggtttgcagtcagattggc

SEQ ID NO: 52013 - DNA, 20 bp, Artificial Sequence
  chemically synthesized
agcagcctagctcaggagaa

SEQ ID NO: 52014 - DNA, 20 bp, Artificial Sequence
  chemically synthesized
agaagtccactcattcttgg

SEQ ID NO: 52015 - DNA, 20 bp, Artificial Sequence
  chemically synthesized
tgtctgaggctggccctacg

SEQ ID NO: 52016 - DNA, 20 bp, Artificial Sequence
  chemically synthesized
ccagcttttattactagggc

SEQ ID NO: 52017 - DNA, 20 bp, Artificial Sequence
  chemically synthesized
taattaattcaaacttcaaa

SEQ ID NO: 52018 - DNA, 20 bp, Artificial Sequence
  chemically synthesized
tattaaggaagctgttaata

SEQ ID NO: 52019 - DNA, 20 bp, Artificial Sequence
  chemically synthesized
ctaattcttaaatcctctag

SEQ ID NO: 52020 - DNA, 20 bp, Artificial Sequence
  chemically synthesized
gaattaactaatactataaa

SEQ ID NO: 52021 - DNA, 20 bp, Artificial Sequence
  chemically synthesized
actaatactataaaatgggt

SEQ ID NO: 52022 - DNA, 20 bp, Artificial Sequence
  chemically synthesized
ttttataacaactggtaaga

SEQ ID NO: 52023 - DNA, 20 bp, Artificial Sequence
  chemically synthesized
acaattacgtctgtgttata

SEQ ID NO: 52024 - DNA, 20 bp, Artificial Sequence
  chemically synthesized
gacacttacgttcctgataa

SEQ ID NO: 52025 - DNA, 20 bp, Artificial Sequence
  chemically synthesized
tccagatttctaataccaca

SEQ ID NO: 52026 - DNA, 20 bp, Artificial Sequence
  chemically synthesized
tctctacacccagggcaccg

SEQ ID NO: 52027 - DNA, 20 bp, Artificial Sequence
  chemically synthesized
ctttgaccatcagaggacac

SEQ ID NO: 52028 - DNA, 20 bp, Artificial Sequence
  chemically synthesized
cacttggattcaccggtgcc

SEQ ID NO: 52029 - DNA, 20 bp, Artificial Sequence
  chemically synthesized
gagaagttaacaaaattgat

SEQ ID NO: 52030 - DNA, 20 bp, Artificial Sequence
  chemically synthesized
aacaaaattgatcagagtga

SEQ ID NO: 52031 - DNA, 20 bp, Artificial Sequence
  chemically synthesized
ttagaaatctggagcgaaac

SEQ ID NO: 52032 - DNA, 20 bp, Artificial Sequence
  chemically synthesized
gacgtaattgtttccaaagc

SEQ ID NO: 52033 - DNA, 20 bp, Artificial Sequence
  chemically synthesized
cagacacactgctatcaacc

SEQ ID NO: 52034 - DNA, 20 bp, Artificial Sequence
  chemically synthesized
atcaaccagggatgtgtata

SEQ ID NO: 52035 - DNA, 20 bp, Artificial Sequence
  chemically synthesized
gctttgttaaaagtctccat

SEQ ID NO: 52036 - DNA, 20 bp, Artificial Sequence
  chemically synthesized
gttaaaagtctccatttgag

SEQ ID NO: 52037 - DNA, 20 bp, Artificial Sequence
  chemically synthesized
agtattagttaattcttcta

SEQ ID NO: 52038 - DNA, 20 bp, Artificial Sequence
  chemically synthesized
ttaattcttctagaggattt

SEQ ID NO: 52039 - DNA, 20 bp, Artificial Sequence
  chemically synthesized
ttaagaattagatatctgac

SEQ ID NO: 52040 - DNA, 20 bp, Artificial Sequence
  chemically synthesized
gattaatcaataaatacgtt

SEQ ID NO: 52041 - DNA, 20 bp, Artificial Sequence
  chemically synthesized
gttttgaataactatagggc

SEQ ID NO: 52042 - DNA, 20 bp, Artificial Sequence
  chemically synthesized
cccccaaatacattttatgg

SEQ ID NO: 52043 - DNA, 20 bp, Artificial Sequence
  chemically synthesized
aatgcaccaaagcaatgagg

SEQ ID NO: 52044 - DNA, 20 bp, Artificial Sequence
  chemically synthesized
aagcaatgaggtagaatgct

SEQ ID NO: 52045 - DNA, 20 bp, Artificial Sequence
  chemically synthesized
aacttcattctttttgaagt

SEQ ID NO: 52046 - DNA, 20 bp, Artificial Sequence
  chemically synthesized
aattatattaaaaatagatg

SEQ ID NO: 52047 - DNA, 20 bp, Artificial Sequence
  chemically synthesized
agctggttggcaaagctgga

SEQ ID NO: 52048 - DNA, 20 bp, Artificial Sequence
  chemically synthesized
tcacttctacttcatttagc

SEQ ID NO: 52049 - DNA, 20 bp, Artificial Sequence
  chemically synthesized
ttagcgtgaatcttaaatgt

SEQ ID NO: 52050 - DNA, 20 bp, Artificial Sequence
  chemically synthesized
gtgaatcttaaatgtaggaa

SEQ ID NO: 52051 - DNA, 20 bp, Artificial Sequence
  chemically synthesized
cgatgagaagccatcctgcc

SEQ ID NO: 52052 - DNA, 20 bp, Artificial Sequence
  chemically synthesized
gagaagccatcctgccaaga

SEQ ID NO: 52053 - DNA, 20 bp, Artificial Sequence
  chemically synthesized
ataattaattcaaacttcaa

SEQ ID NO: 52054 - DNA, 20 bp, Artificial Sequence
  chemically synthesized
tctgtttcctcagatagatg

SEQ ID NO: 52055 - DNA, 20 bp, Artificial Sequence
  chemically synthesized
aagctgttaatactgaattt

SEQ ID NO: 52056 - DNA, 20 bp, Artificial Sequence
  chemically synthesized
tctaattcttaaatcctcta

SEQ ID NO: 52057 - DNA, 20 bp, Artificial Sequence
  chemically synthesized
tgatagcagtgtgtctggag

SEQ ID NO: 52058 - DNA, 20 bp, Artificial Sequence
  chemically synthesized
ctccagatttctaataccac

SEQ ID NO: 52059 - DNA, 20 bp, Artificial Sequence
  chemically synthesized
caatgtggccgtgcatgtgt

SEQ ID NO: 52060 - DNA, 20 bp, Artificial Sequence
  chemically synthesized
aggatttattctttgtggta

SEQ ID NO: 52061 - DNA, 20 bp, Artificial Sequence
  chemically synthesized
attagaaatctggagcgaaa

SEQ ID NO: 52062 - DNA, 20 bp, Artificial Sequence
  chemically synthesized
agacgtaattgtttccaaag

SEQ ID NO: 52063 - DNA, 20 bp, Artificial Sequence
  chemically synthesized
tgtgtataatgaattttaag

SEQ ID NO: 52064 - DNA, 20 bp, Artificial Sequence
  chemically synthesized
gttaattcttctagaggatt

SEQ ID NO: 52065 - DNA, 20 bp, Artificial Sequence
  chemically synthesized
tttaagaattagatatctga

SEQ ID NO: 52066 - DNA, 20 bp, Artificial Sequence
  chemically synthesized
cgttttgaataactataggg

SEQ ID NO: 52067 - DNA, 20 bp, Artificial Sequence
  chemically synthesized
taatgcaccaaagcaatgag

SEQ ID NO: 52068 - DNA, 20 bp, Artificial Sequence
  chemically synthesized
aaatgtaggaatgggatgtc

SEQ ID NO: 52069 - DNA, 20 bp, Artificial Sequence
  chemically synthesized
acgatgagaagccatcctgc

SEQ ID NO: 52070 - DNA, 20 bp, Artificial Sequence
  chemically synthesized
attctggccctatagttatt

SEQ ID NO: 52071 - DNA, 20 bp, Artificial Sequence
  chemically synthesized
aacaactaaaatgatctcag

SEQ ID NO: 52072 - DNA, 20 bp, Artificial Sequence
  chemically synthesized
taagtcaataatcagaatca

SEQ ID NO: 52073 - DNA, 20 bp, Artificial Sequence
  chemically synthesized
tcagaatcagcaggtttgca

SEQ ID NO: 52074 - DNA, 20 bp, Artificial Sequence
  chemically synthesized
agtccactcattcttggcag

SEQ ID NO: 52075 - DNA, 20 bp, Artificial Sequence
  chemically synthesized
tctgaggctggccctacggt

SEQ ID NO: 52076 - DNA, 20 bp, Artificial Sequence
  chemically synthesized
gtgacatcccattcctacat

SEQ ID NO: 52077 - DNA, 20 bp, Artificial Sequence
  chemically synthesized
atgaagtagaagtgactcct

SEQ ID NO: 52078 - DNA, 20 bp, Artificial Sequence
  chemically synthesized
gactccttccagctttgcca

SEQ ID NO: 52079 - DNA, 20 bp, Artificial Sequence
  chemically synthesized
tcaaaaagaatgaagttcca

SEQ ID NO: 52080 - DNA, 20 bp, Artificial Sequence
  chemically synthesized
gaactctgagcattctacct

SEQ ID NO: 52081 - DNA, 20 bp, Artificial Sequence
  chemically synthesized
tacctcattgctttggtgca

SEQ ID NO: 52082 - DNA, 20 bp, Artificial Sequence
  chemically synthesized
aggtttgtaatatctggtac

SEQ ID NO: 52083 - DNA, 20 bp, Artificial Sequence
  chemically synthesized
gtatttgggggacaaactgc

SEQ ID NO: 52084 - DNA, 20 bp, Artificial Sequence
  chemically synthesized
atagttattcaaaacgtatt

SEQ ID NO: 52085 - DNA, 20 bp, Artificial Sequence
  chemically synthesized
tatttattgattaatcttta

SEQ ID NO: 52086 - DNA, 20 bp, Artificial Sequence
  chemically synthesized
actaaaatgatctcaggaaa

SEQ ID NO: 52087 - DNA, 20 bp, Artificial Sequence
  chemically synthesized
tgtctggaggcagaaaccat

SEQ ID NO: 52088 - DNA, 20 bp, Artificial Sequence
  chemically synthesized
taatgggatcagtgtgtaat

SEQ ID NO: 52089 - DNA, 20 bp, Artificial Sequence
  chemically synthesized
gtgtgtaattcttgtttcgc

SEQ ID NO: 52090 - DNA, 20 bp, Artificial Sequence
  chemically synthesized
actttgaccatcagaggaca

SEQ ID NO: 52091 - DNA, 20 bp, Artificial Sequence
  chemically synthesized
taacaaaattgatcagagtg

SEQ ID NO: 52092 - DNA, 20 bp, Artificial Sequence
  chemically synthesized
aacgtaagtgtcgacaatta

SEQ ID NO: 52093 - DNA, 20 bp, Artificial Sequence
  chemically synthesized
actcagtataacacagacgt

SEQ ID NO: 52094 - DNA, 20 bp, Artificial Sequence
  chemically synthesized
gtaattgtttccaaagcaag

SEQ ID NO: 52095 - DNA, 20 bp, Artificial Sequence
  chemically synthesized
aaaataggtcccctgagaac

SEQ ID NO: 52096 - DNA, 20 bp, Artificial Sequence
  chemically synthesized
tgtaccatacatagggccaa

SEQ ID NO: 52097 - DNA, 20 bp, Artificial Sequence
  chemically synthesized
tagtattagttaattcttct

SEQ ID NO: 52098 - DNA, 20 bp, Artificial Sequence
  chemically synthesized
atattgttcactaagccttt

SEQ ID NO: 52099 - DNA, 20 bp, Artificial Sequence
  chemically synthesized
ttttaaagattaatcaataa

SEQ ID NO: 52100 - DNA, 20 bp, Artificial Sequence
  chemically synthesized
agggccagaatataatctcc

SEQ ID NO: 52101 - DNA, 20 bp, Artificial Sequence
  chemically synthesized
ttttctgaaaattcagtatt

SEQ ID NO: 52102 - DNA, 20 bp, Artificial Sequence
  chemically synthesized
cagtggaacttcattctttt

SEQ ID NO: 52103 - DNA, 20 bp, Artificial Sequence
  chemically synthesized
tgtgatggctgctcccagcc

SEQ ID NO: 52104 - DNA, 20 bp, Artificial Sequence
  chemically synthesized
tactcacttctcctgagcta

SEQ ID NO: 52105 - DNA, 20 bp, Artificial Sequence
  chemically synthesized
tgccaatctgactgcaaacc

SEQ ID NO: 52106 - DNA, 20 bp, Artificial Sequence
  chemically synthesized
tctgactgcaaacctgctga

SEQ ID NO: 52107 - DNA, 22 bp, Artificial Sequence
  chemically synthesized
actaagtcaataatcagaatca

SEQ ID NO: 52108 - DNA, 22 bp, Artificial Sequence
  chemically synthesized
agtcaataatcagaatcagcag

SEQ ID NO: 52109 - DNA, 22 bp, Artificial Sequence
  chemically synthesized
gcagtcagattggcagggataa

SEQ ID NO: 52110 - DNA, 22 bp, Artificial Sequence
  chemically synthesized
cagtcagattggcagggataag

SEQ ID NO: 52111 - DNA, 22 bp, Artificial Sequence
  chemically synthesized
gcagggataagcagcctagctc

SEQ ID NO: 52112 - DNA, 22 bp, Artificial Sequence
  chemically synthesized
gctcaggagaagtgagtataaa

SEQ ID NO: 52113 - DNA, 22 bp, Artificial Sequence
  chemically synthesized
aggagaagtgagtataaaagcc

SEQ ID NO: 52114 - DNA, 22 bp, Artificial Sequence
  chemically synthesized
ggagcagccatcacagaagtcc

SEQ ID NO: 52115 - DNA, 22 bp, Artificial Sequence
  chemically synthesized
attcttggcaggatggcttctc

SEQ ID NO: 52116 - DNA, 22 bp, Artificial Sequence
  chemically synthesized
ttggcaggatggcttctcatcg

SEQ ID NO: 52117 - DNA, 22 bp, Artificial Sequence
  chemically synthesized
ggcaggatggcttctcatcgtc

SEQ ID NO: 52118 - DNA, 22 bp, Artificial Sequence
  chemically synthesized
gcaggatggcttctcatcgtct

SEQ ID NO: 52119 - DNA, 22 bp, Artificial Sequence
  chemically synthesized
ctcatcgtctgctcctcctctg

SEQ ID NO: 52120 - DNA, 22 bp, Artificial Sequence
  chemically synthesized
tcatcgtctgctcctcctctgc

SEQ ID NO: 52121 - DNA, 22 bp, Artificial Sequence
  chemically synthesized
atcgtctgctcctcctctgcct

SEQ ID NO: 52122 - DNA, 22 bp, Artificial Sequence
  chemically synthesized
ctcctcctctgccttgctggac

SEQ ID NO: 52123 - DNA, 22 bp, Artificial Sequence
  chemically synthesized
ctcctctgccttgctggactgg

SEQ ID NO: 52124 - DNA, 22 bp, Artificial Sequence
  chemically synthesized
ctctgccttgctggactggtat

SEQ ID NO: 52125 - DNA, 22 bp, Artificial Sequence
  chemically synthesized
tgccttgctggactggtatttg

SEQ ID NO: 52126 - DNA, 22 bp, Artificial Sequence
  chemically synthesized
ccttgctggactggtatttgtg

SEQ ID NO: 52127 - DNA, 22 bp, Artificial Sequence
  chemically synthesized
gctggactggtatttgtgtctg

SEQ ID NO: 52128 - DNA, 22 bp, Artificial Sequence
  chemically synthesized
ctggactggtatttgtgtctga

SEQ ID NO: 52129 - DNA, 22 bp, Artificial Sequence
  chemically synthesized
gactggtatttgtgtctgaggc

SEQ ID NO: 52130 - DNA, 22 bp, Artificial Sequence
  chemically synthesized
gtatttgtgtctgaggctggcc

SEQ ID NO: 52131 - DNA, 22 bp, Artificial Sequence
  chemically synthesized
gtgtctgaggctggccctacgg

SEQ ID NO: 52132 - DNA, 22 bp, Artificial Sequence
  chemically synthesized
tgtctgaggctggccctacggt

SEQ ID NO: 52133 - DNA, 22 bp, Artificial Sequence
  chemically synthesized
aggctggccctacggtgagtgt

SEQ ID NO: 52134 - DNA, 22 bp, Artificial Sequence
  chemically synthesized
gccctacggtgagtgtttctgt

SEQ ID NO: 52135 - DNA, 22 bp, Artificial Sequence
  chemically synthesized
cggtgagtgtttctgtgacatc

SEQ ID NO: 52136 - DNA, 22 bp, Artificial Sequence
  chemically synthesized
ctgtgacatcccattcctacat

SEQ ID NO: 52137 - DNA, 22 bp, Artificial Sequence
  chemically synthesized
tgtgacatcccattcctacatt

SEQ ID NO: 52138 - DNA, 22 bp, Artificial Sequence
  chemically synthesized
tgacatcccattcctacattta

SEQ ID NO: 52139 - DNA, 22 bp, Artificial Sequence
  chemically synthesized
ctacatttaagattcacgctaa

SEQ ID NO: 52140 - DNA, 22 bp, Artificial Sequence
  chemically synthesized
catttaagattcacgctaaatg

SEQ ID NO: 52141 - DNA, 22 bp, Artificial Sequence
  chemically synthesized
aagattcacgctaaatgaagta

SEQ ID NO: 52142 - DNA, 22 bp, Artificial Sequence
  chemically synthesized
agattcacgctaaatgaagtag

SEQ ID NO: 52143 - DNA, 22 bp, Artificial Sequence
  chemically synthesized
acgctaaatgaagtagaagtga

SEQ ID NO: 52144 - DNA, 22 bp, Artificial Sequence
  chemically synthesized
aatgaagtagaagtgactcctt

SEQ ID NO: 52145 - DNA, 22 bp, Artificial Sequence
  chemically synthesized
cttccagctttgccaaccagct

SEQ ID NO: 52146 - DNA, 22 bp, Artificial Sequence
  chemically synthesized
ccagctttgccaaccagctttt

SEQ ID NO: 52147 - DNA, 22 bp, Artificial Sequence
  chemically synthesized
cagctttgccaaccagctttta

SEQ ID NO: 52148 - DNA, 22 bp, Artificial Sequence
  chemically synthesized
tgccaaccagcttttattacta

SEQ ID NO: 52149 - DNA, 22 bp, Artificial Sequence
  chemically synthesized
gccaaccagcttttattactag

SEQ ID NO: 52150 - DNA, 22 bp, Artificial Sequence
  chemically synthesized
ccaaccagcttttattactagg

SEQ ID NO: 52151 - DNA, 22 bp, Artificial Sequence
  chemically synthesized
ttattactagggcaagggtacc

SEQ ID NO: 52152 - DNA, 22 bp, Artificial Sequence
  chemically synthesized
tattactagggcaagggtaccc

SEQ ID NO: 52153 - DNA, 22 bp, Artificial Sequence
  chemically synthesized
attactagggcaagggtaccca

SEQ ID NO: 52154 - DNA, 22 bp, Artificial Sequence
  chemically synthesized
ttactagggcaagggtacccag

SEQ ID NO: 52155 - DNA, 22 bp, Artificial Sequence
  chemically synthesized
ctagggcaagggtacccagcat

SEQ ID NO: 52156 - DNA, 22 bp, Artificial Sequence
  chemically synthesized
gggcaagggtacccagcatcta

SEQ ID NO: 52157 - DNA, 22 bp, Artificial Sequence
  chemically synthesized
tttttaatataattaattcaaa

SEQ ID NO: 52158 - DNA, 22 bp, Artificial Sequence
  chemically synthesized
ttaatataattaattcaaactt

SEQ ID NO: 52159 - DNA, 22 bp, Artificial Sequence
  chemically synthesized
taatataattaattcaaacttc

SEQ ID NO: 52160 - DNA, 22 bp, Artificial Sequence
  chemically synthesized
aatataattaattcaaacttca

SEQ ID NO: 52161 - DNA, 22 bp, Artificial Sequence
  chemically synthesized
atataattaattcaaacttcaa

SEQ ID NO: 52162 - DNA, 22 bp, Artificial Sequence
  chemically synthesized
attcaaacttcaaaaagaatga

SEQ ID NO: 52163 - DNA, 22 bp, Artificial Sequence
  chemically synthesized
aaacttcaaaaagaatgaagtt

SEQ ID NO: 52164 - DNA, 22 bp, Artificial Sequence
  chemically synthesized
caaaaagaatgaagttccactg

SEQ ID NO: 52165 - DNA, 22 bp, Artificial Sequence
  chemically synthesized
aaaaagaatgaagttccactga

SEQ ID NO: 52166 - DNA, 22 bp, Artificial Sequence
  chemically synthesized
cactgagcttactgagctggga

SEQ ID NO: 52167 - DNA, 22 bp, Artificial Sequence
  chemically synthesized
agcttactgagctgggacttga

SEQ ID NO: 52168 - DNA, 22 bp, Artificial Sequence
  chemically synthesized
actgagctgggacttgaactct

SEQ ID NO: 52169 - DNA, 22 bp, Artificial Sequence
  chemically synthesized
ctgagctgggacttgaactctg

SEQ ID NO: 52170 - DNA, 22 bp, Artificial Sequence
  chemically synthesized
agctgggacttgaactctgagc

SEQ ID NO: 52171 - DNA, 22 bp, Artificial Sequence
  chemically synthesized
ggacttgaactctgagcattct

SEQ ID NO: 52172 - DNA, 22 bp, Artificial Sequence
  chemically synthesized
gaactctgagcattctacctca

SEQ ID NO: 52173 - DNA, 22 bp, Artificial Sequence
  chemically synthesized
aactctgagcattctacctcat

SEQ ID NO: 52174 - DNA, 22 bp, Artificial Sequence
  chemically synthesized
tgagcattctacctcattgctt

SEQ ID NO: 52175 - DNA, 22 bp, Artificial Sequence
  chemically synthesized
agcattctacctcattgctttg

SEQ ID NO: 52176 - DNA, 22 bp, Artificial Sequence
  chemically synthesized
tacctcattgctttggtgcatt

SEQ ID NO: 52177 - DNA, 22 bp, Artificial Sequence
  chemically synthesized
cctcattgctttggtgcattag

SEQ ID NO: 52178 - DNA, 22 bp, Artificial Sequence
  chemically synthesized
attgctttggtgcattaggttt

SEQ ID NO: 52179 - DNA, 22 bp, Artificial Sequence
  chemically synthesized
ctttggtgcattaggtttgtaa

SEQ ID NO: 52180 - DNA, 22 bp, Artificial Sequence
  chemically synthesized
tggtgcattaggtttgtaatat

SEQ ID NO: 52181 - DNA, 22 bp, Artificial Sequence
  chemically synthesized
ggtgcattaggtttgtaatatc

SEQ ID NO: 52182 - DNA, 22 bp, Artificial Sequence
  chemically synthesized
gtgcattaggtttgtaatatct

SEQ ID NO: 52183 - DNA, 22 bp, Artificial Sequence
  chemically synthesized
ggtttgtaatatctggtacctc

SEQ ID NO: 52184 - DNA, 22 bp, Artificial Sequence
  chemically synthesized
gtaatatctggtacctctgttt

SEQ ID NO: 52185 - DNA, 22 bp, Artificial Sequence
  chemically synthesized
taatatctggtacctctgtttc

SEQ ID NO: 52186 - DNA, 22 bp, Artificial Sequence
  chemically synthesized
gtacctctgtttcctcagatag

SEQ ID NO: 52187 - DNA, 22 bp, Artificial Sequence
  chemically synthesized
tgtttcctcagatagatgatag

SEQ ID NO: 52188 - DNA, 22 bp, Artificial Sequence
  chemically synthesized
tttcctcagatagatgatagaa

SEQ ID NO: 52189 - DNA, 22 bp, Artificial Sequence
  chemically synthesized
cctcagatagatgatagaaata

SEQ ID NO: 52190 - DNA, 22 bp, Artificial Sequence
  chemically synthesized
ctcagatagatgatagaaataa

SEQ ID NO: 52191 - DNA, 22 bp, Artificial Sequence
  chemically synthesized
agatagatgatagaaataaaga

SEQ ID NO: 52192 - DNA, 22 bp, Artificial Sequence
  chemically synthesized
aggaagctgttaatactgaatt

SEQ ID NO: 52193 - DNA, 22 bp, Artificial Sequence
  chemically synthesized
ttaatactgaattttcagaaaa

SEQ ID NO: 52194 - DNA, 22 bp, Artificial Sequence
  chemically synthesized
atactgaattttcagaaaagta

SEQ ID NO: 52195 - DNA, 22 bp, Artificial Sequence
  chemically synthesized
aattttcagaaaagtatccctc

SEQ ID NO: 52196 - DNA, 22 bp, Artificial Sequence
  chemically synthesized
tcagaaaagtatccctccataa

SEQ ID NO: 52197 - DNA, 22 bp, Artificial Sequence
  chemically synthesized
cagaaaagtatccctccataaa

SEQ ID NO: 52198 - DNA, 22 bp, Artificial Sequence
  chemically synthesized
agaaaagtatccctccataaaa

SEQ ID NO: 52199 - DNA, 22 bp, Artificial Sequence
  chemically synthesized
cataaaatgtatttgggggaca

SEQ ID NO: 52200 - DNA, 22 bp, Artificial Sequence
  chemically synthesized
gggggacaaactgcaggagatt

SEQ ID NO: 52201 - DNA, 22 bp, Artificial Sequence
  chemically synthesized
ggggacaaactgcaggagatta

SEQ ID NO: 52202 - DNA, 22 bp, Artificial Sequence
  chemically synthesized
caggagattatattctggccct

SEQ ID NO: 52203 - DNA, 22 bp, Artificial Sequence
  chemically synthesized
tattctggccctatagttattc

SEQ ID NO: 52204 - DNA, 22 bp, Artificial Sequence
  chemically synthesized
tggccctatagttattcaaaac

SEQ ID NO: 52205 - DNA, 22 bp, Artificial Sequence
  chemically synthesized
gccctatagttattcaaaacgt

SEQ ID NO: 52206 - DNA, 22 bp, Artificial Sequence
  chemically synthesized
tagttattcaaaacgtatttat

SEQ ID NO: 52207 - DNA, 22 bp, Artificial Sequence
  chemically synthesized
ttcaaaacgtatttattgatta

SEQ ID NO: 52208 - DNA, 22 bp, Artificial Sequence
  chemically synthesized
aaaacgtatttattgattaatc

SEQ ID NO: 52209 - DNA, 22 bp, Artificial Sequence
  chemically synthesized
attgattaatctttaaaaggct

SEQ ID NO: 52210 - DNA, 22 bp, Artificial Sequence
  chemically synthesized
ttgattaatctttaaaaggctt

SEQ ID NO: 52211 - DNA, 22 bp, Artificial Sequence
  chemically synthesized
attaatctttaaaaggcttagt

SEQ ID NO: 52212 - DNA, 22 bp, Artificial Sequence
  chemically synthesized
atctttaaaaggcttagtgaac

SEQ ID NO: 52213 - DNA, 22 bp, Artificial Sequence
  chemically synthesized
taaaaggcttagtgaacaatat

SEQ ID NO: 52214 - DNA, 22 bp, Artificial Sequence
  chemically synthesized
aaaaggcttagtgaacaatatt

SEQ ID NO: 52215 - DNA, 22 bp, Artificial Sequence
  chemically synthesized
aaaggcttagtgaacaatattc

SEQ ID NO: 52216 - DNA, 22 bp, Artificial Sequence
  chemically synthesized
agtgaacaatattctagtcaga

SEQ ID NO: 52217 - DNA, 22 bp, Artificial Sequence
  chemically synthesized
gtgaacaatattctagtcagat

SEQ ID NO: 52218 - DNA, 22 bp, Artificial Sequence
  chemically synthesized
tagtcagatatctaattcttaa

SEQ ID NO: 52219 - DNA, 22 bp, Artificial Sequence
  chemically synthesized
gtcagatatctaattcttaaat

SEQ ID NO: 52220 - DNA, 22 bp, Artificial Sequence
  chemically synthesized
attcttaaatcctctagaagaa

SEQ ID NO: 52221 - DNA, 22 bp, Artificial Sequence
  chemically synthesized
ttaaatcctctagaagaattaa

SEQ ID NO: 52222 - DNA, 22 bp, Artificial Sequence
  chemically synthesized
aaatcctctagaagaattaact

SEQ ID NO: 52223 - DNA, 22 bp, Artificial Sequence
  chemically synthesized
aatcctctagaagaattaacta

SEQ ID NO: 52224 - DNA, 22 bp, Artificial Sequence
  chemically synthesized
tagaagaattaactaatactat

SEQ ID NO: 52225 - DNA, 22 bp, Artificial Sequence
  chemically synthesized
gaagaattaactaatactataa

SEQ ID NO: 52226 - DNA, 22 bp, Artificial Sequence
  chemically synthesized
actaatactataaaatgggtct

SEQ ID NO: 52227 - DNA, 22 bp, Artificial Sequence
  chemically synthesized
atactataaaatgggtctggat

SEQ ID NO: 52228 - DNA, 22 bp, Artificial Sequence
  chemically synthesized
taaaatgggtctggatgtagtt

SEQ ID NO: 52229 - DNA, 22 bp, Artificial Sequence
  chemically synthesized
gatgtagttctgacattatttt

SEQ ID NO: 52230 - DNA, 22 bp, Artificial Sequence
  chemically synthesized
tgacattattttataacaactg

SEQ ID NO: 52231 - DNA, 22 bp, Artificial Sequence
  chemically synthesized
acattattttataacaactggt

SEQ ID NO: 52232 - DNA, 22 bp, Artificial Sequence
  chemically synthesized
ttttataacaactggtaagagg

SEQ ID NO: 52233 - DNA, 22 bp, Artificial Sequence
  chemically synthesized
tataacaactggtaagagggag

SEQ ID NO: 52234 - DNA, 22 bp, Artificial Sequence
  chemically synthesized
ataacaactggtaagagggagt

SEQ ID NO: 52235 - DNA, 22 bp, Artificial Sequence
  chemically synthesized
taacaactggtaagagggagtg

SEQ ID NO: 52236 - DNA, 22 bp, Artificial Sequence
  chemically synthesized
gtaagagggagtgactatagca

SEQ ID NO: 52237 - DNA, 22 bp, Artificial Sequence
  chemically synthesized
tagcaacaactaaaatgatctc

SEQ ID NO: 52238 - DNA, 22 bp, Artificial Sequence
  chemically synthesized
aaatgatctcaggaaaacctgt

SEQ ID NO: 52239 - DNA, 22 bp, Artificial Sequence
  chemically synthesized
aggaaaacctgtttggccctat

SEQ ID NO: 52240 - DNA, 22 bp, Artificial Sequence
  chemically synthesized
tttggccctatgtatggtacat

SEQ ID NO: 52241 - DNA, 22 bp, Artificial Sequence
  chemically synthesized
ggccctatgtatggtacattac

SEQ ID NO: 52242 - DNA, 22 bp, Artificial Sequence
  chemically synthesized
gccctatgtatggtacattaca

SEQ ID NO: 52243 - DNA, 22 bp, Artificial Sequence
  chemically synthesized
tgtatggtacattacatctttt

SEQ ID NO: 52244 - DNA, 22 bp, Artificial Sequence
  chemically synthesized
catcttttcagtaattccactc

SEQ ID NO: 52245 - DNA, 22 bp, Artificial Sequence
  chemically synthesized
ttcagtaattccactcaaatgg

SEQ ID NO: 52246 - DNA, 22 bp, Artificial Sequence
  chemically synthesized
tcagtaattccactcaaatgga

SEQ ID NO: 52247 - DNA, 22 bp, Artificial Sequence
  chemically synthesized
cagtaattccactcaaatggag

SEQ ID NO: 52248 - DNA, 22 bp, Artificial Sequence
  chemically synthesized
agtaattccactcaaatggaga

SEQ ID NO: 52249 - DNA, 22 bp, Artificial Sequence
  chemically synthesized
cactcaaatggagacttttaac

SEQ ID NO: 52250 - DNA, 22 bp, Artificial Sequence
  chemically synthesized
aaatggagacttttaacaaagc

SEQ ID NO: 52251 - DNA, 22 bp, Artificial Sequence
  chemically synthesized
ttaacaaagcaactgttctcag

SEQ ID NO: 52252 - DNA, 22 bp, Artificial Sequence
  chemically synthesized
taacaaagcaactgttctcagg

SEQ ID NO: 52253 - DNA, 22 bp, Artificial Sequence
  chemically synthesized
aacaaagcaactgttctcaggg

SEQ ID NO: 52254 - DNA, 22 bp, Artificial Sequence
  chemically synthesized
acaaagcaactgttctcagggg

SEQ ID NO: 52255 - DNA, 22 bp, Artificial Sequence
  chemically synthesized
ttctcaggggacctattttctc

SEQ ID NO: 52256 - DNA, 22 bp, Artificial Sequence
  chemically synthesized
tcaggggacctattttctccct

SEQ ID NO: 52257 - DNA, 22 bp, Artificial Sequence
  chemically synthesized
aggggacctattttctccctta

SEQ ID NO: 52258 - DNA, 22 bp, Artificial Sequence
  chemically synthesized
ttttctcccttaaaattcatta

SEQ ID NO: 52259 - DNA, 22 bp, Artificial Sequence
  chemically synthesized
tctcccttaaaattcattatac

SEQ ID NO: 52260 - DNA, 22 bp, Artificial Sequence
  chemically synthesized
ctcccttaaaattcattataca

SEQ ID NO: 52261 - DNA, 22 bp, Artificial Sequence
  chemically synthesized
tcccttaaaattcattatacac

SEQ ID NO: 52262 - DNA, 22 bp, Artificial Sequence
  chemically synthesized
ccttaaaattcattatacacat

SEQ ID NO: 52263 - DNA, 22 bp, Artificial Sequence
  chemically synthesized
aaaattcattatacacatccct

SEQ ID NO: 52264 - DNA, 22 bp, Artificial Sequence
  chemically synthesized
aaattcattatacacatccctg

SEQ ID NO: 52265 - DNA, 22 bp, Artificial Sequence
  chemically synthesized
attatacacatccctggttgat

SEQ ID NO: 52266 - DNA, 22 bp, Artificial Sequence
  chemically synthesized
tacacatccctggttgatagca

SEQ ID NO: 52267 - DNA, 22 bp, Artificial Sequence
  chemically synthesized
gttgatagcagtgtgtctggag

SEQ ID NO: 52268 - DNA, 22 bp, Artificial Sequence
  chemically synthesized
atagcagtgtgtctggaggcag

SEQ ID NO: 52269 - DNA, 22 bp, Artificial Sequence
  chemically synthesized
gaggcagaaaccattcttgctt

SEQ ID NO: 52270 - DNA, 22 bp, Artificial Sequence
  chemically synthesized
ttgctttggaaacaattacgtc

SEQ ID NO: 52271 - DNA, 22 bp, Artificial Sequence
  chemically synthesized
gctttggaaacaattacgtctg

SEQ ID NO: 52272 - DNA, 22 bp, Artificial Sequence
  chemically synthesized
ctttggaaacaattacgtctgt

SEQ ID NO: 52273 - DNA, 22 bp, Artificial Sequence
  chemically synthesized
tggaaacaattacgtctgtgtt

SEQ ID NO: 52274 - DNA, 22 bp, Artificial Sequence
  chemically synthesized
ggaaacaattacgtctgtgtta

SEQ ID NO: 52275 - DNA, 22 bp, Artificial Sequence
  chemically synthesized
gaaacaattacgtctgtgttat

SEQ ID NO: 52276 - DNA, 22 bp, Artificial Sequence
  chemically synthesized
cgtctgtgttatactgagtagg

SEQ ID NO: 52277 - DNA, 22 bp, Artificial Sequence
  chemically synthesized
tgttatactgagtagggaagct

SEQ ID NO: 52278 - DNA, 22 bp, Artificial Sequence
  chemically synthesized
tactgagtagggaagctcatta

SEQ ID NO: 52279 - DNA, 22 bp, Artificial Sequence
  chemically synthesized
agtagggaagctcattaattgt

SEQ ID NO: 52280 - DNA, 22 bp, Artificial Sequence
  chemically synthesized
attaattgtcgacacttacgtt

SEQ ID NO: 52281 - DNA, 22 bp, Artificial Sequence
  chemically synthesized
attgtcgacacttacgttcctg

SEQ ID NO: 52282 - DNA, 22 bp, Artificial Sequence
  chemically synthesized
tcgacacttacgttcctgataa

SEQ ID NO: 52283 - DNA, 22 bp, Artificial Sequence
  chemically synthesized
acgttcctgataatgggatcag

SEQ ID NO: 52284 - DNA, 22 bp, Artificial Sequence
  chemically synthesized
cgttcctgataatgggatcagt

SEQ ID NO: 52285 - DNA, 22 bp, Artificial Sequence
  chemically synthesized
ctgataatgggatcagtgtgta

SEQ ID NO: 52286 - DNA, 22 bp, Artificial Sequence
  chemically synthesized
ataatgggatcagtgtgtaatt

SEQ ID NO: 52287 - DNA, 22 bp, Artificial Sequence
  chemically synthesized
ttgtttcgctccagatttctaa

SEQ ID NO: 52288 - DNA, 22 bp, Artificial Sequence
  chemically synthesized
gtttcgctccagatttctaata

SEQ ID NO: 52289 - DNA, 22 bp, Artificial Sequence
  chemically synthesized
tttcgctccagatttctaatac

SEQ ID NO: 52290 - DNA, 22 bp, Artificial Sequence
  chemically synthesized
cgctccagatttctaataccac

SEQ ID NO: 52291 - DNA, 22 bp, Artificial Sequence
  chemically synthesized
gctccagatttctaataccaca

SEQ ID NO: 52292 - DNA, 22 bp, Artificial Sequence
  chemically synthesized
cagatttctaataccacaaaga

SEQ ID NO: 52293 - DNA, 22 bp, Artificial Sequence
  chemically synthesized
ctaataccacaaagaataaatc

SEQ ID NO: 52294 - DNA, 22 bp, Artificial Sequence
  chemically synthesized
taataccacaaagaataaatcc

SEQ ID NO: 52295 - DNA, 22 bp, Artificial Sequence
  chemically synthesized
ataccacaaagaataaatcctt

SEQ ID NO: 52296 - DNA, 22 bp, Artificial Sequence
  chemically synthesized
tcactctgatcaattttgttaa

SEQ ID NO: 52297 - DNA, 22 bp, Artificial Sequence
  chemically synthesized
cactctgatcaattttgttaac

SEQ ID NO: 52298 - DNA, 22 bp, Artificial Sequence
  chemically synthesized
actctgatcaattttgttaact

SEQ ID NO: 52299 - DNA, 22 bp, Artificial Sequence
  chemically synthesized
tgatcaattttgttaacttctc

SEQ ID NO: 52300 - DNA, 22 bp, Artificial Sequence
  chemically synthesized
atcaattttgttaacttctcac

SEQ ID NO: 52301 - DNA, 22 bp, Artificial Sequence
  chemically synthesized
tgttaacttctcacgtgtcttc

SEQ ID NO: 52302 - DNA, 22 bp, Artificial Sequence
  chemically synthesized
gttaacttctcacgtgtcttct

SEQ ID NO: 52303 - DNA, 22 bp, Artificial Sequence
  chemically synthesized
ttaacttctcacgtgtcttctc

SEQ ID NO: 52304 - DNA, 22 bp, Artificial Sequence
  chemically synthesized
acttctcacgtgtcttctctac

SEQ ID NO: 52305 - DNA, 22 bp, Artificial Sequence
  chemically synthesized
ctcacgtgtcttctctacaccc

SEQ ID NO: 52306 - DNA, 22 bp, Artificial Sequence
  chemically synthesized
tcacgtgtcttctctacaccca

SEQ ID NO: 52307 - DNA, 22 bp, Artificial Sequence
  chemically synthesized
acgtgtcttctctacacccagg

SEQ ID NO: 52308 - DNA, 22 bp, Artificial Sequence
  chemically synthesized
ctctacacccagggcaccggtg

SEQ ID NO: 52309 - DNA, 22 bp, Artificial Sequence
  chemically synthesized
tctacacccagggcaccggtga

SEQ ID NO: 52310 - DNA, 22 bp, Artificial Sequence
  chemically synthesized
tacacccagggcaccggtgaat

SEQ ID NO: 52311 - DNA, 22 bp, Artificial Sequence
  chemically synthesized
cacccagggcaccggtgaatcc

SEQ ID NO: 52312 - DNA, 22 bp, Artificial Sequence
  chemically synthesized
tgatggtcaaagttctagatgc

SEQ ID NO: 52313 - DNA, 22 bp, Artificial Sequence
  chemically synthesized
atggtcaaagttctagatgctg

SEQ ID NO: 52314 - DNA, 22 bp, Artificial Sequence
  chemically synthesized
tagatgctgtccgaggcagtcc

SEQ ID NO: 52315 - DNA, 22 bp, Artificial Sequence
  chemically synthesized
gatgctgtccgaggcagtcctg

SEQ ID NO: 52316 - DNA, 22 bp, Artificial Sequence
  chemically synthesized
tccgaggcagtcctgccatcaa

SEQ ID NO: 52317 - DNA, 22 bp, Artificial Sequence
  chemically synthesized
ccatcaatgtggccgtgcatgt

SEQ ID NO: 52318 - DNA, 22 bp, Artificial Sequence
  chemically synthesized
agaaaggctgctgatgacacct

SEQ ID NO: 52319 - DNA, 22 bp, Artificial Sequence
  chemically synthesized
ctgatgacacctgggagccatt

SEQ ID NO: 52320 - DNA, 22 bp, Artificial Sequence
  chemically synthesized
atgacacctgggagccatttgc

SEQ ID NO: 52321 - DNA, 22 bp, Artificial Sequence
  chemically synthesized
ccaggtgtcatcagcagccttt

SEQ ID NO: 52322 - DNA, 22 bp, Artificial Sequence
  chemically synthesized
tctgaacacatgcacggccaca

SEQ ID NO: 52323 - DNA, 22 bp, Artificial Sequence
  chemically synthesized
ctgaacacatgcacggccacat

SEQ ID NO: 52324 - DNA, 22 bp, Artificial Sequence
  chemically synthesized
tgaacacatgcacggccacatt

SEQ ID NO: 52325 - DNA, 22 bp, Artificial Sequence
  chemically synthesized
aacacatgcacggccacattga

SEQ ID NO: 52326 - DNA, 22 bp, Artificial Sequence
  chemically synthesized
atggcaggactgcctcggacag

SEQ ID NO: 52327 - DNA, 22 bp, Artificial Sequence
  chemically synthesized
cctcggacagcatctagaactt

SEQ ID NO: 52328 - DNA, 22 bp, Artificial Sequence
  chemically synthesized
ggacagcatctagaactttgac

SEQ ID NO: 52329 - DNA, 22 bp, Artificial Sequence
  chemically synthesized
gaactttgaccatcagaggaca

SEQ ID NO: 52330 - DNA, 22 bp, Artificial Sequence
  chemically synthesized
tgaccatcagaggacacttgga

SEQ ID NO: 52331 - DNA, 22 bp, Artificial Sequence
  chemically synthesized
gaccatcagaggacacttggat

SEQ ID NO: 52332 - DNA, 22 bp, Artificial Sequence
  chemically synthesized
accatcagaggacacttggatt

SEQ ID NO: 52333 - DNA, 22 bp, Artificial Sequence
  chemically synthesized
ggattcaccggtgccctgggtg

SEQ ID NO: 52334 - DNA, 22 bp, Artificial Sequence
  chemically synthesized
gattcaccggtgccctgggtgt

SEQ ID NO: 52335 - DNA, 22 bp, Artificial Sequence
  chemically synthesized
accggtgccctgggtgtagaga

SEQ ID NO: 52336 - DNA, 22 bp, Artificial Sequence
  chemically synthesized
ggtgtagagaagacacgtgaga

SEQ ID NO: 52337 - DNA, 22 bp, Artificial Sequence
  chemically synthesized
acaaaattgatcagagtgaaag

SEQ ID NO: 52338 - DNA, 22 bp, Artificial Sequence
  chemically synthesized
atcagagtgaaaggatttattc

SEQ ID NO: 52339 - DNA, 22 bp, Artificial Sequence
  chemically synthesized
attctttgtggtattagaaatc

SEQ ID NO: 52340 - DNA, 22 bp, Artificial Sequence
  chemically synthesized
ttctttgtggtattagaaatct

SEQ ID NO: 52341 - DNA, 22 bp, Artificial Sequence
  chemically synthesized
tttgtggtattagaaatctgga

SEQ ID NO: 52342 - DNA, 22 bp, Artificial Sequence
  chemically synthesized
tgtggtattagaaatctggagc

SEQ ID NO: 52343 - DNA, 22 bp, Artificial Sequence
  chemically synthesized
gtggtattagaaatctggagcg

SEQ ID NO: 52344 - DNA, 22 bp, Artificial Sequence
  chemically synthesized
tggtattagaaatctggagcga

SEQ ID NO: 52345 - DNA, 22 bp, Artificial Sequence
  chemically synthesized
gaaatctggagcgaaacaagaa

SEQ ID NO: 52346 - DNA, 22 bp, Artificial Sequence
  chemically synthesized
gagcgaaacaagaattacacac

SEQ ID NO: 52347 - DNA, 22 bp, Artificial Sequence
  chemically synthesized
cacactgatcccattatcagga

SEQ ID NO: 52348 - DNA, 22 bp, Artificial Sequence
  chemically synthesized
atcccattatcaggaacgtaag

SEQ ID NO: 52349 - DNA, 22 bp, Artificial Sequence
  chemically synthesized
tcaggaacgtaagtgtcgacaa

SEQ ID NO: 52350 - DNA, 22 bp, Artificial Sequence
  chemically synthesized
atgagcttccctactcagtata

SEQ ID NO: 52351 - DNA, 22 bp, Artificial Sequence
  chemically synthesized
ccctactcagtataacacagac

SEQ ID NO: 52352 - DNA, 22 bp, Artificial Sequence
  chemically synthesized
cctactcagtataacacagacg

SEQ ID NO: 52353 - DNA, 22 bp, Artificial Sequence
  chemically synthesized
ctcagtataacacagacgtaat

SEQ ID NO: 52354 - DNA, 22 bp, Artificial Sequence
  chemically synthesized
agtataacacagacgtaattgt

SEQ ID NO: 52355 - DNA, 22 bp, Artificial Sequence
  chemically synthesized
tttccaaagcaagaatggtttc

SEQ ID NO: 52356 - DNA, 22 bp, Artificial Sequence
  chemically synthesized
ccaaagcaagaatggtttctgc

SEQ ID NO: 52357 - DNA, 22 bp, Artificial Sequence
  chemically synthesized
caaagcaagaatggtttctgcc

SEQ ID NO: 52358 - DNA, 22 bp, Artificial Sequence
  chemically synthesized
ctgcctccagacacactgctat

SEQ ID NO: 52359 - DNA, 22 bp, Artificial Sequence
  chemically synthesized
tgcctccagacacactgctatc

SEQ ID NO: 52360 - DNA, 22 bp, Artificial Sequence
  chemically synthesized
cctccagacacactgctatcaa

SEQ ID NO: 52361 - DNA, 22 bp, Artificial Sequence
  chemically synthesized
cagacacactgctatcaaccag

SEQ ID NO: 52362 - DNA, 22 bp, Artificial Sequence
  chemically synthesized
ctatcaaccagggatgtgtata

SEQ ID NO: 52363 - DNA, 22 bp, Artificial Sequence
  chemically synthesized
tcaaccagggatgtgtataatg

SEQ ID NO: 52364 - DNA, 22 bp, Artificial Sequence
  chemically synthesized
taagggagaaaataggtcccct

SEQ ID NO: 52365 - DNA, 22 bp, Artificial Sequence
  chemically synthesized
aagggagaaaataggtcccctg

SEQ ID NO: 52366 - DNA, 22 bp, Artificial Sequence
  chemically synthesized
agggagaaaataggtcccctga

SEQ ID NO: 52367 - DNA, 22 bp, Artificial Sequence
  chemically synthesized
agaacagttgctttgttaaaag

SEQ ID NO: 52368 - DNA, 22 bp, Artificial Sequence
  chemically synthesized
ctttgttaaaagtctccatttg

SEQ ID NO: 52369 - DNA, 22 bp, Artificial Sequence
  chemically synthesized
tgttaaaagtctccatttgagt

SEQ ID NO: 52370 - DNA, 22 bp, Artificial Sequence
  chemically synthesized
gttaaaagtctccatttgagtg

SEQ ID NO: 52371 - DNA, 22 bp, Artificial Sequence
  chemically synthesized
ttaaaagtctccatttgagtgg

SEQ ID NO: 52372 - DNA, 22 bp, Artificial Sequence
  chemically synthesized
aaagtctccatttgagtggaat

SEQ ID NO: 52373 - DNA, 22 bp, Artificial Sequence
  chemically synthesized
catttgagtggaattactgaaa

SEQ ID NO: 52374 - DNA, 22 bp, Artificial Sequence
  chemically synthesized
gagtggaattactgaaaagatg

SEQ ID NO: 52375 - DNA, 22 bp, Artificial Sequence
  chemically synthesized
agtggaattactgaaaagatgt

SEQ ID NO: 52376 - DNA, 22 bp, Artificial Sequence
  chemically synthesized
ctgaaaagatgtaatgtaccat

SEQ ID NO: 52377 - DNA, 22 bp, Artificial Sequence
  chemically synthesized
aaaagatgtaatgtaccataca

SEQ ID NO: 52378 - DNA, 22 bp, Artificial Sequence
  chemically synthesized
tcctgagatcattttagttgtt

SEQ ID NO: 52379 - DNA, 22 bp, Artificial Sequence
  chemically synthesized
cctgagatcattttagttgttg

SEQ ID NO: 52380 - DNA, 22 bp, Artificial Sequence
  chemically synthesized
ctgagatcattttagttgttgc

SEQ ID NO: 52381 - DNA, 22 bp, Artificial Sequence
  chemically synthesized
agatcattttagttgttgctat

SEQ ID NO: 52382 - DNA, 22 bp, Artificial Sequence
  chemically synthesized
tagttgttgctatagtcactcc

SEQ ID NO: 52383 - DNA, 22 bp, Artificial Sequence
  chemically synthesized
agttgttgctatagtcactccc

SEQ ID NO: 52384 - DNA, 22 bp, Artificial Sequence
  chemically synthesized
gttgttgctatagtcactccct

SEQ ID NO: 52385 - DNA, 22 bp, Artificial Sequence
  chemically synthesized
ttgctatagtcactccctctta

SEQ ID NO: 52386 - DNA, 22 bp, Artificial Sequence
  chemically synthesized
ctatagtcactccctcttacca

SEQ ID NO: 52387 - DNA, 22 bp, Artificial Sequence
  chemically synthesized
tagtcactccctcttaccagtt

SEQ ID NO: 52388 - DNA, 22 bp, Artificial Sequence
  chemically synthesized
cctcttaccagttgttataaaa

SEQ ID NO: 52389 - DNA, 22 bp, Artificial Sequence
  chemically synthesized
ttaccagttgttataaaataat

SEQ ID NO: 52390 - DNA, 22 bp, Artificial Sequence
  chemically synthesized
accagttgttataaaataatgt

SEQ ID NO: 52391 - DNA, 22 bp, Artificial Sequence
  chemically synthesized
ccagttgttataaaataatgtc

SEQ ID NO: 52392 - DNA, 22 bp, Artificial Sequence
  chemically synthesized
ttataaaataatgtcagaacta

SEQ ID NO: 52393 - DNA, 22 bp, Artificial Sequence
  chemically synthesized
taaaataatgtcagaactacat

SEQ ID NO: 52394 - DNA, 22 bp, Artificial Sequence
  chemically synthesized
catccagacccattttatagta

SEQ ID NO: 52395 - DNA, 22 bp, Artificial Sequence
  chemically synthesized
tatagtattagttaattcttct

SEQ ID NO: 52396 - DNA, 22 bp, Artificial Sequence
  chemically synthesized
atagtattagttaattcttcta

SEQ ID NO: 52397 - DNA, 22 bp, Artificial Sequence
  chemically synthesized
tagtattagttaattcttctag

SEQ ID NO: 52398 - DNA, 22 bp, Artificial Sequence
  chemically synthesized
gttaattcttctagaggattta

SEQ ID NO: 52399 - DNA, 22 bp, Artificial Sequence
  chemically synthesized
attcttctagaggatttaagaa

SEQ ID NO: 52400 - DNA, 22 bp, Artificial Sequence
  chemically synthesized
ttctagaggatttaagaattag

SEQ ID NO: 52401 - DNA, 22 bp, Artificial Sequence
  chemically synthesized
ctagaggatttaagaattagat

SEQ ID NO: 52402 - DNA, 22 bp, Artificial Sequence
  chemically synthesized
tagaggatttaagaattagata

SEQ ID NO: 52403 - DNA, 22 bp, Artificial Sequence
  chemically synthesized
gaggatttaagaattagatatc

SEQ ID NO: 52404 - DNA, 22 bp, Artificial Sequence
  chemically synthesized
aagaattagatatctgactaga

SEQ ID NO: 52405 - DNA, 22 bp, Artificial Sequence
  chemically synthesized
agaattagatatctgactagaa

SEQ ID NO: 52406 - DNA, 22 bp, Artificial Sequence
  chemically synthesized
gatatctgactagaatattgtt

SEQ ID NO: 52407 - DNA, 22 bp, Artificial Sequence
  chemically synthesized
actagaatattgttcactaagc

SEQ ID NO: 52408 - DNA, 22 bp, Artificial Sequence
  chemically synthesized
gaatattgttcactaagccttt

SEQ ID NO: 52409 - DNA, 22 bp, Artificial Sequence
  chemically synthesized
ttcactaagccttttaaagatt

SEQ ID NO: 52410 - DNA, 22 bp, Artificial Sequence
  chemically synthesized
actaagccttttaaagattaat

SEQ ID NO: 52411 - DNA, 22 bp, Artificial Sequence
  chemically synthesized
agccttttaaagattaatcaat

SEQ ID NO: 52412 - DNA, 22 bp, Artificial Sequence
  chemically synthesized
ttaaagattaatcaataaatac

SEQ ID NO: 52413 - DNA, 22 bp, Artificial Sequence
  chemically synthesized
taaagattaatcaataaatacg

SEQ ID NO: 52414 - DNA, 22 bp, Artificial Sequence
  chemically synthesized
aaagattaatcaataaatacgt

SEQ ID NO: 52415 - DNA, 22 bp, Artificial Sequence
  chemically synthesized
aagattaatcaataaatacgtt

SEQ ID NO: 52416 - DNA, 22 bp, Artificial Sequence
  chemically synthesized
atcaataaatacgttttgaata

SEQ ID NO: 52417 - DNA, 22 bp, Artificial Sequence
  chemically synthesized
tgaataactatagggccagaat

SEQ ID NO: 52418 - DNA, 22 bp, Artificial Sequence
  chemically synthesized
gaataactatagggccagaata

SEQ ID NO: 52419 - DNA, 22 bp, Artificial Sequence
  chemically synthesized
aataactatagggccagaatat

SEQ ID NO: 52420 - DNA, 22 bp, Artificial Sequence
  chemically synthesized
tagggccagaatataatctcct

SEQ ID NO: 52421 - DNA, 22 bp, Artificial Sequence
  chemically synthesized
ctgcagtttgtcccccaaatac

SEQ ID NO: 52422 - DNA, 22 bp, Artificial Sequence
  chemically synthesized
cagtttgtcccccaaatacatt

SEQ ID NO: 52423 - DNA, 22 bp, Artificial Sequence
  chemically synthesized
gtcccccaaatacattttatgg

SEQ ID NO: 52424 - DNA, 22 bp, Artificial Sequence
  chemically synthesized
tcccccaaatacattttatgga

SEQ ID NO: 52425 - DNA, 22 bp, Artificial Sequence
  chemically synthesized
tatggagggatacttttctgaa

SEQ ID NO: 52426 - DNA, 22 bp, Artificial Sequence
  chemically synthesized
atggagggatacttttctgaaa

SEQ ID NO: 52427 - DNA, 22 bp, Artificial Sequence
  chemically synthesized
tggagggatacttttctgaaaa

SEQ ID NO: 52428 - DNA, 22 bp, Artificial Sequence
  chemically synthesized
ttctgaaaattcagtattaaca

SEQ ID NO: 52429 - DNA, 22 bp, Artificial Sequence
  chemically synthesized
tctgaaaattcagtattaacag

SEQ ID NO: 52430 - DNA, 22 bp, Artificial Sequence
  chemically synthesized
ctgaaaattcagtattaacagc

SEQ ID NO: 52431 - DNA, 22 bp, Artificial Sequence
  chemically synthesized
tgaaaattcagtattaacagct

SEQ ID NO: 52432 - DNA, 22 bp, Artificial Sequence
  chemically synthesized
aaaattcagtattaacagcttc

SEQ ID NO: 52433 - DNA, 22 bp, Artificial Sequence
  chemically synthesized
agtattaacagcttccttaata

SEQ ID NO: 52434 - DNA, 22 bp, Artificial Sequence
  chemically synthesized
acagcttccttaatatcatatc

SEQ ID NO: 52435 - DNA, 22 bp, Artificial Sequence
  chemically synthesized
ccttaatatcatatctttattt

SEQ ID NO: 52436 - DNA, 22 bp, Artificial Sequence
  chemically synthesized
cttaatatcatatctttatttc

SEQ ID NO: 52437 - DNA, 22 bp, Artificial Sequence
  chemically synthesized
aatatcatatctttatttctat

SEQ ID NO: 52438 - DNA, 22 bp, Artificial Sequence
  chemically synthesized
atatcatatctttatttctatc

SEQ ID NO: 52439 - DNA, 22 bp, Artificial Sequence
  chemically synthesized
tatttctatcatctatctgagg

SEQ ID NO: 52440 - DNA, 22 bp, Artificial Sequence
  chemically synthesized
atttctatcatctatctgagga

SEQ ID NO: 52441 - DNA, 22 bp, Artificial Sequence
  chemically synthesized
tttctatcatctatctgaggaa

SEQ ID NO: 52442 - DNA, 22 bp, Artificial Sequence
  chemically synthesized
ctatcatctatctgaggaaaca

SEQ ID NO: 52443 - DNA, 22 bp, Artificial Sequence
  chemically synthesized
tatcatctatctgaggaaacag

SEQ ID NO: 52444 - DNA, 22 bp, Artificial Sequence
  chemically synthesized
tcatctatctgaggaaacagag

SEQ ID NO: 52445 - DNA, 22 bp, Artificial Sequence
  chemically synthesized
tctgaggaaacagaggtaccag

SEQ ID NO: 52446 - DNA, 22 bp, Artificial Sequence
  chemically synthesized
aggaaacagaggtaccagatat

SEQ ID NO: 52447 - DNA, 22 bp, Artificial Sequence
  chemically synthesized
caaacctaatgcaccaaagcaa

SEQ ID NO: 52448 - DNA, 22 bp, Artificial Sequence
  chemically synthesized
atgcaccaaagcaatgaggtag

SEQ ID NO: 52449 - DNA, 22 bp, Artificial Sequence
  chemically synthesized
agagttcaagtcccagctcagt

SEQ ID NO: 52450 - DNA, 22 bp, Artificial Sequence
  chemically synthesized
aagtcccagctcagtaagctca

SEQ ID NO: 52451 - DNA, 22 bp, Artificial Sequence
  chemically synthesized
agtaagctcagtggaacttcat

SEQ ID NO: 52452 - DNA, 22 bp, Artificial Sequence
  chemically synthesized
agtggaacttcattctttttga

SEQ ID NO: 52453 - DNA, 22 bp, Artificial Sequence
  chemically synthesized
cattctttttgaagtttgaatt

SEQ ID NO: 52454 - DNA, 22 bp, Artificial Sequence
  chemically synthesized
attctttttgaagtttgaatta

SEQ ID NO: 52455 - DNA, 22 bp, Artificial Sequence
  chemically synthesized
tttttgaagtttgaattaatta

SEQ ID NO: 52456 - DNA, 22 bp, Artificial Sequence
  chemically synthesized
tttgaagtttgaattaattata

SEQ ID NO: 52457 - DNA, 22 bp, Artificial Sequence
  chemically synthesized
ttgaagtttgaattaattatat

SEQ ID NO: 52458 - DNA, 22 bp, Artificial Sequence
  chemically synthesized
tgaagtttgaattaattatatt

SEQ ID NO: 52459 - DNA, 22 bp, Artificial Sequence
  chemically synthesized
gaagtttgaattaattatatta

SEQ ID NO: 52460 - DNA, 22 bp, Artificial Sequence
  chemically synthesized
aagtttgaattaattatattaa

SEQ ID NO: 52461 - DNA, 22 bp, Artificial Sequence
  chemically synthesized
gaattaattatattaaaaatag

SEQ ID NO: 52462 - DNA, 22 bp, Artificial Sequence
  chemically synthesized
aattaattatattaaaaataga

SEQ ID NO: 52463 - DNA, 22 bp, Artificial Sequence
  chemically synthesized
attatattaaaaatagatgctg

SEQ ID NO: 52464 - DNA, 22 bp, Artificial Sequence
  chemically synthesized
tattaaaaatagatgctgggta

SEQ ID NO: 52465 - DNA, 22 bp, Artificial Sequence
  chemically synthesized
aaaatagatgctgggtaccctt

SEQ ID NO: 52466 - DNA, 22 bp, Artificial Sequence
  chemically synthesized
ggtacccttgccctagtaataa

SEQ ID NO: 52467 - DNA, 22 bp, Artificial Sequence
  chemically synthesized
gccctagtaataaaagctggtt

SEQ ID NO: 52468 - DNA, 22 bp, Artificial Sequence
  chemically synthesized
ccctagtaataaaagctggttg

SEQ ID NO: 52469 - DNA, 22 bp, Artificial Sequence
  chemically synthesized
gtaataaaagctggttggcaaa

SEQ ID NO: 52470 - DNA, 22 bp, Artificial Sequence
  chemically synthesized
gttggcaaagctggaaggagtc

SEQ ID NO: 52471 - DNA, 22 bp, Artificial Sequence
  chemically synthesized
gcaaagctggaaggagtcactt

SEQ ID NO: 52472 - DNA, 22 bp, Artificial Sequence
  chemically synthesized
gaaggagtcacttctacttcat

SEQ ID NO: 52473 - DNA, 22 bp, Artificial Sequence
  chemically synthesized
ctacttcatttagcgtgaatct

SEQ ID NO: 52474 - DNA, 22 bp, Artificial Sequence
  chemically synthesized
tacttcatttagcgtgaatctt

SEQ ID NO: 52475 - DNA, 22 bp, Artificial Sequence
  chemically synthesized
cttcatttagcgtgaatcttaa

SEQ ID NO: 52476 - DNA, 22 bp, Artificial Sequence
  chemically synthesized
catttagcgtgaatcttaaatg

SEQ ID NO: 52477 - DNA, 22 bp, Artificial Sequence
  chemically synthesized
atttagcgtgaatcttaaatgt

SEQ ID NO: 52478 - DNA, 22 bp, Artificial Sequence
  chemically synthesized
agcgtgaatcttaaatgtagga

SEQ ID NO: 52479 - DNA, 22 bp, Artificial Sequence
  chemically synthesized
gcgtgaatcttaaatgtaggaa

SEQ ID NO: 52480 - DNA, 22 bp, Artificial Sequence
  chemically synthesized
aaatgtaggaatgggatgtcac

SEQ ID NO: 52481 - DNA, 22 bp, Artificial Sequence
  chemically synthesized
aatgtaggaatgggatgtcaca

SEQ ID NO: 52482 - DNA, 22 bp, Artificial Sequence
  chemically synthesized
accgtagggccagcctcagaca

SEQ ID NO: 52483 - DNA, 22 bp, Artificial Sequence
  chemically synthesized
agacacaaataccagtccagca

SEQ ID NO: 52484 - DNA, 22 bp, Artificial Sequence
  chemically synthesized
ccaagaatgagtggacttctgt

SEQ ID NO: 52485 - DNA, 22 bp, Artificial Sequence
  chemically synthesized
ctgtgatggctgctcccagcct

SEQ ID NO: 52486 - DNA, 22 bp, Artificial Sequence
  chemically synthesized
tgtgatggctgctcccagcctg

SEQ ID NO: 52487 - DNA, 22 bp, Artificial Sequence
  chemically synthesized
tgatggctgctcccagcctggg

SEQ ID NO: 52488 - DNA, 22 bp, Artificial Sequence
  chemically synthesized
ctcccagcctggggcttttata

SEQ ID NO: 52489 - DNA, 22 bp, Artificial Sequence
  chemically synthesized
ccagcctggggcttttatactc

SEQ ID NO: 52490 - DNA, 22 bp, Artificial Sequence
  chemically synthesized
gggcttttatactcacttctcc

SEQ ID NO: 52491 - DNA, 22 bp, Artificial Sequence
  chemically synthesized
ttatactcacttctcctgagct

SEQ ID NO: 52492 - DNA, 22 bp, Artificial Sequence
  chemically synthesized
tatactcacttctcctgagcta

SEQ ID NO: 52493 - DNA, 22 bp, Artificial Sequence
  chemically synthesized
atactcacttctcctgagctag

SEQ ID NO: 52494 - DNA, 22 bp, Artificial Sequence
  chemically synthesized
tactcacttctcctgagctagg

SEQ ID NO: 52495 - DNA, 22 bp, Artificial Sequence
  chemically synthesized
acttctcctgagctaggctgct

SEQ ID NO: 52496 - DNA, 22 bp, Artificial Sequence
  chemically synthesized
ctcctgagctaggctgcttatc

SEQ ID NO: 52497 - DNA, 22 bp, Artificial Sequence
  chemically synthesized
tcctgagctaggctgcttatcc

SEQ ID NO: 52498 - DNA, 22 bp, Artificial Sequence
  chemically synthesized
ctgagctaggctgcttatccct

SEQ ID NO: 52499 - DNA, 22 bp, Artificial Sequence
  chemically synthesized
agctaggctgcttatccctgcc

SEQ ID NO: 52500 - DNA, 22 bp, Artificial Sequence
  chemically synthesized
ggctgcttatccctgccaatct

SEQ ID NO: 52501 - DNA, 22 bp, Artificial Sequence
  chemically synthesized
cttatccctgccaatctgactg

SEQ ID NO: 52502 - DNA, 22 bp, Artificial Sequence
  chemically synthesized
atccctgccaatctgactgcaa

SEQ ID NO: 52503 - DNA, 22 bp, Artificial Sequence
  chemically synthesized
tccctgccaatctgactgcaaa

SEQ ID NO: 52504 - DNA, 22 bp, Artificial Sequence
  chemically synthesized
ccaatctgactgcaaacctgct

SEQ ID NO: 52505 - DNA, 22 bp, Artificial Sequence
  chemically synthesized
actgcaaacctgctgattctga

SEQ ID NO: 52506 - DNA, 22 bp, Artificial Sequence
  chemically synthesized
caaacctgctgattctgattat

SEQ ID NO: 52507 - DNA, 22 bp, Artificial Sequence
  chemically synthesized
ctgattctgattattgacttag

SEQ ID NO: 52508 - DNA, 22 bp, Artificial Sequence
  chemically synthesized
attctgattattgacttagtca

SEQ ID NO: 52509 - DNA, 20 bp, Artificial Sequence
  chemically synthesized
ggtttggtggtgtgcgcctg

SEQ ID NO: 52510 - DNA, 20 bp, Artificial Sequence
  chemically synthesized
gtttggtggtgtgcgcctgt

SEQ ID NO: 52511 - DNA, 20 bp, Artificial Sequence
  chemically synthesized
gtggtgtgcgcctgtaggcc

SEQ ID NO: 52512 - DNA, 20 bp, Artificial Sequence
  chemically synthesized
cgcctgtaggcccagctacc

SEQ ID NO: 52513 - DNA, 20 bp, Artificial Sequence
  chemically synthesized
cctgtaggcccagctaccca

SEQ ID NO: 52514 - DNA, 20 bp, Artificial Sequence
  chemically synthesized
ctgatgcaaaacgatccctt

SEQ ID NO: 52515 - DNA, 20 bp, Artificial Sequence
  chemically synthesized
gcaaaacgatcccttaagcc

SEQ ID NO: 52516 - DNA, 20 bp, Artificial Sequence
  chemically synthesized
caaaacgatcccttaagccc

SEQ ID NO: 52517 - DNA, 20 bp, Artificial Sequence
  chemically synthesized
aaacgatcccttaagcccag

SEQ ID NO: 52518 - DNA, 20 bp, Artificial Sequence
  chemically synthesized
tcccttaagcccaggagact

SEQ ID NO: 52519 - DNA, 20 bp, Artificial Sequence
  chemically synthesized
cccttaagcccaggagactg

SEQ ID NO: 52520 - DNA, 20 bp, Artificial Sequence
  chemically synthesized
agcccaggagactgaggctg

SEQ ID NO: 52521 - DNA, 20 bp, Artificial Sequence
  chemically synthesized
caggagactgaggctgcagt

SEQ ID NO: 52522 - DNA, 20 bp, Artificial Sequence
  chemically synthesized
gaggctgcagtgagctgtga

SEQ ID NO: 52523 - DNA, 20 bp, Artificial Sequence
  chemically synthesized
gtgatggtgccaccgcactc

SEQ ID NO: 52524 - DNA, 20 bp, Artificial Sequence
  chemically synthesized
ggtgccaccgcactccagcc

SEQ ID NO: 52525 - DNA, 20 bp, Artificial Sequence
  chemically synthesized
gtgccaccgcactccagcct

SEQ ID NO: 52526 - DNA, 20 bp, Artificial Sequence
  chemically synthesized
ccgcactccagcctgggtaa

SEQ ID NO: 52527 - DNA, 20 bp, Artificial Sequence
  chemically synthesized
gcactccagcctgggtaaca

SEQ ID NO: 52528 - DNA, 20 bp, Artificial Sequence
  chemically synthesized
tccagcctgggtaacagagt

SEQ ID NO: 52529 - DNA, 20 bp, Artificial Sequence
  chemically synthesized
gagaccccgtctcaaataaa

SEQ ID NO: 52530 - DNA, 20 bp, Artificial Sequence
  chemically synthesized
tctcaaataaacagataaat

SEQ ID NO: 52531 - DNA, 20 bp, Artificial Sequence
  chemically synthesized
caaataaacagataaatgag

SEQ ID NO: 52532 - DNA, 20 bp, Artificial Sequence
  chemically synthesized
cagataaatgagtggattct

SEQ ID NO: 52533 - DNA, 20 bp, Artificial Sequence
  chemically synthesized
tggattctcagcaaaacttc

SEQ ID NO: 52534 - DNA, 20 bp, Artificial Sequence
  chemically synthesized
cactcgcctcatatatccac

SEQ ID NO: 52535 - DNA, 20 bp, Artificial Sequence
  chemically synthesized
catatatccacaagaccttt

SEQ ID NO: 52536 - DNA, 20 bp, Artificial Sequence
  chemically synthesized
acaagacctttgagaatcca

SEQ ID NO: 52537 - DNA, 20 bp, Artificial Sequence
  chemically synthesized
gaatccacggtgtctcgatg

SEQ ID NO: 52538 - DNA, 20 bp, Artificial Sequence
  chemically synthesized
ccacggtgtctcgatgcagt

SEQ ID NO: 52539 - DNA, 20 bp, Artificial Sequence
  chemically synthesized
gatgcagtcagctttctaac

SEQ ID NO: 52540 - DNA, 20 bp, Artificial Sequence
  chemically synthesized
cagtcagctttctaacaagc

SEQ ID NO: 52541 - DNA, 20 bp, Artificial Sequence
  chemically synthesized
agtcagctttctaacaagct

SEQ ID NO: 52542 - DNA, 20 bp, Artificial Sequence
  chemically synthesized
gtcagctttctaacaagctg

SEQ ID NO: 52543 - DNA, 20 bp, Artificial Sequence
  chemically synthesized
gggcctcacctgttttccca

SEQ ID NO: 52544 - DNA, 20 bp, Artificial Sequence
  chemically synthesized
tcccacggataaaaacgtgc

SEQ ID NO: 52545 - DNA, 20 bp, Artificial Sequence
  chemically synthesized
ccacggataaaaacgtgctg

SEQ ID NO: 52546 - DNA, 20 bp, Artificial Sequence
  chemically synthesized
cacggataaaaacgtgctgg

SEQ ID NO: 52547 - DNA, 20 bp, Artificial Sequence
  chemically synthesized
ggataaaaacgtgctggagg

SEQ ID NO: 52548 - DNA, 20 bp, Artificial Sequence
  chemically synthesized
taaaaacgtgctggaggaag

SEQ ID NO: 52549 - DNA, 20 bp, Artificial Sequence
  chemically synthesized
aacgtgctggaggaagcaga

SEQ ID NO: 52550 - DNA, 20 bp, Artificial Sequence
  chemically synthesized
acgtgctggaggaagcagaa

SEQ ID NO: 52551 - DNA, 20 bp, Artificial Sequence
  chemically synthesized
cgtgctggaggaagcagaaa

SEQ ID NO: 52552 - DNA, 20 bp, Artificial Sequence
  chemically synthesized
gtgctggaggaagcagaaag

SEQ ID NO: 52553 - DNA, 20 bp, Artificial Sequence
  chemically synthesized
tggaggaagcagaaaggggc

SEQ ID NO: 52554 - DNA, 20 bp, Artificial Sequence
  chemically synthesized
aggaagcagaaaggggctgg

SEQ ID NO: 52555 - DNA, 20 bp, Artificial Sequence
  chemically synthesized
ggaagcagaaaggggctggc

SEQ ID NO: 52556 - DNA, 20 bp, Artificial Sequence
  chemically synthesized
agcagaaaggggctggcagg

SEQ ID NO: 52557 - DNA, 20 bp, Artificial Sequence
  chemically synthesized
gaaaggggctggcaggtgga

SEQ ID NO: 52558 - DNA, 20 bp, Artificial Sequence
  chemically synthesized
gggctggcaggtggaaagat

SEQ ID NO: 52559 - DNA, 20 bp, Artificial Sequence
  chemically synthesized
ggctggcaggtggaaagatg

SEQ ID NO: 52560 - DNA, 20 bp, Artificial Sequence
  chemically synthesized
gcaggtggaaagatgaggac

SEQ ID NO: 52561 - DNA, 20 bp, Artificial Sequence
  chemically synthesized
gctcatcgtctcatgactat

SEQ ID NO: 52562 - DNA, 20 bp, Artificial Sequence
  chemically synthesized
ctcatcgtctcatgactatg

SEQ ID NO: 52563 - DNA, 20 bp, Artificial Sequence
  chemically synthesized
actatgaggttgctctgatc

SEQ ID NO: 52564 - DNA, 20 bp, Artificial Sequence
  chemically synthesized
tatgaggttgctctgatcca

SEQ ID NO: 52565 - DNA, 20 bp, Artificial Sequence
  chemically synthesized
atgaggttgctctgatccag

SEQ ID NO: 52566 - DNA, 20 bp, Artificial Sequence
  chemically synthesized
tgaggttgctctgatccaga

SEQ ID NO: 52567 - DNA, 20 bp, Artificial Sequence
  chemically synthesized
atccagagggtccccctgcc

SEQ ID NO: 52568 - DNA, 20 bp, Artificial Sequence
  chemically synthesized
cagagggtccccctgcctgg

SEQ ID NO: 52569 - DNA, 20 bp, Artificial Sequence
  chemically synthesized
cctgcctggtggcccaccgc

SEQ ID NO: 52570 - DNA, 20 bp, Artificial Sequence
  chemically synthesized
ctgcctggtggcccaccgcc

SEQ ID NO: 52571 - DNA, 20 bp, Artificial Sequence
  chemically synthesized
cctggtggcccaccgccagg

SEQ ID NO: 52572 - DNA, 20 bp, Artificial Sequence
  chemically synthesized
aggaagactcccactgtccc

SEQ ID NO: 52573 - DNA, 20 bp, Artificial Sequence
  chemically synthesized
tcccactgtccctggatgcc

SEQ ID NO: 52574 - DNA, 20 bp, Artificial Sequence
  chemically synthesized
ccactgtccctggatgccca

SEQ ID NO: 52575 - DNA, 20 bp, Artificial Sequence
  chemically synthesized
ctgtccctggatgcccagag

SEQ ID NO: 52576 - DNA, 20 bp, Artificial Sequence
  chemically synthesized
tgtccctggatgcccagagt

SEQ ID NO: 52577 - DNA, 20 bp, Artificial Sequence
  chemically synthesized
acttatcaactccttatcca

SEQ ID NO: 52578 - DNA, 20 bp, Artificial Sequence
  chemically synthesized
cttatcaactccttatccat

SEQ ID NO: 52579 - DNA, 20 bp, Artificial Sequence
  chemically synthesized
ttatcaactccttatccata

SEQ ID NO: 52580 - DNA, 20 bp, Artificial Sequence
  chemically synthesized
tatcaactccttatccatag

SEQ ID NO: 52581 - DNA, 20 bp, Artificial Sequence
  chemically synthesized
tccataggggtattcttcct

SEQ ID NO: 52582 - DNA, 20 bp, Artificial Sequence
  chemically synthesized
ccataggggtattcttcctg

SEQ ID NO: 52583 - DNA, 20 bp, Artificial Sequence
  chemically synthesized
gtattcttcctgaggcgtct

SEQ ID NO: 52584 - DNA, 20 bp, Artificial Sequence
  chemically synthesized
tcctgaggcgtctcagaaaa

SEQ ID NO: 52585 - DNA, 20 bp, Artificial Sequence
  chemically synthesized
cctgaggcgtctcagaaaac

SEQ ID NO: 52586 - DNA, 20 bp, Artificial Sequence
  chemically synthesized
ctgaggcgtctcagaaaaca

SEQ ID NO: 52587 - DNA, 20 bp, Artificial Sequence
  chemically synthesized
cccatatgctgaccacataa

SEQ ID NO: 52588 - DNA, 20 bp, Artificial Sequence
  chemically synthesized
taatagaacccctcccaact

SEQ ID NO: 52589 - DNA, 20 bp, Artificial Sequence
  chemically synthesized
atagaacccctcccaactca

SEQ ID NO: 52590 - DNA, 20 bp, Artificial Sequence
  chemically synthesized
ccctcccaactcagagaccc

SEQ ID NO: 52591 - DNA, 20 bp, Artificial Sequence
  chemically synthesized
aactcagagaccctggctgc

SEQ ID NO: 52592 - DNA, 20 bp, Artificial Sequence
  chemically synthesized
accctggctgctagctgccc

SEQ ID NO: 52593 - DNA, 20 bp, Artificial Sequence
  chemically synthesized
ctagctgccctggcatgacc

SEQ ID NO: 52594 - DNA, 20 bp, Artificial Sequence
  chemically synthesized
ctgccctggcatgacccaga

SEQ ID NO: 52595 - DNA, 20 bp, Artificial Sequence
  chemically synthesized
ccctggcatgacccagacag

SEQ ID NO: 52596 - DNA, 20 bp, Artificial Sequence
  chemically synthesized
gtggcctttgtatatgtttt

SEQ ID NO: 52597 - DNA, 20 bp, Artificial Sequence
  chemically synthesized
ccttgactcacctctgacca

SEQ ID NO: 52598 - DNA, 20 bp, Artificial Sequence
  chemically synthesized
gaccatagaaactctcatcc

SEQ ID NO: 52599 - DNA, 20 bp, Artificial Sequence
  chemically synthesized
ccatagaaactctcatccca

SEQ ID NO: 52600 - DNA, 20 bp, Artificial Sequence
  chemically synthesized
catagaaactctcatcccag

SEQ ID NO: 52601 - DNA, 20 bp, Artificial Sequence
  chemically synthesized
catcccagaggtcactgcaa

SEQ ID NO: 52602 - DNA, 20 bp, Artificial Sequence
  chemically synthesized
ctgcaatagttactccacaa

SEQ ID NO: 52603 - DNA, 20 bp, Artificial Sequence
  chemically synthesized
gcaatagttactccacaaca

SEQ ID NO: 52604 - DNA, 20 bp, Artificial Sequence
  chemically synthesized
caatagttactccacaacag

SEQ ID NO: 52605 - DNA, 20 bp, Artificial Sequence
  chemically synthesized
ctccacaacagaggcttatc

SEQ ID NO: 52606 - DNA, 20 bp, Artificial Sequence
  chemically synthesized
tccacaacagaggcttatct

SEQ ID NO: 52607 - DNA, 20 bp, Artificial Sequence
  chemically synthesized
acaacagaggcttatctggg

SEQ ID NO: 52608 - DNA, 20 bp, Artificial Sequence
  chemically synthesized
aacagaggcttatctgggta

SEQ ID NO: 52609 - DNA, 20 bp, Artificial Sequence
  chemically synthesized
acagaggcttatctgggtag

SEQ ID NO: 52610 - DNA, 20 bp, Artificial Sequence
  chemically synthesized
cagaggcttatctgggtaga

SEQ ID NO: 52611 - DNA, 20 bp, Artificial Sequence
  chemically synthesized
gaggcttatctgggtagagg

SEQ ID NO: 52612 - DNA, 20 bp, Artificial Sequence
  chemically synthesized
aggcttatctgggtagaggg

SEQ ID NO: 52613 - DNA, 20 bp, Artificial Sequence
  chemically synthesized
agagggaggctccctaccta

SEQ ID NO: 52614 - DNA, 20 bp, Artificial Sequence
  chemically synthesized
gaggctccctacctatggcc

SEQ ID NO: 52615 - DNA, 20 bp, Artificial Sequence
  chemically synthesized
gctccctacctatggcccag

SEQ ID NO: 52616 - DNA, 20 bp, Artificial Sequence
  chemically synthesized
ctatggcccagcagccctga

SEQ ID NO: 52617 - DNA, 20 bp, Artificial Sequence
  chemically synthesized
gcccagcagccctgacagtg

SEQ ID NO: 52618 - DNA, 20 bp, Artificial Sequence
  chemically synthesized
atcacatataccccacgccc

SEQ ID NO: 52619 - DNA, 20 bp, Artificial Sequence
  chemically synthesized
ccagcactgcctgccacgca

SEQ ID NO: 52620 - DNA, 20 bp, Artificial Sequence
  chemically synthesized
cagcactgcctgccacgcat

SEQ ID NO: 52621 - DNA, 20 bp, Artificial Sequence
  chemically synthesized
gcttactttacacccaccca

SEQ ID NO: 52622 - DNA, 20 bp, Artificial Sequence
  chemically synthesized
caacacattacctgctctcc

SEQ ID NO: 52623 - DNA, 20 bp, Artificial Sequence
  chemically synthesized
aacacattacctgctctcca

SEQ ID NO: 52624 - DNA, 20 bp, Artificial Sequence
  chemically synthesized
cattacctgctctccaaggt

SEQ ID NO: 52625 - DNA, 20 bp, Artificial Sequence
  chemically synthesized
attacctgctctccaaggtt

SEQ ID NO: 52626 - DNA, 20 bp, Artificial Sequence
  chemically synthesized
ctgctctccaaggttaggcg

SEQ ID NO: 52627 - DNA, 20 bp, Artificial Sequence
  chemically synthesized
ctctccaaggttaggcgtgg

SEQ ID NO: 52628 - DNA, 20 bp, Artificial Sequence
  chemically synthesized
tctccaaggttaggcgtggc

SEQ ID NO: 52629 - DNA, 20 bp, Artificial Sequence
  chemically synthesized
tccaaggttaggcgtggcag

SEQ ID NO: 52630 - DNA, 20 bp, Artificial Sequence
  chemically synthesized
aaggttaggcgtggcaggag

SEQ ID NO: 52631 - DNA, 20 bp, Artificial Sequence
  chemically synthesized
cgtggcaggagaagtttgct

SEQ ID NO: 52632 - DNA, 20 bp, Artificial Sequence
  chemically synthesized
caggagaagtttgcttggac

SEQ ID NO: 52633 - DNA, 20 bp, Artificial Sequence
  chemically synthesized
gagaagtttgcttggaccag

SEQ ID NO: 52634 - DNA, 20 bp, Artificial Sequence
  chemically synthesized
ttggaccagcagaaaccatg

SEQ ID NO: 52635 - DNA, 20 bp, Artificial Sequence
  chemically synthesized
ccagcagaaaccatgcagtc

SEQ ID NO: 52636 - DNA, 20 bp, Artificial Sequence
  chemically synthesized
cagcagaaaccatgcagtca

SEQ ID NO: 52637 - DNA, 20 bp, Artificial Sequence
  chemically synthesized
accatgcagtcaaggacaac

SEQ ID NO: 52638 - DNA, 20 bp, Artificial Sequence
  chemically synthesized
catgcagtcaaggacaactg

SEQ ID NO: 52639 - DNA, 20 bp, Artificial Sequence
  chemically synthesized
cagtcaaggacaactggagt

SEQ ID NO: 52640 - DNA, 20 bp, Artificial Sequence
  chemically synthesized
aaggacaactggagtcagca

SEQ ID NO: 52641 - DNA, 20 bp, Artificial Sequence
  chemically synthesized
aggacaactggagtcagcat

SEQ ID NO: 52642 - DNA, 20 bp, Artificial Sequence
  chemically synthesized
caactggagtcagcatgggc

SEQ ID NO: 52643 - DNA, 20 bp, Artificial Sequence
  chemically synthesized
aactggagtcagcatgggct

SEQ ID NO: 52644 - DNA, 20 bp, Artificial Sequence
  chemically synthesized
agtcagcatgggctgggtgc

SEQ ID NO: 52645 - DNA, 20 bp, Artificial Sequence
  chemically synthesized
atgggctgggtgcgagccct

SEQ ID NO: 52646 - DNA, 20 bp, Artificial Sequence
  chemically synthesized
ggctgggtgcgagcccttgg

SEQ ID NO: 52647 - DNA, 20 bp, Artificial Sequence
  chemically synthesized
gctgggtgcgagcccttggt

SEQ ID NO: 52648 - DNA, 20 bp, Artificial Sequence
  chemically synthesized
ctgggtgcgagcccttggtg

SEQ ID NO: 52649 - DNA, 20 bp, Artificial Sequence
  chemically synthesized
ggtgcgagcccttggtgggg

SEQ ID NO: 52650 - DNA, 20 bp, Artificial Sequence
  chemically synthesized
gtgcgagcccttggtggggt

SEQ ID NO: 52651 - DNA, 20 bp, Artificial Sequence
  chemically synthesized
tgcgagcccttggtggggtg

SEQ ID NO: 52652 - DNA, 20 bp, Artificial Sequence
  chemically synthesized
cgagcccttggtggggtggg

SEQ ID NO: 52653 - DNA, 20 bp, Artificial Sequence
  chemically synthesized
gagcccttggtggggtgggg

SEQ ID NO: 52654 - DNA, 20 bp, Artificial Sequence
  chemically synthesized
gcccttggtggggtggggag

SEQ ID NO: 52655 - DNA, 20 bp, Artificial Sequence
  chemically synthesized
gtggggtggggaggagactc

SEQ ID NO: 52656 - DNA, 20 bp, Artificial Sequence
  chemically synthesized
tggggtggggaggagactcc

SEQ ID NO: 52657 - DNA, 20 bp, Artificial Sequence
  chemically synthesized
agactccaggtcatacctcc

SEQ ID NO: 52658 - DNA, 20 bp, Artificial Sequence
  chemically synthesized
actccaggtcatacctcctg

SEQ ID NO: 52659 - DNA, 20 bp, Artificial Sequence
  chemically synthesized
ctccaggtcatacctcctgg

SEQ ID NO: 52660 - DNA, 20 bp, Artificial Sequence
  chemically synthesized
gaggatgttttaatcatttc

SEQ ID NO: 52661 - DNA, 20 bp, Artificial Sequence
  chemically synthesized
tgttttaatcatttccagca

SEQ ID NO: 52662 - DNA, 20 bp, Artificial Sequence
  chemically synthesized
aatgctgtcaacttttgcca

SEQ ID NO: 52663 - DNA, 20 bp, Artificial Sequence
  chemically synthesized
aacttttgccacagattcat

SEQ ID NO: 52664 - DNA, 20 bp, Artificial Sequence
  chemically synthesized
gccacagattcattagctct

SEQ ID NO: 52665 - DNA, 20 bp, Artificial Sequence
  chemically synthesized
gagtttcttttttctgtccc

SEQ ID NO: 52666 - DNA, 20 bp, Artificial Sequence
  chemically synthesized
ctaccccttacatgtcaata

SEQ ID NO: 52667 - DNA, 20 bp, Artificial Sequence
  chemically synthesized
tgtcaatatggacttaatga

SEQ ID NO: 52668 - DNA, 20 bp, Artificial Sequence
  chemically synthesized
gtcaatatggacttaatgat

SEQ ID NO: 52669 - DNA, 20 bp, Artificial Sequence
  chemically synthesized
ggacttaatgatgggaaatt

SEQ ID NO: 52670 - DNA, 20 bp, Artificial Sequence
  chemically synthesized
gacttaatgatgggaaattc

SEQ ID NO: 52671 - DNA, 20 bp, Artificial Sequence
  chemically synthesized
taatgatgggaaattcaggc

SEQ ID NO: 52672 - DNA, 20 bp, Artificial Sequence
  chemically synthesized
tttaaacattttattccccc

SEQ ID NO: 52673 - DNA, 20 bp, Artificial Sequence
  chemically synthesized
cctcaaaaaatgcatgaatt

SEQ ID NO: 52674 - DNA, 20 bp, Artificial Sequence
  chemically synthesized
tcaaaaaatgcatgaatttg

SEQ ID NO: 52675 - DNA, 20 bp, Artificial Sequence
  chemically synthesized
caaaaaatgcatgaatttgg

SEQ ID NO: 52676 - DNA, 20 bp, Artificial Sequence
  chemically synthesized
aaaatgcatgaatttggagg

SEQ ID NO: 52677 - DNA, 20 bp, Artificial Sequence
  chemically synthesized
atgcatgaatttggaggcag

SEQ ID NO: 52678 - DNA, 20 bp, Artificial Sequence
  chemically synthesized
ctgtaatcccaatgctttgc

SEQ ID NO: 52679 - DNA, 20 bp, Artificial Sequence
  chemically synthesized
tgtaatcccaatgctttgct

SEQ ID NO: 52680 - DNA, 20 bp, Artificial Sequence
  chemically synthesized
tcccaatgctttgctaggtt

SEQ ID NO: 52681 - DNA, 20 bp, Artificial Sequence
  chemically synthesized
cccaatgctttgctaggttg

SEQ ID NO: 52682 - DNA, 20 bp, Artificial Sequence
  chemically synthesized
aatgctttgctaggttgagg

SEQ ID NO: 52683 - DNA, 20 bp, Artificial Sequence
  chemically synthesized
atgctttgctaggttgaggc

SEQ ID NO: 52684 - DNA, 20 bp, Artificial Sequence
  chemically synthesized
gctttgctaggttgaggcgg

SEQ ID NO: 52685 - DNA, 20 bp, Artificial Sequence
  chemically synthesized
ctttgctaggttgaggcggg

SEQ ID NO: 52686 - DNA, 20 bp, Artificial Sequence
  chemically synthesized
tgaggcgggaggatcacttg

SEQ ID NO: 52687 - DNA, 20 bp, Artificial Sequence
  chemically synthesized
gcgggaggatcacttgaagc

SEQ ID NO: 52688 - DNA, 20 bp, Artificial Sequence
  chemically synthesized
cgggaggatcacttgaagcc

SEQ ID NO: 52689 - DNA, 20 bp, Artificial Sequence
  chemically synthesized
tcacttgaagccaggaattt

SEQ ID NO: 52690 - DNA, 20 bp, Artificial Sequence
  chemically synthesized
tgaagccaggaatttgagac

SEQ ID NO: 52691 - DNA, 20 bp, Artificial Sequence
  chemically synthesized
ccaggaatttgagaccagcc

SEQ ID NO: 52692 - DNA, 20 bp, Artificial Sequence
  chemically synthesized
caggaatttgagaccagcct

SEQ ID NO: 52693 - DNA, 20 bp, Artificial Sequence
  chemically synthesized
tgagaccagcctgggccgca

SEQ ID NO: 52694 - DNA, 20 bp, Artificial Sequence
  chemically synthesized
accagcctgggccgcatagt

SEQ ID NO: 52695 - DNA, 20 bp, Artificial Sequence
  chemically synthesized
aataaataaataataaataa

SEQ ID NO: 52696 - DNA, 20 bp, Artificial Sequence
  chemically synthesized
taataaataatagtgatatg

SEQ ID NO: 52697 - DNA, 20 bp, Artificial Sequence
  chemically synthesized
tgatatgaagcatgattaaa

SEQ ID NO: 52698 - DNA, 20 bp, Artificial Sequence
  chemically synthesized
ccctattttttaaaatgcat

SEQ ID NO: 52699 - DNA, 20 bp, Artificial Sequence
  chemically synthesized
tcgttacctgattcattccc

SEQ ID NO: 52700 - DNA, 20 bp, Artificial Sequence
  chemically synthesized
tcattccctggttcctttca

SEQ ID NO: 52701 - DNA, 20 bp, Artificial Sequence
  chemically synthesized
ttcacagtcctccgtgaccc

SEQ ID NO: 52702 - DNA, 20 bp, Artificial Sequence
  chemically synthesized
gtcctccgtgacccaagtgt

SEQ ID NO: 52703 - DNA, 20 bp, Artificial Sequence
  chemically synthesized
tcctccgtgacccaagtgtt

SEQ ID NO: 52704 - DNA, 20 bp, Artificial Sequence
  chemically synthesized
cctccgtgacccaagtgtta

SEQ ID NO: 52705 - DNA, 20 bp, Artificial Sequence
  chemically synthesized
tgacccaagtgttagggttt

SEQ ID NO: 52706 - DNA, 20 bp, Artificial Sequence
  chemically synthesized
tttggtctctctactatttg

SEQ ID NO: 52707 - DNA, 20 bp, Artificial Sequence
  chemically synthesized
ttggtctctctactatttgt

SEQ ID NO: 52708 - DNA, 20 bp, Artificial Sequence
  chemically synthesized
actatttgtaggctgatata

SEQ ID NO: 52709 - DNA, 20 bp, Artificial Sequence
  chemically synthesized
cacacacatatacacacaca

SEQ ID NO: 52710 - DNA, 20 bp, Artificial Sequence
  chemically synthesized
acacacacacagtgtatctt

SEQ ID NO: 52711 - DNA, 20 bp, Artificial Sequence
  chemically synthesized
atatctacacacatatgtat

SEQ ID NO: 52712 - DNA, 20 bp, Artificial Sequence
  chemically synthesized
ctacacacatatgtataaga

SEQ ID NO: 52713 - DNA, 20 bp, Artificial Sequence
  chemically synthesized
acatatgtataagaaagctc

SEQ ID NO: 52714 - DNA, 20 bp, Artificial Sequence
  chemically synthesized
gtataagaaagctcaagata

SEQ ID NO: 52715 - DNA, 20 bp, Artificial Sequence
  chemically synthesized
taagaaagctcaagatatag

SEQ ID NO: 52716 - DNA, 20 bp, Artificial Sequence
  chemically synthesized
cctttttcaaaaataactga

SEQ ID NO: 52717 - DNA, 20 bp, Artificial Sequence
  chemically synthesized
ctgaaagtttcaaactcttt

SEQ ID NO: 52718 - DNA, 20 bp, Artificial Sequence
  chemically synthesized
tttcaaactctttaagtctc

SEQ ID NO: 52719 - DNA, 20 bp, Artificial Sequence
  chemically synthesized
gtctccagttaccattttgc

SEQ ID NO: 52720 - DNA, 20 bp, Artificial Sequence
  chemically synthesized
attttgctggtattcttatt

SEQ ID NO: 52721 - DNA, 20 bp, Artificial Sequence
  chemically synthesized
acattcatcatattgttgca

SEQ ID NO: 52722 - DNA, 20 bp, Artificial Sequence
  chemically synthesized
tcatcatattgttgcacagt

SEQ ID NO: 52723 - DNA, 20 bp, Artificial Sequence
  chemically synthesized
attattttgcttaaacgtat

SEQ ID NO: 52724 - DNA, 20 bp, Artificial Sequence
  chemically synthesized
aacgtatgagttaaaacact

SEQ ID NO: 52725 - DNA, 20 bp, Artificial Sequence
  chemically synthesized
tatgagttaaaacacttggc

SEQ ID NO: 52726 - DNA, 20 bp, Artificial Sequence
  chemically synthesized
atgagttaaaacacttggcc

SEQ ID NO: 52727 - DNA, 20 bp, Artificial Sequence
  chemically synthesized
ttaaaacacttggccaggca

SEQ ID NO: 52728 - DNA, 20 bp, Artificial Sequence
  chemically synthesized
aaacacttggccaggcatgg

SEQ ID NO: 52729 - DNA, 20 bp, Artificial Sequence
  chemically synthesized
gtggttcacacctgtaatcc

SEQ ID NO: 52730 - DNA, 20 bp, Artificial Sequence
  chemically synthesized
ggttcacacctgtaatccca

SEQ ID NO: 52731 - DNA, 20 bp, Artificial Sequence
  chemically synthesized
cacctgtaatcccagagctt

SEQ ID NO: 52732 - DNA, 20 bp, Artificial Sequence
  chemically synthesized
acctgtaatcccagagcttt

SEQ ID NO: 52733 - DNA, 20 bp, Artificial Sequence
  chemically synthesized
tgtaatcccagagctttggg

SEQ ID NO: 52734 - DNA, 20 bp, Artificial Sequence
  chemically synthesized
tcccagagctttgggaagcc

SEQ ID NO: 52735 - DNA, 20 bp, Artificial Sequence
  chemically synthesized
gagctttgggaagccaagac

SEQ ID NO: 52736 - DNA, 20 bp, Artificial Sequence
  chemically synthesized
ctttgggaagccaagactgg

SEQ ID NO: 52737 - DNA, 20 bp, Artificial Sequence
  chemically synthesized
ccaagactggcagatctctt

SEQ ID NO: 52738 - DNA, 20 bp, Artificial Sequence
  chemically synthesized
actggcagatctcttgagct

SEQ ID NO: 52739 - DNA, 20 bp, Artificial Sequence
  chemically synthesized
ctggcagatctcttgagctc

SEQ ID NO: 52740 - DNA, 20 bp, Artificial Sequence
  chemically synthesized
tctcttgagctcaggaattc

SEQ ID NO: 52741 - DNA, 20 bp, Artificial Sequence
  chemically synthesized
tgagctcaggaattcaagac

SEQ ID NO: 52742 - DNA, 20 bp, Artificial Sequence
  chemically synthesized
tcaggaattcaagaccagcc

SEQ ID NO: 52743 - DNA, 20 bp, Artificial Sequence
  chemically synthesized
caggaattcaagaccagcct

SEQ ID NO: 52744 - DNA, 20 bp, Artificial Sequence
  chemically synthesized
caagaccagcctgggcaaca

SEQ ID NO: 52745 - DNA, 20 bp, Artificial Sequence
  chemically synthesized
gaaaaaccccatctctacaa

SEQ ID NO: 52746 - DNA, 20 bp, Artificial Sequence
  chemically synthesized
aaccccatctctacaaaaga

SEQ ID NO: 52747 - DNA, 20 bp, Artificial Sequence
  chemically synthesized
tctacaaaagatagaaaaat

SEQ ID NO: 52748 - DNA, 20 bp, Artificial Sequence
  chemically synthesized
caaaagatagaaaaattagc

SEQ ID NO: 52749 - DNA, 20 bp, Artificial Sequence
  chemically synthesized
aaaagatagaaaaattagcc

SEQ ID NO: 52750 - DNA, 20 bp, Artificial Sequence
  chemically synthesized
atagaaaaattagccaggca

SEQ ID NO: 52751 - DNA, 20 bp, Artificial Sequence
  chemically synthesized
gaaaaattagccaggcatgg

SEQ ID NO: 52752 - DNA, 20 bp, Artificial Sequence
  chemically synthesized
ggcatggtggcgtgtgcctg

SEQ ID NO: 52753 - DNA, 20 bp, Artificial Sequence
  chemically synthesized
gtggcgtgtgcctgtggtcc

SEQ ID NO: 52754 - DNA, 20 bp, Artificial Sequence
  chemically synthesized
tgcctgtggtcccagctact

SEQ ID NO: 52755 - DNA, 20 bp, Artificial Sequence
  chemically synthesized
gcctgtggtcccagctactc

SEQ ID NO: 52756 - DNA, 20 bp, Artificial Sequence
  chemically synthesized
ctgtggtcccagctactcag

SEQ ID NO: 52757 - DNA, 20 bp, Artificial Sequence
  chemically synthesized
tgtggtcccagctactcagg

SEQ ID NO: 52758 - DNA, 20 bp, Artificial Sequence
  chemically synthesized
tcccagctactcaggaggct

SEQ ID NO: 52759 - DNA, 20 bp, Artificial Sequence
  chemically synthesized
cccagctactcaggaggctg

SEQ ID NO: 52760 - DNA, 20 bp, Artificial Sequence
  chemically synthesized
agctactcaggaggctgagg

SEQ ID NO: 52761 - DNA, 20 bp, Artificial Sequence
  chemically synthesized
gctactcaggaggctgaggt

SEQ ID NO: 52762 - DNA, 20 bp, Artificial Sequence
  chemically synthesized
tactcaggaggctgaggtgg

SEQ ID NO: 52763 - DNA, 20 bp, Artificial Sequence
  chemically synthesized
actcaggaggctgaggtggg

SEQ ID NO: 52764 - DNA, 20 bp, Artificial Sequence
  chemically synthesized
ctgaggtgggaggatcacat

SEQ ID NO: 52765 - DNA, 20 bp, Artificial Sequence
  chemically synthesized
gtgggaggatcacattagcc

SEQ ID NO: 52766 - DNA, 20 bp, Artificial Sequence
  chemically synthesized
tgggaggatcacattagccc

SEQ ID NO: 52767 - DNA, 20 bp, Artificial Sequence
  chemically synthesized
ggaggatcacattagcccag

SEQ ID NO: 52768 - DNA, 20 bp, Artificial Sequence
  chemically synthesized
gaggatcacattagcccagg

SEQ ID NO: 52769 - DNA, 20 bp, Artificial Sequence
  chemically synthesized
tcacattagcccaggaggtt

SEQ ID NO: 52770 - DNA, 20 bp, Artificial Sequence
  chemically synthesized
cacattagcccaggaggttg

SEQ ID NO: 52771 - DNA, 20 bp, Artificial Sequence
  chemically synthesized
agcccaggaggttgaggctg

SEQ ID NO: 52772 - DNA, 20 bp, Artificial Sequence
  chemically synthesized
caggaggttgaggctgcagt

SEQ ID NO: 52773 - DNA, 20 bp, Artificial Sequence
  chemically synthesized
gtgattatgccactgcactc

SEQ ID NO: 52774 - DNA, 20 bp, Artificial Sequence
  chemically synthesized
tatgccactgcactccagcc

SEQ ID NO: 52775 - DNA, 20 bp, Artificial Sequence
  chemically synthesized
atgccactgcactccagcct

SEQ ID NO: 52776 - DNA, 20 bp, Artificial Sequence
  chemically synthesized
gccactgcactccagcctgg

SEQ ID NO: 52777 - DNA, 20 bp, Artificial Sequence
  chemically synthesized
ctgcactccagcctgggaga

SEQ ID NO: 52778 - DNA, 20 bp, Artificial Sequence
  chemically synthesized
gcactccagcctgggagaca

SEQ ID NO: 52779 - DNA, 20 bp, Artificial Sequence
  chemically synthesized
tccagcctgggagacagagt

SEQ ID NO: 52780 - DNA, 20 bp, Artificial Sequence
  chemically synthesized
tgagaccctgtttcaaaaaa

SEQ ID NO: 52781 - DNA, 20 bp, Artificial Sequence
  chemically synthesized
agaccctgtttcaaaaaaaa

SEQ ID NO: 52782 - DNA, 20 bp, Artificial Sequence
  chemically synthesized
accctgtttcaaaaaaaaga

SEQ ID NO: 52783 - DNA, 20 bp, Artificial Sequence
  chemically synthesized
cctgtttcaaaaaaaagaga

SEQ ID NO: 52784 - DNA, 20 bp, Artificial Sequence
  chemically synthesized
aagagagagaaaatttaaaa

SEQ ID NO: 52785 - DNA, 20 bp, Artificial Sequence
  chemically synthesized
ttaaaaaagaaaacaacacc

SEQ ID NO: 52786 - DNA, 20 bp, Artificial Sequence
  chemically synthesized
taaaaaagaaaacaacacca

SEQ ID NO: 52787 - DNA, 20 bp, Artificial Sequence
  chemically synthesized
aaaaaagaaaacaacaccaa

SEQ ID NO: 52788 - DNA, 20 bp, Artificial Sequence
  chemically synthesized
acaccaagggctgtaacttt

SEQ ID NO: 52789 - DNA, 20 bp, Artificial Sequence
  chemically synthesized
caccaagggctgtaacttta

SEQ ID NO: 52790 - DNA, 20 bp, Artificial Sequence
  chemically synthesized
attcaaaaacgattactttc

SEQ ID NO: 52791 - DNA, 20 bp, Artificial Sequence
  chemically synthesized
aacgattactttctggccct

SEQ ID NO: 52792 - DNA, 20 bp, Artificial Sequence
  chemically synthesized
cgattactttctggccctaa

SEQ ID NO: 52793 - DNA, 20 bp, Artificial Sequence
  chemically synthesized
tttctggccctaagagacat

SEQ ID NO: 52794 - DNA, 20 bp, Artificial Sequence
  chemically synthesized
ttctggccctaagagacatg

SEQ ID NO: 52795 - DNA, 20 bp, Artificial Sequence
  chemically synthesized
aagagacatgaggccaatac

SEQ ID NO: 52796 - DNA, 20 bp, Artificial Sequence
  chemically synthesized
agagacatgaggccaatacc

SEQ ID NO: 52797 - DNA, 20 bp, Artificial Sequence
  chemically synthesized
gacatgaggccaataccagg

SEQ ID NO: 52798 - DNA, 20 bp, Artificial Sequence
  chemically synthesized
acatgaggccaataccagga

SEQ ID NO: 52799 - DNA, 20 bp, Artificial Sequence
  chemically synthesized
catgaggccaataccaggaa

SEQ ID NO: 52800 - DNA, 20 bp, Artificial Sequence
  chemically synthesized
atgaggccaataccaggaag

SEQ ID NO: 52801 - DNA, 20 bp, Artificial Sequence
  chemically synthesized
tgaggccaataccaggaagg

SEQ ID NO: 52802 - DNA, 20 bp, Artificial Sequence
  chemically synthesized
agggggttgatctcccaaac

SEQ ID NO: 52803 - DNA, 20 bp, Artificial Sequence
  chemically synthesized
ggggttgatctcccaaacca

SEQ ID NO: 52804 - DNA, 20 bp, Artificial Sequence
  chemically synthesized
gggttgatctcccaaaccag

SEQ ID NO: 52805 - DNA, 20 bp, Artificial Sequence
  chemically synthesized
ttgatctcccaaaccagagg

SEQ ID NO: 52806 - DNA, 20 bp, Artificial Sequence
  chemically synthesized
cccaaaccagaggcagaccc

SEQ ID NO: 52807 - DNA, 20 bp, Artificial Sequence
  chemically synthesized
gcagaccctagactctaata

SEQ ID NO: 52808 - DNA, 20 bp, Artificial Sequence
  chemically synthesized
ccctagactctaatacagtt

SEQ ID NO: 52809 - DNA, 20 bp, Artificial Sequence
  chemically synthesized
cctagactctaatacagtta

SEQ ID NO: 52810 - DNA, 20 bp, Artificial Sequence
  chemically synthesized
gactctaatacagttaagga

SEQ ID NO: 52811 - DNA, 20 bp, Artificial Sequence
  chemically synthesized
taatacagttaaggaaagac

SEQ ID NO: 52812 - DNA, 20 bp, Artificial Sequence
  chemically synthesized
acagttaaggaaagaccagc

SEQ ID NO: 52813 - DNA, 20 bp, Artificial Sequence
  chemically synthesized
aggaaagaccagcaagatga

SEQ ID NO: 52814 - DNA, 20 bp, Artificial Sequence
  chemically synthesized
gatgatagtccccaatacaa

SEQ ID NO: 52815 - DNA, 20 bp, Artificial Sequence
  chemically synthesized
gatagtccccaatacaatag

SEQ ID NO: 52816 - DNA, 20 bp, Artificial Sequence
  chemically synthesized
tgttttgttttgttttgttt

SEQ ID NO: 52817 - DNA, 20 bp, Artificial Sequence
  chemically synthesized
ttttgttttgttttgtttta

SEQ ID NO: 52818 - DNA, 20 bp, Artificial Sequence
  chemically synthesized
ttttgttttgttttagagac

SEQ ID NO: 52819 - DNA, 20 bp, Artificial Sequence
  chemically synthesized
tttgttttgttttagagact

SEQ ID NO: 52820 - DNA, 20 bp, Artificial Sequence
  chemically synthesized
ttgttttgttttagagactg

SEQ ID NO: 52821 - DNA, 20 bp, Artificial Sequence
  chemically synthesized
tggggtcttgctcgattgcc

SEQ ID NO: 52822 - DNA, 20 bp, Artificial Sequence
  chemically synthesized
ggggtcttgctcgattgccc

SEQ ID NO: 52823 - DNA, 20 bp, Artificial Sequence
  chemically synthesized
ttgctcgattgcccaggctg

SEQ ID NO: 52824 - DNA, 20 bp, Artificial Sequence
  chemically synthesized
cgattgcccaggctgtagtg

SEQ ID NO: 52825 - DNA, 20 bp, Artificial Sequence
  chemically synthesized
ttgcccaggctgtagtgcag

SEQ ID NO: 52826 - DNA, 20 bp, Artificial Sequence
  chemically synthesized
cccaggctgtagtgcagcgg

SEQ ID NO: 52827 - DNA, 20 bp, Artificial Sequence
  chemically synthesized
ccaggctgtagtgcagcggt

SEQ ID NO: 52828 - DNA, 20 bp, Artificial Sequence
  chemically synthesized
gtagtgcagcggtgggacaa

SEQ ID NO: 52829 - DNA, 20 bp, Artificial Sequence
  chemically synthesized
ggtgggacaatagctcactg

SEQ ID NO: 52830 - DNA, 20 bp, Artificial Sequence
  chemically synthesized
tcactgcagactccaactcc

SEQ ID NO: 52831 - DNA, 20 bp, Artificial Sequence
  chemically synthesized
cactgcagactccaactcct

SEQ ID NO: 52832 - DNA, 20 bp, Artificial Sequence
  chemically synthesized
agactccaactcctgggctc

SEQ ID NO: 52833 - DNA, 20 bp, Artificial Sequence
  chemically synthesized
ctcaagcaatcctcctgcct

SEQ ID NO: 52834 - DNA, 20 bp, Artificial Sequence
  chemically synthesized
tcctgcctcagcctcctgaa

SEQ ID NO: 52835 - DNA, 20 bp, Artificial Sequence
  chemically synthesized
gcctcagcctcctgaatagc

SEQ ID NO: 52836 - DNA, 20 bp, Artificial Sequence
  chemically synthesized
cctcagcctcctgaatagct

SEQ ID NO: 52837 - DNA, 20 bp, Artificial Sequence
  chemically synthesized
tcctgaatagctgggactac

SEQ ID NO: 52838 - DNA, 20 bp, Artificial Sequence
  chemically synthesized
cctgaatagctgggactaca

SEQ ID NO: 52839 - DNA, 20 bp, Artificial Sequence
  chemically synthesized
ctgaatagctgggactacaa

SEQ ID NO: 52840 - DNA, 20 bp, Artificial Sequence
  chemically synthesized
caattttttaaatttttgtg

SEQ ID NO: 52841 - DNA, 20 bp, Artificial Sequence
  chemically synthesized
ttaaatttttgtgtagaaac

SEQ ID NO: 52842 - DNA, 20 bp, Artificial Sequence
  chemically synthesized
taaatttttgtgtagaaacg

SEQ ID NO: 52843 - DNA, 20 bp, Artificial Sequence
  chemically synthesized
aaatttttgtgtagaaacga

SEQ ID NO: 52844 - DNA, 20 bp, Artificial Sequence
  chemically synthesized
gagggtcttgctttgttgcc

SEQ ID NO: 52845 - DNA, 20 bp, Artificial Sequence
  chemically synthesized
agggtcttgctttgttgccc

SEQ ID NO: 52846 - DNA, 20 bp, Artificial Sequence
  chemically synthesized
tcttgctttgttgcccaggc

SEQ ID NO: 52847 - DNA, 20 bp, Artificial Sequence
  chemically synthesized
ccaggctggtctccaactcc

SEQ ID NO: 52848 - DNA, 20 bp, Artificial Sequence
  chemically synthesized
ggtctccaactcctggcttc

SEQ ID NO: 52849 - DNA, 20 bp, Artificial Sequence
  chemically synthesized
gtctccaactcctggcttca

SEQ ID NO: 52850 - DNA, 20 bp, Artificial Sequence
  chemically synthesized
tctccaactcctggcttcaa

SEQ ID NO: 52851 - DNA, 20 bp, Artificial Sequence
  chemically synthesized
ttcaagggatcctcccacct

SEQ ID NO: 52852 - DNA, 20 bp, Artificial Sequence
  chemically synthesized
acctcagcctcccaaattgc

SEQ ID NO: 52853 - DNA, 20 bp, Artificial Sequence
  chemically synthesized
cctcagcctcccaaattgct

SEQ ID NO: 52854 - DNA, 20 bp, Artificial Sequence
  chemically synthesized
ctcccaaattgctgggatta

SEQ ID NO: 52855 - DNA, 20 bp, Artificial Sequence
  chemically synthesized
tcccaaattgctgggattac

SEQ ID NO: 52856 - DNA, 20 bp, Artificial Sequence
  chemically synthesized
attgctgggattacaggtgt

SEQ ID NO: 52857 - DNA, 20 bp, Artificial Sequence
  chemically synthesized
caggtgtgagccaccacaac

SEQ ID NO: 52858 - DNA, 20 bp, Artificial Sequence
  chemically synthesized
tgtgagccaccacaaccagc

SEQ ID NO: 52859 - DNA, 20 bp, Artificial Sequence
  chemically synthesized
actttactaattttaaaatt

SEQ ID NO: 52860 - DNA, 20 bp, Artificial Sequence
  chemically synthesized
ttaagaacttaaaacttgaa

SEQ ID NO: 52861 - DNA, 20 bp, Artificial Sequence
  chemically synthesized
gaacttaaaacttgaatagc

SEQ ID NO: 52862 - DNA, 20 bp, Artificial Sequence
  chemically synthesized
acttaaaacttgaatagcta

SEQ ID NO: 52863 - DNA, 20 bp, Artificial Sequence
  chemically synthesized
acttgaatagctagagcacc

SEQ ID NO: 52864 - DNA, 20 bp, Artificial Sequence
  chemically synthesized
atttttctttgtccccaaat

SEQ ID NO: 52865 - DNA, 20 bp, Artificial Sequence
  chemically synthesized
tctttgtccccaaataagtg

SEQ ID NO: 52866 - DNA, 20 bp, Artificial Sequence
  chemically synthesized
tccccaaataagtgcagttg

SEQ ID NO: 52867 - DNA, 20 bp, Artificial Sequence
  chemically synthesized
ccccaaataagtgcagttgc

SEQ ID NO: 52868 - DNA, 20 bp, Artificial Sequence
  chemically synthesized
aataagtgcagttgcaggca

SEQ ID NO: 52869 - DNA, 20 bp, Artificial Sequence
  chemically synthesized
agaaaatctgacatctttgc

SEQ ID NO: 52870 - DNA, 20 bp, Artificial Sequence
  chemically synthesized
catctttgcaagaatcatcg

SEQ ID NO: 52871 - DNA, 20 bp, Artificial Sequence
  chemically synthesized
tgcaagaatcatcgtggatg

SEQ ID NO: 52872 - DNA, 20 bp, Artificial Sequence
  chemically synthesized
tagactctgtcctgtgtctc

SEQ ID NO: 52873 - DNA, 20 bp, Artificial Sequence
  chemically synthesized
tctgtcctgtgtctctggcc

SEQ ID NO: 52874 - DNA, 20 bp, Artificial Sequence
  chemically synthesized
ctgtgtctctggcctggttt

SEQ ID NO: 52875 - DNA, 20 bp, Artificial Sequence
  chemically synthesized
tgtgtctctggcctggtttc

SEQ ID NO: 52876 - DNA, 20 bp, Artificial Sequence
  chemically synthesized
gtgtctctggcctggtttcg

SEQ ID NO: 52877 - DNA, 20 bp, Artificial Sequence
  chemically synthesized
tctggcctggtttcggggac

SEQ ID NO: 52878 - DNA, 20 bp, Artificial Sequence
  chemically synthesized
ctggcctggtttcggggacc

SEQ ID NO: 52879 - DNA, 20 bp, Artificial Sequence
  chemically synthesized
ggcctggtttcggggaccag

SEQ ID NO: 52880 - DNA, 20 bp, Artificial Sequence
  chemically synthesized
gcctggtttcggggaccagg

SEQ ID NO: 52881 - DNA, 20 bp, Artificial Sequence
  chemically synthesized
cctggtttcggggaccagga

SEQ ID NO: 52882 - DNA, 20 bp, Artificial Sequence
  chemically synthesized
ggtttcggggaccaggaggg

SEQ ID NO: 52883 - DNA, 20 bp, Artificial Sequence
  chemically synthesized
gggcagacccttgcactgcc

SEQ ID NO: 52884 - DNA, 20 bp, Artificial Sequence
  chemically synthesized
cagacccttgcactgccaag

SEQ ID NO: 52885 - DNA, 20 bp, Artificial Sequence
  chemically synthesized
cactgccaagaagcatgcca

SEQ ID NO: 52886 - DNA, 20 bp, Artificial Sequence
  chemically synthesized
agcatgccaaagttaatcat

SEQ ID NO: 52887 - DNA, 20 bp, Artificial Sequence
  chemically synthesized
agttaatcattggccctgct

SEQ ID NO: 52888 - DNA, 20 bp, Artificial Sequence
  chemically synthesized
cattggccctgctgagtaca

SEQ ID NO: 52889 - DNA, 20 bp, Artificial Sequence
  chemically synthesized
ctgctgagtacatggccgat

SEQ ID NO: 52890 - DNA, 20 bp, Artificial Sequence
  chemically synthesized
tgctgagtacatggccgatc

SEQ ID NO: 52891 - DNA, 20 bp, Artificial Sequence
  chemically synthesized
acatgtttgcatcaacctac

SEQ ID NO: 52892 - DNA, 20 bp, Artificial Sequence
  chemically synthesized
cacctttgatcaatacattt

SEQ ID NO: 52893 - DNA, 20 bp, Artificial Sequence
  chemically synthesized
caatacattttagacaaacg

SEQ ID NO: 52894 - DNA, 20 bp, Artificial Sequence
  chemically synthesized
tttagacaaacgtggttttt

SEQ ID NO: 52895 - DNA, 20 bp, Artificial Sequence
  chemically synthesized
aaacgtggtttttgagtcca

SEQ ID NO: 52896 - DNA, 20 bp, Artificial Sequence
  chemically synthesized
tggtttttgagtccaaagat

SEQ ID NO: 52897 - DNA, 20 bp, Artificial Sequence
  chemically synthesized
ggtttttgagtccaaagatc

SEQ ID NO: 52898 - DNA, 20 bp, Artificial Sequence
  chemically synthesized
gtttttgagtccaaagatca

SEQ ID NO: 52899 - DNA, 20 bp, Artificial Sequence
  chemically synthesized
ttgagtccaaagatcagggc

SEQ ID NO: 52900 - DNA, 20 bp, Artificial Sequence
  chemically synthesized
tgagtccaaagatcagggct

SEQ ID NO: 52901 - DNA, 20 bp, Artificial Sequence
  chemically synthesized
ggctgggttgacctgaatac

SEQ ID NO: 52902 - DNA, 20 bp, Artificial Sequence
  chemically synthesized
gttgacctgaatactggata

SEQ ID NO: 52903 - DNA, 20 bp, Artificial Sequence
  chemically synthesized
ttgacctgaatactggatac

SEQ ID NO: 52904 - DNA, 20 bp, Artificial Sequence
  chemically synthesized
tgacctgaatactggataca

SEQ ID NO: 52905 - DNA, 20 bp, Artificial Sequence
  chemically synthesized
tggatacagggcatataaaa

SEQ ID NO: 52906 - DNA, 20 bp, Artificial Sequence
  chemically synthesized
ggatacagggcatataaaac

SEQ ID NO: 52907 - DNA, 20 bp, Artificial Sequence
  chemically synthesized
gatacagggcatataaaaca

SEQ ID NO: 52908 - DNA, 20 bp, Artificial Sequence
  chemically synthesized
atacagggcatataaaacag

SEQ ID NO: 52909 - DNA, 20 bp, Artificial Sequence
  chemically synthesized
agggcatataaaacaggggc

SEQ ID NO: 52910 - DNA, 20 bp, Artificial Sequence
  chemically synthesized
gggcatataaaacaggggca

SEQ ID NO: 52911 - DNA, 20 bp, Artificial Sequence
  chemically synthesized
tataaaacaggggcaaggca

SEQ ID NO: 52912 - DNA, 20 bp, Artificial Sequence
  chemically synthesized
aggggcaaggcacagactca

SEQ ID NO: 52913 - DNA, 20 bp, Artificial Sequence
  chemically synthesized
ggcaaggcacagactcatag

SEQ ID NO: 52914 - DNA, 20 bp, Artificial Sequence
  chemically synthesized
caaggcacagactcatagca

SEQ ID NO: 52915 - DNA, 20 bp, Artificial Sequence
  chemically synthesized
atagcagagcaatcaccacc

SEQ ID NO: 52916 - DNA, 20 bp, Artificial Sequence
  chemically synthesized
agagcaatcaccaccaagcc

SEQ ID NO: 52917 - DNA, 20 bp, Artificial Sequence
  chemically synthesized
accaagcctggaataactgc

SEQ ID NO: 52918 - DNA, 20 bp, Artificial Sequence
  chemically synthesized
ccaagcctggaataactgca

SEQ ID NO: 52919 - DNA, 20 bp, Artificial Sequence
  chemically synthesized
caagcctggaataactgcaa

SEQ ID NO: 52920 - DNA, 20 bp, Artificial Sequence
  chemically synthesized
ggctctgctgacatcttcct

SEQ ID NO: 52921 - DNA, 20 bp, Artificial Sequence
  chemically synthesized
gctctgctgacatcttcctg

SEQ ID NO: 52922 - DNA, 20 bp, Artificial Sequence
  chemically synthesized
tgacatcttcctgaggtgcc

SEQ ID NO: 52923 - DNA, 20 bp, Artificial Sequence
  chemically synthesized
gacatcttcctgaggtgcca

SEQ ID NO: 52924 - DNA, 20 bp, Artificial Sequence
  chemically synthesized
tcctgaggtgccaaggaaat

SEQ ID NO: 52925 - DNA, 20 bp, Artificial Sequence
  chemically synthesized
cctgaggtgccaaggaaatg

SEQ ID NO: 52926 - DNA, 20 bp, Artificial Sequence
  chemically synthesized
aggtgccaaggaaatgagga

SEQ ID NO: 52927 - DNA, 20 bp, Artificial Sequence
  chemically synthesized
gtgccaaggaaatgaggatg

SEQ ID NO: 52928 - DNA, 20 bp, Artificial Sequence
  chemically synthesized
tgccaaggaaatgaggatgg

SEQ ID NO: 52929 - DNA, 20 bp, Artificial Sequence
  chemically synthesized
caaggaaatgaggatggagg

SEQ ID NO: 52930 - DNA, 20 bp, Artificial Sequence
  chemically synthesized
aaggaaatgaggatggagga

SEQ ID NO: 52931 - DNA, 20 bp, Artificial Sequence
  chemically synthesized
atgaatgttctccatgactt

SEQ ID NO: 52932 - DNA, 20 bp, Artificial Sequence
  chemically synthesized
tgaatgttctccatgacttt

SEQ ID NO: 52933 - DNA, 20 bp, Artificial Sequence
  chemically synthesized
ttctccatgactttgggatc

SEQ ID NO: 52934 - DNA, 20 bp, Artificial Sequence
  chemically synthesized
tccagtcaacacattacctc

SEQ ID NO: 52935 - DNA, 20 bp, Artificial Sequence
  chemically synthesized
ccagtcaacacattacctcc

SEQ ID NO: 52936 - DNA, 20 bp, Artificial Sequence
  chemically synthesized
ttacctccaggtgaattacc

SEQ ID NO: 52937 - DNA, 20 bp, Artificial Sequence
  chemically synthesized
aggtgaattaccaagactcc

SEQ ID NO: 52938 - DNA, 20 bp, Artificial Sequence
  chemically synthesized
ggtgaattaccaagactccc

SEQ ID NO: 52939 - DNA, 20 bp, Artificial Sequence
  chemically synthesized
attaccaagactcccaggac

SEQ ID NO: 52940 - DNA, 20 bp, Artificial Sequence
  chemically synthesized
ctcccaggactggttcatct

SEQ ID NO: 52941 - DNA, 20 bp, Artificial Sequence
  chemically synthesized
catcttggtgtccgtgatcg

SEQ ID NO: 52942 - DNA, 20 bp, Artificial Sequence
  chemically synthesized
gtgtccgtgatcgcagacct

SEQ ID NO: 52943 - DNA, 20 bp, Artificial Sequence
  chemically synthesized
tgtccgtgatcgcagacctc

SEQ ID NO: 52944 - DNA, 20 bp, Artificial Sequence
  chemically synthesized
tctacgtcctcttccccatc

SEQ ID NO: 52945 - DNA, 20 bp, Artificial Sequence
  chemically synthesized
tccccatctggttccatctt

SEQ ID NO: 52946 - DNA, 20 bp, Artificial Sequence
  chemically synthesized
ccccatctggttccatcttc

SEQ ID NO: 52947 - DNA, 20 bp, Artificial Sequence
  chemically synthesized
catctggttccatcttcagg

SEQ ID NO: 52948 - DNA, 20 bp, Artificial Sequence
  chemically synthesized
gttccatcttcaggaagctg

SEQ ID NO: 52949 - DNA, 20 bp, Artificial Sequence
  chemically synthesized
ttccatcttcaggaagctgt

SEQ ID NO: 52950 - DNA, 20 bp, Artificial Sequence
  chemically synthesized
ctgtgggcattaaactcctt

SEQ ID NO: 52951 - DNA, 20 bp, Artificial Sequence
  chemically synthesized
tgtgggcattaaactccttt

SEQ ID NO: 52952 - DNA, 20 bp, Artificial Sequence
  chemically synthesized
gggcattaaactcctttggg

SEQ ID NO: 52953 - DNA, 20 bp, Artificial Sequence
  chemically synthesized
ctcctttgggtagctgtgat

SEQ ID NO: 52954 - DNA, 20 bp, Artificial Sequence
  chemically synthesized
cctttgggtagctgtgattg

SEQ ID NO: 52955 - DNA, 20 bp, Artificial Sequence
  chemically synthesized
gggtagctgtgattggagac

SEQ ID NO: 52956 - DNA, 20 bp, Artificial Sequence
  chemically synthesized
actggctcaacctcgtcttt

SEQ ID NO: 52957 - DNA, 20 bp, Artificial Sequence
  chemically synthesized
ggctcaacctcgtctttaag

SEQ ID NO: 52958 - DNA, 20 bp, Artificial Sequence
  chemically synthesized
caacctcgtctttaagtggt

SEQ ID NO: 52959 - DNA, 20 bp, Artificial Sequence
  chemically synthesized
tttaagtggtaagaaccata

SEQ ID NO: 52960 - DNA, 20 bp, Artificial Sequence
  chemically synthesized
taagtggtaagaaccatata

SEQ ID NO: 52961 - DNA, 20 bp, Artificial Sequence
  chemically synthesized
agtggtaagaaccatataga

SEQ ID NO: 52962 - DNA, 20 bp, Artificial Sequence
  chemically synthesized
gtggtaagaaccatatagag

SEQ ID NO: 52963 - DNA, 20 bp, Artificial Sequence
  chemically synthesized
ggtaagaaccatatagagag

SEQ ID NO: 52964 - DNA, 20 bp, Artificial Sequence
  chemically synthesized
gaaccatatagagaggagat

SEQ ID NO: 52965 - DNA, 20 bp, Artificial Sequence
  chemically synthesized
catatagagaggagatcagc

SEQ ID NO: 52966 - DNA, 20 bp, Artificial Sequence
  chemically synthesized
agagaggagatcagcaagaa

SEQ ID NO: 52967 - DNA, 20 bp, Artificial Sequence
  chemically synthesized
agaggagatcagcaagaaaa

SEQ ID NO: 52968 - DNA, 20 bp, Artificial Sequence
  chemically synthesized
gaggagatcagcaagaaaag

SEQ ID NO: 52969 - DNA, 20 bp, Artificial Sequence
  chemically synthesized
agatcagcaagaaaagaggc

SEQ ID NO: 52970 - DNA, 20 bp, Artificial Sequence
  chemically synthesized
ctctcgcaatgtctgtccat

SEQ ID NO: 52971 - DNA, 20 bp, Artificial Sequence
  chemically synthesized
tcgcaatgtctgtccatcag

SEQ ID NO: 52972 - DNA, 20 bp, Artificial Sequence
  chemically synthesized
ccatcagaagttgctttccc

SEQ ID NO: 52973 - DNA, 20 bp, Artificial Sequence
  chemically synthesized
catcagaagttgctttcccc

SEQ ID NO: 52974 - DNA, 20 bp, Artificial Sequence
  chemically synthesized
gttgctttccccaggctatt

SEQ ID NO: 52975 - DNA, 20 bp, Artificial Sequence
  chemically synthesized
ttgctttccccaggctattc

SEQ ID NO: 52976 - DNA, 20 bp, Artificial Sequence
  chemically synthesized
ctttccccaggctattcagg

SEQ ID NO: 52977 - DNA, 20 bp, Artificial Sequence
  chemically synthesized
ccaggctattcaggaagcca

SEQ ID NO: 52978 - DNA, 20 bp, Artificial Sequence
  chemically synthesized
caggctattcaggaagccac

SEQ ID NO: 52979 - DNA, 20 bp, Artificial Sequence
  chemically synthesized
ccaacccctctctctgactt

SEQ ID NO: 52980 - DNA, 20 bp, Artificial Sequence
  chemically synthesized
gactttggatcatctacata

SEQ ID NO: 52981 - DNA, 20 bp, Artificial Sequence
  chemically synthesized
actttggatcatctacataa

SEQ ID NO: 52982 - DNA, 20 bp, Artificial Sequence
  chemically synthesized
ctttggatcatctacataaa

SEQ ID NO: 52983 - DNA, 20 bp, Artificial Sequence
  chemically synthesized
tttggatcatctacataaag

SEQ ID NO: 52984 - DNA, 20 bp, Artificial Sequence
  chemically synthesized
ttggatcatctacataaagg

SEQ ID NO: 52985 - DNA, 20 bp, Artificial Sequence
  chemically synthesized
gatcatctacataaaggggg

SEQ ID NO: 52986 - DNA, 20 bp, Artificial Sequence
  chemically synthesized
atctacataaagggggaaga

SEQ ID NO: 52987 - DNA, 20 bp, Artificial Sequence
  chemically synthesized
gaagacagaaaaaatcctac

SEQ ID NO: 52988 - DNA, 20 bp, Artificial Sequence
  chemically synthesized
acagaaaaaatcctaccagt

SEQ ID NO: 52989 - DNA, 20 bp, Artificial Sequence
  chemically synthesized
ctaccagtgagttgaaaata

SEQ ID NO: 52990 - DNA, 20 bp, Artificial Sequence
  chemically synthesized
taccagtgagttgaaaatac

SEQ ID NO: 52991 - DNA, 20 bp, Artificial Sequence
  chemically synthesized
agtgagttgaaaatacagga

SEQ ID NO: 52992 - DNA, 20 bp, Artificial Sequence
  chemically synthesized
acaggaaagcctatttcata

SEQ ID NO: 52993 - DNA, 20 bp, Artificial Sequence
  chemically synthesized
caggaaagcctatttcatat

SEQ ID NO: 52994 - DNA, 20 bp, Artificial Sequence
  chemically synthesized
agcctatttcatatgggtta

SEQ ID NO: 52995 - DNA, 20 bp, Artificial Sequence
  chemically synthesized
gcctatttcatatgggttaa

SEQ ID NO: 52996 - DNA, 20 bp, Artificial Sequence
  chemically synthesized
cctatttcatatgggttaaa

SEQ ID NO: 52997 - DNA, 20 bp, Artificial Sequence
  chemically synthesized
atttcatatgggttaaaggg

SEQ ID NO: 52998 - DNA, 20 bp, Artificial Sequence
  chemically synthesized
tttcatatgggttaaagggt

SEQ ID NO: 52999 - DNA, 20 bp, Artificial Sequence
  chemically synthesized
atatgggttaaagggtagga

SEQ ID NO: 53000 - DNA, 20 bp, Artificial Sequence
  chemically synthesized
ggacagttgaatttcgtgaa

SEQ ID NO: 53001 - DNA, 20 bp, Artificial Sequence
  chemically synthesized
ttgaatttcgtgaaaagtct

SEQ ID NO: 53002 - DNA, 20 bp, Artificial Sequence
  chemically synthesized
cgtgaaaagtctgagttata

SEQ ID NO: 53003 - DNA, 20 bp, Artificial Sequence
  chemically synthesized
gtgaaaagtctgagttatat

SEQ ID NO: 53004 - DNA, 20 bp, Artificial Sequence
  chemically synthesized
gtctgagttatataggcttt

SEQ ID NO: 53005 - DNA, 20 bp, Artificial Sequence
  chemically synthesized
agttatataggctttgagca

SEQ ID NO: 53006 - DNA, 20 bp, Artificial Sequence
  chemically synthesized
ttatataggctttgagcaaa

SEQ ID NO: 53007 - DNA, 20 bp, Artificial Sequence
  chemically synthesized
ctttgagcaaagagttttat

SEQ ID NO: 53008 - DNA, 20 bp, Artificial Sequence
  chemically synthesized
caaagagttttattagtatg

SEQ ID NO: 53009 - DNA, 20 bp, Artificial Sequence
  chemically synthesized
agagttttattagtatgaag

SEQ ID NO: 53010 - DNA, 20 bp, Artificial Sequence
  chemically synthesized
gttttattagtatgaagcag

SEQ ID NO: 53011 - DNA, 20 bp, Artificial Sequence
  chemically synthesized
tttattagtatgaagcagaa

SEQ ID NO: 53012 - DNA, 20 bp, Artificial Sequence
  chemically synthesized
ttattagtatgaagcagaag

SEQ ID NO: 53013 - DNA, 20 bp, Artificial Sequence
  chemically synthesized
gaagcagaagaggtaacata

SEQ ID NO: 53014 - DNA, 20 bp, Artificial Sequence
  chemically synthesized
cagaagaggtaacataaaga

SEQ ID NO: 53015 - DNA, 20 bp, Artificial Sequence
  chemically synthesized
gtaacataaagaaagatgta

SEQ ID NO: 53016 - DNA, 20 bp, Artificial Sequence
  chemically synthesized
taacataaagaaagatgtat

SEQ ID NO: 53017 - DNA, 20 bp, Artificial Sequence
  chemically synthesized
aacataaagaaagatgtatg

SEQ ID NO: 53018 - DNA, 20 bp, Artificial Sequence
  chemically synthesized
taaagaaagatgtatggggc

SEQ ID NO: 53019 - DNA, 20 bp, Artificial Sequence
  chemically synthesized
aaagaaagatgtatggggcc

SEQ ID NO: 53020 - DNA, 20 bp, Artificial Sequence
  chemically synthesized
aagatgtatggggccaggca

SEQ ID NO: 53021 - DNA, 20 bp, Artificial Sequence
  chemically synthesized
atgtatggggccaggcatgg

SEQ ID NO: 53022 - DNA, 20 bp, Artificial Sequence
  chemically synthesized
gtggctcacacctgtaatcc

SEQ ID NO: 53023 - DNA, 20 bp, Artificial Sequence
  chemically synthesized
cacctgtaatcccagcactt

SEQ ID NO: 53024 - DNA, 20 bp, Artificial Sequence
  chemically synthesized
acctgtaatcccagcacttt

SEQ ID NO: 53025 - DNA, 20 bp, Artificial Sequence
  chemically synthesized
ctgtaatcccagcactttgg

SEQ ID NO: 53026 - DNA, 20 bp, Artificial Sequence
  chemically synthesized
tgtaatcccagcactttggg

SEQ ID NO: 53027 - DNA, 20 bp, Artificial Sequence
  chemically synthesized
tcccagcactttgggaggcc

SEQ ID NO: 53028 - DNA, 20 bp, Artificial Sequence
  chemically synthesized
cccagcactttgggaggccg

SEQ ID NO: 53029 - DNA, 20 bp, Artificial Sequence
  chemically synthesized
agcactttgggaggccgagg

SEQ ID NO: 53030 - DNA, 20 bp, Artificial Sequence
  chemically synthesized
gcactttgggaggccgaggt

SEQ ID NO: 53031 - DNA, 20 bp, Artificial Sequence
  chemically synthesized
cgaggtgggcgaatcactcc

SEQ ID NO: 53032 - DNA, 20 bp, Artificial Sequence
  chemically synthesized
gaggtgggcgaatcactcct

SEQ ID NO: 53033 - DNA, 20 bp, Artificial Sequence
  chemically synthesized
gaatcactcctgggtgaact

SEQ ID NO: 53034 - DNA, 20 bp, Artificial Sequence
  chemically synthesized
aatcactcctgggtgaactc

SEQ ID NO: 53035 - DNA, 20 bp, Artificial Sequence
  chemically synthesized
tcactcctgggtgaactcag

SEQ ID NO: 53036 - DNA, 20 bp, Artificial Sequence
  chemically synthesized
ctgggtgaactcaggagttc

SEQ ID NO: 53037 - DNA, 20 bp, Artificial Sequence
  chemically synthesized
tgaactcaggagttcaagac

SEQ ID NO: 53038 - DNA, 20 bp, Artificial Sequence
  chemically synthesized
tcaggagttcaagaccagcc

SEQ ID NO: 53039 - DNA, 20 bp, Artificial Sequence
  chemically synthesized
caggagttcaagaccagcct

SEQ ID NO: 53040 - DNA, 20 bp, Artificial Sequence
  chemically synthesized
caagaccagcctgggcaaca

SEQ ID NO: 53041 - DNA, 20 bp, Artificial Sequence
  chemically synthesized
tacaaaaacattacgaaaat

SEQ ID NO: 53042 - DNA, 20 bp, Artificial Sequence
  chemically synthesized
aaaacattacgaaaattagc

SEQ ID NO: 53043 - DNA, 20 bp, Artificial Sequence
  chemically synthesized
aaacattacgaaaattagct

SEQ ID NO: 53044 - DNA, 20 bp, Artificial Sequence
  chemically synthesized
cgaaaattagctgggcgtgt

SEQ ID NO: 53045 - DNA, 20 bp, Artificial Sequence
  chemically synthesized
agctgggcgtgttggtgctg

SEQ ID NO: 53046 - DNA, 20 bp, Artificial Sequence
  chemically synthesized
gcgtgttggtgctgtagtcc

SEQ ID NO: 53047 - DNA, 20 bp, Artificial Sequence
  chemically synthesized
gtgctgtagtcccagctact

SEQ ID NO: 53048 - DNA, 20 bp, Artificial Sequence
  chemically synthesized
tgctgtagtcccagctactc

SEQ ID NO: 53049 - DNA, 20 bp, Artificial Sequence
  chemically synthesized
ctgtagtcccagctactcag

SEQ ID NO: 53050 - DNA, 20 bp, Artificial Sequence
  chemically synthesized
tgtagtcccagctactcagg

SEQ ID NO: 53051 - DNA, 20 bp, Artificial Sequence
  chemically synthesized
tcccagctactcaggaggct

SEQ ID NO: 53052 - DNA, 20 bp, Artificial Sequence
  chemically synthesized
cccagctactcaggaggctg

SEQ ID NO: 53053 - DNA, 20 bp, Artificial Sequence
  chemically synthesized
gctactcaggaggctgaggt

SEQ ID NO: 53054 - DNA, 20 bp, Artificial Sequence
  chemically synthesized
tactcaggaggctgaggtga

SEQ ID NO: 53055 - DNA, 20 bp, Artificial Sequence
  chemically synthesized
actcaggaggctgaggtgag

SEQ ID NO: 53056 - DNA, 20 bp, Artificial Sequence
  chemically synthesized
caggaggctgaggtgagagg

SEQ ID NO: 53057 - DNA, 20 bp, Artificial Sequence
  chemically synthesized
ggaggctgaggtgagaggcg

SEQ ID NO: 53058 - DNA, 20 bp, Artificial Sequence
  chemically synthesized
gaggctgaggtgagaggcgg

SEQ ID NO: 53059 - DNA, 20 bp, Artificial Sequence
  chemically synthesized
ggctgaggtgagaggcggag

SEQ ID NO: 53060 - DNA, 20 bp, Artificial Sequence
  chemically synthesized
gctgaggtgagaggcggagg

SEQ ID NO: 53061 - DNA, 20 bp, Artificial Sequence
  chemically synthesized
gtgagaggcggaggaggttg

SEQ ID NO: 53062 - DNA, 20 bp, Artificial Sequence
  chemically synthesized
gaggcggaggaggttgcagt

SEQ ID NO: 53063 - DNA, 20 bp, Artificial Sequence
  chemically synthesized
ggaggaggttgcagtgagtc

SEQ ID NO: 53064 - DNA, 20 bp, Artificial Sequence
  chemically synthesized
aagatcatgccactgcactc

SEQ ID NO: 53065 - DNA, 20 bp, Artificial Sequence
  chemically synthesized
catgccactgcactccagcc

SEQ ID NO: 53066 - DNA, 20 bp, Artificial Sequence
  chemically synthesized
atgccactgcactccagcct

SEQ ID NO: 53067 - DNA, 20 bp, Artificial Sequence
  chemically synthesized
ctgcactccagcctgggcaa

SEQ ID NO: 53068 - DNA, 20 bp, Artificial Sequence
  chemically synthesized
gcactccagcctgggcaaca

SEQ ID NO: 53069 - DNA, 20 bp, Artificial Sequence
  chemically synthesized
tccagcctgggcaacagagt

SEQ ID NO: 53070 - DNA, 20 bp, Artificial Sequence
  chemically synthesized
cctgtctcaaaaaaaaaaaa

SEQ ID NO: 53071 - DNA, 20 bp, Artificial Sequence
  chemically synthesized
tctcaaaaaaaaaaaaaaga

SEQ ID NO: 53072 - DNA, 20 bp, Artificial Sequence
  chemically synthesized
tgatgtatgctgtatgaaaa

SEQ ID NO: 53073 - DNA, 20 bp, Artificial Sequence
  chemically synthesized
gatgtatgctgtatgaaaaa

SEQ ID NO: 53074 - DNA, 20 bp, Artificial Sequence
  chemically synthesized
gtatgaaaaaaggaaacaca

SEQ ID NO: 53075 - DNA, 20 bp, Artificial Sequence
  chemically synthesized
gaaacacacagatgattcaa

SEQ ID NO: 53076 - DNA, 20 bp, Artificial Sequence
  chemically synthesized
tgattcaacagcctgttttg

SEQ ID NO: 53077 - DNA, 20 bp, Artificial Sequence
  chemically synthesized
gattcaacagcctgttttgt

SEQ ID NO: 53078 - DNA, 20 bp, Artificial Sequence
  chemically synthesized
attcaacagcctgttttgtg

SEQ ID NO: 53079 - DNA, 20 bp, Artificial Sequence
  chemically synthesized
ctgttttgtggggtaatgaa

SEQ ID NO: 53080 - DNA, 20 bp, Artificial Sequence
  chemically synthesized
ggggtaatgaaaagtcaccc

SEQ ID NO: 53081 - DNA, 20 bp, Artificial Sequence
  chemically synthesized
gggtaatgaaaagtcaccct

SEQ ID NO: 53082 - DNA, 20 bp, Artificial Sequence
  chemically synthesized
tgaaaagtcaccctgggaac

SEQ ID NO: 53083 - DNA, 20 bp, Artificial Sequence
  chemically synthesized
gaaaagtcaccctgggaact

SEQ ID NO: 53084 - DNA, 20 bp, Artificial Sequence
  chemically synthesized
tcaccctgggaactgggctc

SEQ ID NO: 53085 - DNA, 20 bp, Artificial Sequence
  chemically synthesized
acccaccaactacatgtcct

SEQ ID NO: 53086 - DNA, 20 bp, Artificial Sequence
  chemically synthesized
accaactacatgtccttggc

SEQ ID NO: 53087 - DNA, 20 bp, Artificial Sequence
  chemically synthesized
gcaagtcatatcaattatct

SEQ ID NO: 53088 - DNA, 20 bp, Artificial Sequence
  chemically synthesized
tctgttttataatctacaaa

SEQ ID NO: 53089 - DNA, 20 bp, Artificial Sequence
  chemically synthesized
ctgttttataatctacaaat

SEQ ID NO: 53090 - DNA, 20 bp, Artificial Sequence
  chemically synthesized
atctacaaataggttatctc

SEQ ID NO: 53091 - DNA, 20 bp, Artificial Sequence
  chemically synthesized
tacaaataggttatctctgg

SEQ ID NO: 53092 - DNA, 20 bp, Artificial Sequence
  chemically synthesized
tctggcagcttaataataat

SEQ ID NO: 53093 - DNA, 20 bp, Artificial Sequence
  chemically synthesized
ctggcagcttaataataatc

SEQ ID NO: 53094 - DNA, 20 bp, Artificial Sequence
  chemically synthesized
tggcagcttaataataatca

SEQ ID NO: 53095 - DNA, 20 bp, Artificial Sequence
  chemically synthesized
cagggttaacatttattaaa

SEQ ID NO: 53096 - DNA, 20 bp, Artificial Sequence
  chemically synthesized
atttattaaacagtgtgtgc

SEQ ID NO: 53097 - DNA, 20 bp, Artificial Sequence
  chemically synthesized
tgtgctatgtgcttttctgt

SEQ ID NO: 53098 - DNA, 20 bp, Artificial Sequence
  chemically synthesized
gtgctatgtgcttttctgtg

SEQ ID NO: 53099 - DNA, 20 bp, Artificial Sequence
  chemically synthesized
ctatgtgcttttctgtgagg

SEQ ID NO: 53100 - DNA, 20 bp, Artificial Sequence
  chemically synthesized
gaggtagttactgctattta

SEQ ID NO: 53101 - DNA, 20 bp, Artificial Sequence
  chemically synthesized
gttactgctatttacagaaa

SEQ ID NO: 53102 - DNA, 20 bp, Artificial Sequence
  chemically synthesized
actgctatttacagaaacag

SEQ ID NO: 53103 - DNA, 20 bp, Artificial Sequence
  chemically synthesized
atttacagaaacagtagatg

SEQ ID NO: 53104 - DNA, 20 bp, Artificial Sequence
  chemically synthesized
ttacagaaacagtagatgca

SEQ ID NO: 53105 - DNA, 20 bp, Artificial Sequence
  chemically synthesized
aaacagtagatgcagagacc

SEQ ID NO: 53106 - DNA, 20 bp, Artificial Sequence
  chemically synthesized
aacagtagatgcagagacca

SEQ ID NO: 53107 - DNA, 20 bp, Artificial Sequence
  chemically synthesized
gatgcagagaccaaggtgct

SEQ ID NO: 53108 - DNA, 20 bp, Artificial Sequence
  chemically synthesized
aaggtgctgagttaaatgat

SEQ ID NO: 53109 - DNA, 20 bp, Artificial Sequence
  chemically synthesized
aggtgctgagttaaatgatt

SEQ ID NO: 53110 - DNA, 20 bp, Artificial Sequence
  chemically synthesized
agttaaatgattaggccaac

SEQ ID NO: 53111 - DNA, 20 bp, Artificial Sequence
  chemically synthesized
gttaaatgattaggccaaca

SEQ ID NO: 53112 - DNA, 20 bp, Artificial Sequence
  chemically synthesized
aatgattaggccaacaaggt

SEQ ID NO: 53113 - DNA, 20 bp, Artificial Sequence
  chemically synthesized
caacaaggttagtacatgcc

SEQ ID NO: 53114 - DNA, 20 bp, Artificial Sequence
  chemically synthesized
aaggttagtacatgccgagc

SEQ ID NO: 53115 - DNA, 20 bp, Artificial Sequence
  chemically synthesized
aggttagtacatgccgagcc

SEQ ID NO: 53116 - DNA, 20 bp, Artificial Sequence
  chemically synthesized
tagtacatgccgagccagga

SEQ ID NO: 53117 - DNA, 20 bp, Artificial Sequence
  chemically synthesized
tacatgccgagccaggatgg

SEQ ID NO: 53118 - DNA, 20 bp, Artificial Sequence
  chemically synthesized
gccgagccaggatggaagcc

SEQ ID NO: 53119 - DNA, 20 bp, Artificial Sequence
  chemically synthesized
ccgagccaggatggaagccc

SEQ ID NO: 53120 - DNA, 20 bp, Artificial Sequence
  chemically synthesized
agccaggatggaagcccagg

SEQ ID NO: 53121 - DNA, 20 bp, Artificial Sequence
  chemically synthesized
gccaggatggaagcccaggt

SEQ ID NO: 53122 - DNA, 20 bp, Artificial Sequence
  chemically synthesized
aggatggaagcccaggtagg

SEQ ID NO: 53123 - DNA, 20 bp, Artificial Sequence
  chemically synthesized
ggatggaagcccaggtaggc

SEQ ID NO: 53124 - DNA, 20 bp, Artificial Sequence
  chemically synthesized
ggaagcccaggtaggcaggc

SEQ ID NO: 53125 - DNA, 20 bp, Artificial Sequence
  chemically synthesized
ggtaggcaggctggcttccg

SEQ ID NO: 53126 - DNA, 20 bp, Artificial Sequence
  chemically synthesized
cttatgaactatgttacgtc

SEQ ID NO: 53127 - DNA, 20 bp, Artificial Sequence
  chemically synthesized
gtgctgataaactgactctc

SEQ ID NO: 53128 - DNA, 20 bp, Artificial Sequence
  chemically synthesized
tgctgataaactgactctct

SEQ ID NO: 53129 - DNA, 20 bp, Artificial Sequence
  chemically synthesized
gctgataaactgactctctg

SEQ ID NO: 53130 - DNA, 20 bp, Artificial Sequence
  chemically synthesized
tgataaactgactctctggg

SEQ ID NO: 53131 - DNA, 20 bp, Artificial Sequence
  chemically synthesized
taaactgactctctggggag

SEQ ID NO: 53132 - DNA, 20 bp, Artificial Sequence
  chemically synthesized
aaactgactctctggggagc

SEQ ID NO: 53133 - DNA, 20 bp, Artificial Sequence
  chemically synthesized
aactgactctctggggagca

SEQ ID NO: 53134 - DNA, 20 bp, Artificial Sequence
  chemically synthesized
actgactctctggggagcag

SEQ ID NO: 53135 - DNA, 20 bp, Artificial Sequence
  chemically synthesized
actctctggggagcagggga

SEQ ID NO: 53136 - DNA, 20 bp, Artificial Sequence
  chemically synthesized
ggggagcaggggaaagccct

SEQ ID NO: 53137 - DNA, 20 bp, Artificial Sequence
  chemically synthesized
gcaggggaaagccctgagtt

SEQ ID NO: 53138 - DNA, 20 bp, Artificial Sequence
  chemically synthesized
tcacgtaaacattcccattc

SEQ ID NO: 53139 - DNA, 20 bp, Artificial Sequence
  chemically synthesized
tttcttttgtttgtttgttt

SEQ ID NO: 53140 - DNA, 20 bp, Artificial Sequence
  chemically synthesized
ttttgtttgtttgtttgaga

SEQ ID NO: 53141 - DNA, 20 bp, Artificial Sequence
  chemically synthesized
ttgtttgtttgtttgagatg

SEQ ID NO: 53142 - DNA, 20 bp, Artificial Sequence
  chemically synthesized
tggagtctcgcactgttgcc

SEQ ID NO: 53143 - DNA, 20 bp, Artificial Sequence
  chemically synthesized
gtctcgcactgttgcctggc

SEQ ID NO: 53144 - DNA, 20 bp, Artificial Sequence
  chemically synthesized
ctcgcactgttgcctggctg

SEQ ID NO: 53145 - DNA, 20 bp, Artificial Sequence
  chemically synthesized
gttgcctggctggagtgcaa

SEQ ID NO: 53146 - DNA, 20 bp, Artificial Sequence
  chemically synthesized
ggagtgcaatggtgcaatct

SEQ ID NO: 53147 - DNA, 20 bp, Artificial Sequence
  chemically synthesized
cactgcaacctctgcctctc

SEQ ID NO: 53148 - DNA, 20 bp, Artificial Sequence
  chemically synthesized
aacctctgcctctccggttc

SEQ ID NO: 53149 - DNA, 20 bp, Artificial Sequence
  chemically synthesized
ttcaagtgattctcctgcct

SEQ ID NO: 53150 - DNA, 20 bp, Artificial Sequence
  chemically synthesized
ttctcctgcctcagcctccc

SEQ ID NO: 53151 - DNA, 20 bp, Artificial Sequence
  chemically synthesized
tcctgcctcagcctcccaag

SEQ ID NO: 53152 - DNA, 20 bp, Artificial Sequence
  chemically synthesized
gcctcagcctcccaagtagc

SEQ ID NO: 53153 - DNA, 20 bp, Artificial Sequence
  chemically synthesized
cctcagcctcccaagtagct

SEQ ID NO: 53154 - DNA, 20 bp, Artificial Sequence
  chemically synthesized
ctcccaagtagctgggatta

SEQ ID NO: 53155 - DNA, 20 bp, Artificial Sequence
  chemically synthesized
tcccaagtagctgggattac

SEQ ID NO: 53156 - DNA, 20 bp, Artificial Sequence
  chemically synthesized
caggtgcccgccaccatgcc

SEQ ID NO: 53157 - DNA, 20 bp, Artificial Sequence
  chemically synthesized
gctaattttttttgtatttt

SEQ ID NO: 53158 - DNA, 20 bp, Artificial Sequence
  chemically synthesized
aattttttttgtatttttag

SEQ ID NO: 53159 - DNA, 20 bp, Artificial Sequence
  chemically synthesized
ttttttttgtatttttagta

SEQ ID NO: 53160 - DNA, 20 bp, Artificial Sequence
  chemically synthesized
ttgtatttttagtagagaca

SEQ ID NO: 53161 - DNA, 20 bp, Artificial Sequence
  chemically synthesized
catggtttcactatgttgac

SEQ ID NO: 53162 - DNA, 20 bp, Artificial Sequence
  chemically synthesized
atggtttcactatgttgact

SEQ ID NO: 53163 - DNA, 20 bp, Artificial Sequence
  chemically synthesized
tttcactatgttgactaggc

SEQ ID NO: 53164 - DNA, 20 bp, Artificial Sequence
  chemically synthesized
acctcatgatctgcctgcct

SEQ ID NO: 53165 - DNA, 20 bp, Artificial Sequence
  chemically synthesized
ctgcctgccttggcctccct

SEQ ID NO: 53166 - DNA, 20 bp, Artificial Sequence
  chemically synthesized
gccttggcctccctaagtgc

SEQ ID NO: 53167 - DNA, 20 bp, Artificial Sequence
  chemically synthesized
ccttggcctccctaagtgct

SEQ ID NO: 53168 - DNA, 20 bp, Artificial Sequence
  chemically synthesized
ctccctaagtgctaggatta

SEQ ID NO: 53169 - DNA, 20 bp, Artificial Sequence
  chemically synthesized
tccctaagtgctaggattac

SEQ ID NO: 53170 - DNA, 20 bp, Artificial Sequence
  chemically synthesized
agtgctaggattacaggcgt

SEQ ID NO: 53171 - DNA, 20 bp, Artificial Sequence
  chemically synthesized
caggcgtgagccactacacc

SEQ ID NO: 53172 - DNA, 20 bp, Artificial Sequence
  chemically synthesized
gcatgattctaaaaaataaa

SEQ ID NO: 53173 - DNA, 20 bp, Artificial Sequence
  chemically synthesized
ttctaaaaaataaaaagatg

SEQ ID NO: 53174 - DNA, 20 bp, Artificial Sequence
  chemically synthesized
caaacatctgatctccattg

SEQ ID NO: 53175 - DNA, 20 bp, Artificial Sequence
  chemically synthesized
gaagaaccatgcaatctctc

SEQ ID NO: 53176 - DNA, 20 bp, Artificial Sequence
  chemically synthesized
aagaaccatgcaatctctct

SEQ ID NO: 53177 - DNA, 20 bp, Artificial Sequence
  chemically synthesized
atgcaatctctctgggttga

SEQ ID NO: 53178 - DNA, 20 bp, Artificial Sequence
  chemically synthesized
gcaatctctctgggttgata

SEQ ID NO: 53179 - DNA, 20 bp, Artificial Sequence
  chemically synthesized
caatctctctgggttgatag

SEQ ID NO: 53180 - DNA, 20 bp, Artificial Sequence
  chemically synthesized
ctctctgggttgatagaggc

SEQ ID NO: 53181 - DNA, 20 bp, Artificial Sequence
  chemically synthesized
ctctgggttgatagaggcca

SEQ ID NO: 53182 - DNA, 20 bp, Artificial Sequence
  chemically synthesized
gggttgatagaggccagagt

SEQ ID NO: 53183 - DNA, 20 bp, Artificial Sequence
  chemically synthesized
ttgatagaggccagagttag

SEQ ID NO: 53184 - DNA, 20 bp, Artificial Sequence
  chemically synthesized
ttagtggctctccctgattt

SEQ ID NO: 53185 - DNA, 20 bp, Artificial Sequence
  chemically synthesized
tggctctccctgatttcggt

SEQ ID NO: 53186 - DNA, 20 bp, Artificial Sequence
  chemically synthesized
aaatcactattccaccatca

SEQ ID NO: 53187 - DNA, 20 bp, Artificial Sequence
  chemically synthesized
aatcactattccaccatcac

SEQ ID NO: 53188 - DNA, 20 bp, Artificial Sequence
  chemically synthesized
attccaccatcacgggataa

SEQ ID NO: 53189 - DNA, 20 bp, Artificial Sequence
  chemically synthesized
ttccaccatcacgggataaa

SEQ ID NO: 53190 - DNA, 20 bp, Artificial Sequence
  chemically synthesized
gggataaaaggcatcctgac

SEQ ID NO: 53191 - DNA, 20 bp, Artificial Sequence
  chemically synthesized
ataaaaggcatcctgactgg

SEQ ID NO: 53192 - DNA, 20 bp, Artificial Sequence
  chemically synthesized
gcggttgacacctatttcca

SEQ ID NO: 53193 - DNA, 20 bp, Artificial Sequence
  chemically synthesized
gacacctatttccacagtga

SEQ ID NO: 53194 - DNA, 20 bp, Artificial Sequence
  chemically synthesized
tccacagtgaaagatatatc

SEQ ID NO: 53195 - DNA, 20 bp, Artificial Sequence
  chemically synthesized
agatatatctagtactttta

SEQ ID NO: 53196 - DNA, 20 bp, Artificial Sequence
  chemically synthesized
gatatatctagtacttttaa

SEQ ID NO: 53197 - DNA, 20 bp, Artificial Sequence
  chemically synthesized
atatatctagtacttttaaa

SEQ ID NO: 53198 - DNA, 20 bp, Artificial Sequence
  chemically synthesized
tatatctagtacttttaaag

SEQ ID NO: 53199 - DNA, 20 bp, Artificial Sequence
  chemically synthesized
atctagtacttttaaagggg

SEQ ID NO: 53200 - DNA, 20 bp, Artificial Sequence
  chemically synthesized
tagtacttttaaaggggaag

SEQ ID NO: 53201 - DNA, 20 bp, Artificial Sequence
  chemically synthesized
aaaggggaagtggtttgtct

SEQ ID NO: 53202 - DNA, 20 bp, Artificial Sequence
  chemically synthesized
gtctgagatactctgtttca

SEQ ID NO: 53203 - DNA, 20 bp, Artificial Sequence
  chemically synthesized
tgagatactctgtttcaaag

SEQ ID NO: 53204 - DNA, 20 bp, Artificial Sequence
  chemically synthesized
agatactctgtttcaaagta

SEQ ID NO: 53205 - DNA, 20 bp, Artificial Sequence
  chemically synthesized
atactctgtttcaaagtaga

SEQ ID NO: 53206 - DNA, 20 bp, Artificial Sequence
  chemically synthesized
tactctgtttcaaagtagag

SEQ ID NO: 53207 - DNA, 20 bp, Artificial Sequence
  chemically synthesized
gtttcaaagtagagaggata

SEQ ID NO: 53208 - DNA, 20 bp, Artificial Sequence
  chemically synthesized
aagtagagaggatacagaac

SEQ ID NO: 53209 - DNA, 20 bp, Artificial Sequence
  chemically synthesized
ggatacagaacaagcatctg

SEQ ID NO: 53210 - DNA, 20 bp, Artificial Sequence
  chemically synthesized
tgaagctatatacatcctta

SEQ ID NO: 53211 - DNA, 20 bp, Artificial Sequence
  chemically synthesized
aagctatatacatccttaca

SEQ ID NO: 53212 - DNA, 20 bp, Artificial Sequence
  chemically synthesized
gctatatacatccttacaga

SEQ ID NO: 53213 - DNA, 20 bp, Artificial Sequence
  chemically synthesized
cttacagagagcaattctga

SEQ ID NO: 53214 - DNA, 20 bp, Artificial Sequence
  chemically synthesized
gagcaattctgatggaaatg

SEQ ID NO: 53215 - DNA, 20 bp, Artificial Sequence
  chemically synthesized
agcaattctgatggaaatgc

SEQ ID NO: 53216 - DNA, 20 bp, Artificial Sequence
  chemically synthesized
aaatgcaggccatgtttccc

SEQ ID NO: 53217 - DNA, 20 bp, Artificial Sequence
  chemically synthesized
aatgcaggccatgtttccct

SEQ ID NO: 53218 - DNA, 20 bp, Artificial Sequence
  chemically synthesized
atgcaggccatgtttccctg

SEQ ID NO: 53219 - DNA, 20 bp, Artificial Sequence
  chemically synthesized
tgcaggccatgtttccctgg

SEQ ID NO: 53220 - DNA, 20 bp, Artificial Sequence
  chemically synthesized
gcaggccatgtttccctggg

SEQ ID NO: 53221 - DNA, 20 bp, Artificial Sequence
  chemically synthesized
caggccatgtttccctgggg

SEQ ID NO: 53222 - DNA, 20 bp, Artificial Sequence
  chemically synthesized
aggccatgtttccctggggg

SEQ ID NO: 53223 - DNA, 20 bp, Artificial Sequence
  chemically synthesized
tccctggggggggctcgtcc

SEQ ID NO: 53224 - DNA, 20 bp, Artificial Sequence
  chemically synthesized
ccctggggggggctcgtcct

SEQ ID NO: 53225 - DNA, 20 bp, Artificial Sequence
  chemically synthesized
cctggggggggctcgtccta

SEQ ID NO: 53226 - DNA, 20 bp, Artificial Sequence
  chemically synthesized
ctggggggggctcgtcctag

SEQ ID NO: 53227 - DNA, 20 bp, Artificial Sequence
  chemically synthesized
ggggggctcgtcctaggggc

SEQ ID NO: 53228 - DNA, 20 bp, Artificial Sequence
  chemically synthesized
ggggctcgtcctaggggctg

SEQ ID NO: 53229 - DNA, 20 bp, Artificial Sequence
  chemically synthesized
tggagtgcattctctgatgt

SEQ ID NO: 53230 - DNA, 20 bp, Artificial Sequence
  chemically synthesized
gagtgcattctctgatgtca

SEQ ID NO: 53231 - DNA, 20 bp, Artificial Sequence
  chemically synthesized
agtgcattctctgatgtcag

SEQ ID NO: 53232 - DNA, 20 bp, Artificial Sequence
  chemically synthesized
tctgatgtcagaggaaatgc

SEQ ID NO: 53233 - DNA, 20 bp, Artificial Sequence
  chemically synthesized
gaggaaatgcaagattccct

SEQ ID NO: 53234 - DNA, 20 bp, Artificial Sequence
  chemically synthesized
aggaaatgcaagattccctg

SEQ ID NO: 53235 - DNA, 20 bp, Artificial Sequence
  chemically synthesized
tgcaagattccctgaggcct

SEQ ID NO: 53236 - DNA, 20 bp, Artificial Sequence
  chemically synthesized
gcaagattccctgaggcctg

SEQ ID NO: 53237 - DNA, 20 bp, Artificial Sequence
  chemically synthesized
caagattccctgaggcctga

SEQ ID NO: 53238 - DNA, 20 bp, Artificial Sequence
  chemically synthesized
ctgaggcctgagggaaccca

SEQ ID NO: 53239 - DNA, 20 bp, Artificial Sequence
  chemically synthesized
agggaacccatggtatatgc

SEQ ID NO: 53240 - DNA, 20 bp, Artificial Sequence
  chemically synthesized
cccatggtatatgcaagtcc

SEQ ID NO: 53241 - DNA, 20 bp, Artificial Sequence
  chemically synthesized
caagtccaagtttcaaactg

SEQ ID NO: 53242 - DNA, 20 bp, Artificial Sequence
  chemically synthesized
tagttccatatgcattcttc

SEQ ID NO: 53243 - DNA, 20 bp, Artificial Sequence
  chemically synthesized
agttccatatgcattcttcc

SEQ ID NO: 53244 - DNA, 20 bp, Artificial Sequence
  chemically synthesized
ttccaggacaaatacttctt

SEQ ID NO: 53245 - DNA, 20 bp, Artificial Sequence
  chemically synthesized
tccaggacaaatacttcttg

SEQ ID NO: 53246 - DNA, 20 bp, Artificial Sequence
  chemically synthesized
ttcttgaggttaaaaaaaaa

SEQ ID NO: 53247 - DNA, 20 bp, Artificial Sequence
  chemically synthesized
gttaaaaaaaaaaagtcaca

SEQ ID NO: 53248 - DNA, 20 bp, Artificial Sequence
  chemically synthesized
gtcacatagctgccatttta

SEQ ID NO: 53249 - DNA, 20 bp, Artificial Sequence
  chemically synthesized
agctgccattttatggattt

SEQ ID NO: 53250 - DNA, 20 bp, Artificial Sequence
  chemically synthesized
gctgccattttatggatttc

SEQ ID NO: 53251 - DNA, 20 bp, Artificial Sequence
  chemically synthesized
attttttttttttttttttt

SEQ ID NO: 53252 - DNA, 20 bp, Artificial Sequence
  chemically synthesized
ttttttttttttttttgaga

SEQ ID NO: 53253 - DNA, 20 bp, Artificial Sequence
  chemically synthesized
ttttttttttttttgagatg

SEQ ID NO: 53254 - DNA, 20 bp, Artificial Sequence
  chemically synthesized
tggagtcttgctctgtcacc

SEQ ID NO: 53255 - DNA, 20 bp, Artificial Sequence
  chemically synthesized
ttgctctgtcacccagcctg

SEQ ID NO: 53256 - DNA, 20 bp, Artificial Sequence
  chemically synthesized
ctgtcacccagcctgtagtg

SEQ ID NO: 53257 - DNA, 20 bp, Artificial Sequence
  chemically synthesized
tcacccagcctgtagtgcag

SEQ ID NO: 53258 - DNA, 20 bp, Artificial Sequence
  chemically synthesized
gtagtgcagtggcataatct

SEQ ID NO: 53259 - DNA, 20 bp, Artificial Sequence
  chemically synthesized
agtggcataatctcggctca

SEQ ID NO: 53260 - DNA, 20 bp, Artificial Sequence
  chemically synthesized
tcacggcaacctccgcctcc

SEQ ID NO: 53261 - DNA, 20 bp, Artificial Sequence
  chemically synthesized
cacggcaacctccgcctccc

SEQ ID NO: 53262 - DNA, 20 bp, Artificial Sequence
  chemically synthesized
aacctccgcctcccaggttc

SEQ ID NO: 53263 - DNA, 20 bp, Artificial Sequence
  chemically synthesized
ttcaagcgattctcttgcct

SEQ ID NO: 53264 - DNA, 20 bp, Artificial Sequence
  chemically synthesized
ttctcttgccttagcctccc

SEQ ID NO: 53265 - DNA, 20 bp, Artificial Sequence
  chemically synthesized
tcttgccttagcctcccgag

SEQ ID NO: 53266 - DNA, 20 bp, Artificial Sequence
  chemically synthesized
gccttagcctcccgagtagc

SEQ ID NO: 53267 - DNA, 20 bp, Artificial Sequence
  chemically synthesized
ccttagcctcccgagtagct

SEQ ID NO: 53268 - DNA, 20 bp, Artificial Sequence
  chemically synthesized
ctcccgagtagctgggatta

SEQ ID NO: 53269 - DNA, 20 bp, Artificial Sequence
  chemically synthesized
cagtcacgcaccaccacatc

SEQ ID NO: 53270 - DNA, 20 bp, Artificial Sequence
  chemically synthesized
ggctaattctttatattttt

SEQ ID NO: 53271 - DNA, 20 bp, Artificial Sequence
  chemically synthesized
taattctttatattttttgg

SEQ ID NO: 53272 - DNA, 20 bp, Artificial Sequence
  chemically synthesized
tttatattttttggtagaaa

SEQ ID NO: 53273 - DNA, 20 bp, Artificial Sequence
  chemically synthesized
gaaacggtgtttcaccatgt

SEQ ID NO: 53274 - DNA, 20 bp, Artificial Sequence
  chemically synthesized
cggtgtttcaccatgttggc

SEQ ID NO: 53275 - DNA, 20 bp, Artificial Sequence
  chemically synthesized
ggtgtttcaccatgttggcc

SEQ ID NO: 53276 - DNA, 20 bp, Artificial Sequence
  chemically synthesized
tttcaccatgttggccaggc

SEQ ID NO: 53277 - DNA, 20 bp, Artificial Sequence
  chemically synthesized
ctcatgtgatctgcctgcct

SEQ ID NO: 53278 - DNA, 20 bp, Artificial Sequence
  chemically synthesized
ctgcctgccttggcctccca

SEQ ID NO: 53279 - DNA, 20 bp, Artificial Sequence
  chemically synthesized
ccttggcctcccaaagtgct

SEQ ID NO: 53280 - DNA, 20 bp, Artificial Sequence
  chemically synthesized
ctcccaaagtgctgagatta

SEQ ID NO: 53281 - DNA, 20 bp, Artificial Sequence
  chemically synthesized
tcccaaagtgctgagattac

SEQ ID NO: 53282 - DNA, 20 bp, Artificial Sequence
  chemically synthesized
agtgctgagattacaggtgt

SEQ ID NO: 53283 - DNA, 20 bp, Artificial Sequence
  chemically synthesized
tgtgagccaccgcgcctgcc

SEQ ID NO: 53284 - DNA, 20 bp, Artificial Sequence
  chemically synthesized
tgagccaccgcgcctgcctg

SEQ ID NO: 53285 - DNA, 20 bp, Artificial Sequence
  chemically synthesized
caccgcgcctgcctggagtt

SEQ ID NO: 53286 - DNA, 20 bp, Artificial Sequence
  chemically synthesized
ctgcctggagttcagaatct

SEQ ID NO: 53287 - DNA, 20 bp, Artificial Sequence
  chemically synthesized
tgcctggagttcagaatctt

SEQ ID NO: 53288 - DNA, 20 bp, Artificial Sequence
  chemically synthesized
cttcattatttgtgtttaaa

SEQ ID NO: 53289 - DNA, 20 bp, Artificial Sequence
  chemically synthesized
ttgtgtttaaatagatcata

SEQ ID NO: 53290 - DNA, 20 bp, Artificial Sequence
  chemically synthesized
gtttaaatagatcatacagt

SEQ ID NO: 53291 - DNA, 20 bp, Artificial Sequence
  chemically synthesized
tttaaatagatcatacagtc

SEQ ID NO: 53292 - DNA, 20 bp, Artificial Sequence
  chemically synthesized
atagatcatacagtcaggca

SEQ ID NO: 53293 - DNA, 20 bp, Artificial Sequence
  chemically synthesized
gatcatacagtcaggcacgg

SEQ ID NO: 53294 - DNA, 20 bp, Artificial Sequence
  chemically synthesized
gtggctcatgcctgtaatcc

SEQ ID NO: 53295 - DNA, 20 bp, Artificial Sequence
  chemically synthesized
tgcctgtaatcccagcactt

SEQ ID NO: 53296 - DNA, 20 bp, Artificial Sequence
  chemically synthesized
gcctgtaatcccagcacttt

SEQ ID NO: 53297 - DNA, 20 bp, Artificial Sequence
  chemically synthesized
ctgtaatcccagcactttgg

SEQ ID NO: 53298 - DNA, 20 bp, Artificial Sequence
  chemically synthesized
tgtaatcccagcactttggg

SEQ ID NO: 53299 - DNA, 20 bp, Artificial Sequence
  chemically synthesized
tcccagcactttgggaggct

SEQ ID NO: 53300 - DNA, 20 bp, Artificial Sequence
  chemically synthesized
cccagcactttgggaggctg

SEQ ID NO: 53301 - DNA, 20 bp, Artificial Sequence
  chemically synthesized
agcactttgggaggctgagg

SEQ ID NO: 53302 - DNA, 20 bp, Artificial Sequence
  chemically synthesized
gcactttgggaggctgaggt

SEQ ID NO: 53303 - DNA, 20 bp, Artificial Sequence
  chemically synthesized
actttgggaggctgaggtgg

SEQ ID NO: 53304 - DNA, 20 bp, Artificial Sequence
  chemically synthesized
ctttgggaggctgaggtggg

SEQ ID NO: 53305 - DNA, 20 bp, Artificial Sequence
  chemically synthesized
ctgaggtgggaggattgcct

SEQ ID NO: 53306 - DNA, 20 bp, Artificial Sequence
  chemically synthesized
gtgggaggattgcctgagtt

SEQ ID NO: 53307 - DNA, 20 bp, Artificial Sequence
  chemically synthesized
tgggaggattgcctgagttc

SEQ ID NO: 53308 - DNA, 20 bp, Artificial Sequence
  chemically synthesized
ggaggattgcctgagttcag

SEQ ID NO: 53309 - DNA, 20 bp, Artificial Sequence
  chemically synthesized
gattgcctgagttcaggaga

SEQ ID NO: 53310 - DNA, 20 bp, Artificial Sequence
  chemically synthesized
ttgcctgagttcaggagatg

SEQ ID NO: 53311 - DNA, 20 bp, Artificial Sequence
  chemically synthesized
tgagttcaggagatggagac

SEQ ID NO: 53312 - DNA, 20 bp, Artificial Sequence
  chemically synthesized
tcaggagatggagaccagcc

SEQ ID NO: 53313 - DNA, 20 bp, Artificial Sequence
  chemically synthesized
caggagatggagaccagcct

SEQ ID NO: 53314 - DNA, 20 bp, Artificial Sequence
  chemically synthesized
ggagaccagcctgggcaaca

SEQ ID NO: 53315 - DNA, 20 bp, Artificial Sequence
  chemically synthesized
tctactaaaaatacaaaaac

SEQ ID NO: 53316 - DNA, 20 bp, Artificial Sequence
  chemically synthesized
ctaaaaatacaaaaactagc

SEQ ID NO: 53317 - DNA, 20 bp, Artificial Sequence
  chemically synthesized
atacaaaaactagctggatg

SEQ ID NO: 53318 - DNA, 20 bp, Artificial Sequence
  chemically synthesized
caaaaactagctggatgtgg

SEQ ID NO: 53319 - DNA, 20 bp, Artificial Sequence
  chemically synthesized
gatgtggtggcacacacctg

SEQ ID NO: 53320 - DNA, 20 bp, Artificial Sequence
  chemically synthesized
gtggcacacacctgtagtcc

SEQ ID NO: 53321 - DNA, 20 bp, Artificial Sequence
  chemically synthesized
cacctgtagtcccagctatt

SEQ ID NO: 53322 - DNA, 20 bp, Artificial Sequence
  chemically synthesized
acctgtagtcccagctattc

SEQ ID NO: 53323 - DNA, 20 bp, Artificial Sequence
  chemically synthesized
ctgtagtcccagctattcag

SEQ ID NO: 53324 - DNA, 20 bp, Artificial Sequence
  chemically synthesized
tgtagtcccagctattcagg

SEQ ID NO: 53325 - DNA, 20 bp, Artificial Sequence
  chemically synthesized
tcccagctattcaggaggct

SEQ ID NO: 53326 - DNA, 20 bp, Artificial Sequence
  chemically synthesized
cccagctattcaggaggctg

SEQ ID NO: 53327 - DNA, 20 bp, Artificial Sequence
  chemically synthesized
agctattcaggaggctgagg

SEQ ID NO: 53328 - DNA, 20 bp, Artificial Sequence
  chemically synthesized
gctattcaggaggctgaggt

SEQ ID NO: 53329 - DNA, 20 bp, Artificial Sequence
  chemically synthesized
tattcaggaggctgaggtgg

SEQ ID NO: 53330 - DNA, 20 bp, Artificial Sequence
  chemically synthesized
attcaggaggctgaggtggg

SEQ ID NO: 53331 - DNA, 20 bp, Artificial Sequence
  chemically synthesized
aggctgaggtgggaggatcc

SEQ ID NO: 53332 - DNA, 20 bp, Artificial Sequence
  chemically synthesized
ggctgaggtgggaggatccc

SEQ ID NO: 53333 - DNA, 20 bp, Artificial Sequence
  chemically synthesized
ctgaggtgggaggatcccag

SEQ ID NO: 53334 - DNA, 20 bp, Artificial Sequence
  chemically synthesized
tgaggtgggaggatcccagg

SEQ ID NO: 53335 - DNA, 20 bp, Artificial Sequence
  chemically synthesized
ggtgggaggatcccaggagg

SEQ ID NO: 53336 - DNA, 20 bp, Artificial Sequence
  chemically synthesized
tgggaggatcccaggaggta

SEQ ID NO: 53337 - DNA, 20 bp, Artificial Sequence
  chemically synthesized
gggaggatcccaggaggtag

SEQ ID NO: 53338 - DNA, 20 bp, Artificial Sequence
  chemically synthesized
caggaggtagaggtcacaat

SEQ ID NO: 53339 - DNA, 20 bp, Artificial Sequence
  chemically synthesized
ggtagaggtcacaatgagcc

SEQ ID NO: 53340 - DNA, 20 bp, Artificial Sequence
  chemically synthesized
gagattgcgccactgcactc

SEQ ID NO: 53341 - DNA, 20 bp, Artificial Sequence
  chemically synthesized
agattgcgccactgcactcc

SEQ ID NO: 53342 - DNA, 20 bp, Artificial Sequence
  chemically synthesized
tgcgccactgcactccaggc

SEQ ID NO: 53343 - DNA, 20 bp, Artificial Sequence
  chemically synthesized
gcgccactgcactccaggct

SEQ ID NO: 53344 - DNA, 20 bp, Artificial Sequence
  chemically synthesized
gcactccaggctgggttact

SEQ ID NO: 53345 - DNA, 20 bp, Artificial Sequence
  chemically synthesized
tccaggctgggttactgagc

SEQ ID NO: 53346 - DNA, 20 bp, Artificial Sequence
  chemically synthesized
atcctgtctcaaaaaaaaaa

SEQ ID NO: 53347 - DNA, 20 bp, Artificial Sequence
  chemically synthesized
aaaaagataatacattcaaa

SEQ ID NO: 53348 - DNA, 20 bp, Artificial Sequence
  chemically synthesized
tcaaacagttcaaaatgcaa

SEQ ID NO: 53349 - DNA, 20 bp, Artificial Sequence
  chemically synthesized
aatgcaaaagttacatacat

SEQ ID NO: 53350 - DNA, 20 bp, Artificial Sequence
  chemically synthesized
atgcaaaagttacatacata

SEQ ID NO: 53351 - DNA, 20 bp, Artificial Sequence
  chemically synthesized
caaaagttacatacataagg

SEQ ID NO: 53352 - DNA, 20 bp, Artificial Sequence
  chemically synthesized
ctccctctcacacttctccc

SEQ ID NO: 53353 - DNA, 20 bp, Artificial Sequence
  chemically synthesized
cacacttctccccagccacc

SEQ ID NO: 53354 - DNA, 20 bp, Artificial Sequence
  chemically synthesized
agccacccagttctcccttc

SEQ ID NO: 53355 - DNA, 20 bp, Artificial Sequence
  chemically synthesized
ccacccagttctcccttcta

SEQ ID NO: 53356 - DNA, 20 bp, Artificial Sequence
  chemically synthesized
cacccagttctcccttctag

SEQ ID NO: 53357 - DNA, 20 bp, Artificial Sequence
  chemically synthesized
gcaacatgtgaaatccttct

SEQ ID NO: 53358 - DNA, 20 bp, Artificial Sequence
  chemically synthesized
caacatgtgaaatccttctc

SEQ ID NO: 53359 - DNA, 20 bp, Artificial Sequence
  chemically synthesized
ctcaggctacactcttcttg

SEQ ID NO: 53360 - DNA, 20 bp, Artificial Sequence
  chemically synthesized
tcaggctacactcttcttga

SEQ ID NO: 53361 - DNA, 20 bp, Artificial Sequence
  chemically synthesized
ctacactcttcttgaaggtg

SEQ ID NO: 53362 - DNA, 20 bp, Artificial Sequence
  chemically synthesized
tacactcttcttgaaggtgt

SEQ ID NO: 53363 - DNA, 20 bp, Artificial Sequence
  chemically synthesized
cttcttgaaggtgtaggctt

SEQ ID NO: 53364 - DNA, 20 bp, Artificial Sequence
  chemically synthesized
ttcttgaaggtgtaggcttt

SEQ ID NO: 53365 - DNA, 20 bp, Artificial Sequence
  chemically synthesized
aaggtgtaggctttgggcaa

SEQ ID NO: 53366 - DNA, 20 bp, Artificial Sequence
  chemically synthesized
tttgggcaaaagcattcatt

SEQ ID NO: 53367 - DNA, 20 bp, Artificial Sequence
  chemically synthesized
aagcattcattcagtaaccc

SEQ ID NO: 53368 - DNA, 20 bp, Artificial Sequence
  chemically synthesized
aaacttgttctgtttttcca

SEQ ID NO: 53369 - DNA, 20 bp, Artificial Sequence
  chemically synthesized
aacttgttctgtttttccat

SEQ ID NO: 53370 - DNA, 20 bp, Artificial Sequence
  chemically synthesized
tttttccataggattctctt

SEQ ID NO: 53371 - DNA, 20 bp, Artificial Sequence
  chemically synthesized
tccataggattctctttgga

SEQ ID NO: 53372 - DNA, 20 bp, Artificial Sequence
  chemically synthesized
tctttggacagcgtccatac

SEQ ID NO: 53373 - DNA, 20 bp, Artificial Sequence
  chemically synthesized
ttggacagcgtccatactgg

SEQ ID NO: 53374 - DNA, 20 bp, Artificial Sequence
  chemically synthesized
tggacagcgtccatactggt

SEQ ID NO: 53375 - DNA, 20 bp, Artificial Sequence
  chemically synthesized
gcgtccatactggtgggttt

SEQ ID NO: 53376 - DNA, 20 bp, Artificial Sequence
  chemically synthesized
gttttggatactgactacta

SEQ ID NO: 53377 - DNA, 20 bp, Artificial Sequence
  chemically synthesized
acacttccgtgcccctgata

SEQ ID NO: 53378 - DNA, 20 bp, Artificial Sequence
  chemically synthesized
cttccgtgcccctgataaag

SEQ ID NO: 53379 - DNA, 20 bp, Artificial Sequence
  chemically synthesized
agcagttccctgtaacctgt

SEQ ID NO: 53380 - DNA, 20 bp, Artificial Sequence
  chemically synthesized
ttccctgtaacctgtgagac

SEQ ID NO: 53381 - DNA, 20 bp, Artificial Sequence
  chemically synthesized
tgtaacctgtgagactggac

SEQ ID NO: 53382 - DNA, 20 bp, Artificial Sequence
  chemically synthesized
gtaacctgtgagactggacc

SEQ ID NO: 53383 - DNA, 20 bp, Artificial Sequence
  chemically synthesized
cctgtgagactggaccaggt

SEQ ID NO: 53384 - DNA, 20 bp, Artificial Sequence
  chemically synthesized
actggaccaggtaagcgtcc

SEQ ID NO: 53385 - DNA, 20 bp, Artificial Sequence
  chemically synthesized
ggtaagcgtcccagcccctg

SEQ ID NO: 53386 - DNA, 20 bp, Artificial Sequence
  chemically synthesized
agcgtcccagcccctgcaga

SEQ ID NO: 53387 - DNA, 20 bp, Artificial Sequence
  chemically synthesized
gtcccagcccctgcagacag

SEQ ID NO: 53388 - DNA, 20 bp, Artificial Sequence
  chemically synthesized
agcccctgcagacagaagct

SEQ ID NO: 53389 - DNA, 20 bp, Artificial Sequence
  chemically synthesized
ccctgcagacagaagctgag

SEQ ID NO: 53390 - DNA, 20 bp, Artificial Sequence
  chemically synthesized
tggacctcgtttacctgtta

SEQ ID NO: 53391 - DNA, 20 bp, Artificial Sequence
  chemically synthesized
ttatggatgaaactgacctt

SEQ ID NO: 53392 - DNA, 20 bp, Artificial Sequence
  chemically synthesized
tatggatgaaactgaccttg

SEQ ID NO: 53393 - DNA, 20 bp, Artificial Sequence
  chemically synthesized
atggatgaaactgaccttga

SEQ ID NO: 53394 - DNA, 20 bp, Artificial Sequence
  chemically synthesized
tggatgaaactgaccttgag

SEQ ID NO: 53395 - DNA, 20 bp, Artificial Sequence
  chemically synthesized
aactgaccttgaggggacat

SEQ ID NO: 53396 - DNA, 20 bp, Artificial Sequence
  chemically synthesized
actgaccttgaggggacatg

SEQ ID NO: 53397 - DNA, 20 bp, Artificial Sequence
  chemically synthesized
tgaccttgaggggacatgag

SEQ ID NO: 53398 - DNA, 20 bp, Artificial Sequence
  chemically synthesized
accttgaggggacatgagga

SEQ ID NO: 53399 - DNA, 20 bp, Artificial Sequence
  chemically synthesized
cttttgtcatgctcttcaat

SEQ ID NO: 53400 - DNA, 20 bp, Artificial Sequence
  chemically synthesized
ttctgcaatactttcctgaa

SEQ ID NO: 53401 - DNA, 20 bp, Artificial Sequence
  chemically synthesized
caatactttcctgaatagca

SEQ ID NO: 53402 - DNA, 20 bp, Artificial Sequence
  chemically synthesized
tactttcctgaatagcacag

SEQ ID NO: 53403 - DNA, 20 bp, Artificial Sequence
  chemically synthesized
cctgaatagcacagtagtat

SEQ ID NO: 53404 - DNA, 20 bp, Artificial Sequence
  chemically synthesized
tattggaaatctgcctatta

SEQ ID NO: 53405 - DNA, 20 bp, Artificial Sequence
  chemically synthesized
aatctgcctattacagaacc

SEQ ID NO: 53406 - DNA, 20 bp, Artificial Sequence
  chemically synthesized
tgcctattacagaacctgga

SEQ ID NO: 53407 - DNA, 20 bp, Artificial Sequence
  chemically synthesized
cctattacagaacctggatg

SEQ ID NO: 53408 - DNA, 20 bp, Artificial Sequence
  chemically synthesized
tacagaacctggatggagtc

SEQ ID NO: 53409 - DNA, 20 bp, Artificial Sequence
  chemically synthesized
cagaacctggatggagtcca

SEQ ID NO: 53410 - DNA, 20 bp, Artificial Sequence
  chemically synthesized
gaacctggatggagtccaga

SEQ ID NO: 53411 - DNA, 20 bp, Artificial Sequence
  chemically synthesized
aacctggatggagtccagag

SEQ ID NO: 53412 - DNA, 20 bp, Artificial Sequence
  chemically synthesized
ggatggagtccagagaggca

SEQ ID NO: 53413 - DNA, 20 bp, Artificial Sequence
  chemically synthesized
gatggagtccagagaggcac

SEQ ID NO: 53414 - DNA, 20 bp, Artificial Sequence
  chemically synthesized
cagagaggcacgggcatcca

SEQ ID NO: 53415 - DNA, 20 bp, Artificial Sequence
  chemically synthesized
agagaggcacgggcatccat

SEQ ID NO: 53416 - DNA, 20 bp, Artificial Sequence
  chemically synthesized
ggcacgggcatccatgggca

SEQ ID NO: 53417 - DNA, 20 bp, Artificial Sequence
  chemically synthesized
gcacgggcatccatgggcaa

SEQ ID NO: 53418 - DNA, 20 bp, Artificial Sequence
  chemically synthesized
cacgggcatccatgggcaaa

SEQ ID NO: 53419 - DNA, 20 bp, Artificial Sequence
  chemically synthesized
tccatgggcaaagggctcgt

SEQ ID NO: 53420 - DNA, 20 bp, Artificial Sequence
  chemically synthesized
catgggcaaagggctcgtga

SEQ ID NO: 53421 - DNA, 20 bp, Artificial Sequence
  chemically synthesized
tcgtgagagtcaccgccctg

SEQ ID NO: 53422 - DNA, 20 bp, Artificial Sequence
  chemically synthesized
gccctgcagcgctgtgtcct

SEQ ID NO: 53423 - DNA, 20 bp, Artificial Sequence
  chemically synthesized
tgcagcgctgtgtcctgaga

SEQ ID NO: 53424 - DNA, 20 bp, Artificial Sequence
  chemically synthesized
gcagcgctgtgtcctgagaa

SEQ ID NO: 53425 - DNA, 20 bp, Artificial Sequence
  chemically synthesized
agcgctgtgtcctgagaaag

SEQ ID NO: 53426 - DNA, 20 bp, Artificial Sequence
  chemically synthesized
gcgctgtgtcctgagaaagg

SEQ ID NO: 53427 - DNA, 20 bp, Artificial Sequence
  chemically synthesized
cgctgtgtcctgagaaagga

SEQ ID NO: 53428 - DNA, 20 bp, Artificial Sequence
  chemically synthesized
gctgtgtcctgagaaaggag

SEQ ID NO: 53429 - DNA, 20 bp, Artificial Sequence
  chemically synthesized
ctgtgtcctgagaaaggagg

SEQ ID NO: 53430 - DNA, 20 bp, Artificial Sequence
  chemically synthesized
tgtcctgagaaaggaggggg

SEQ ID NO: 53431 - DNA, 20 bp, Artificial Sequence
  chemically synthesized
cctgagaaaggagggggcag

SEQ ID NO: 53432 - DNA, 20 bp, Artificial Sequence
  chemically synthesized
aaaggagggggcagaagcct

SEQ ID NO: 53433 - DNA, 20 bp, Artificial Sequence
  chemically synthesized
ggggcagaagcctgagcttc

SEQ ID NO: 53434 - DNA, 20 bp, Artificial Sequence
  chemically synthesized
gggcagaagcctgagcttct

SEQ ID NO: 53435 - DNA, 20 bp, Artificial Sequence
  chemically synthesized
ggcagaagcctgagcttctg

SEQ ID NO: 53436 - DNA, 20 bp, Artificial Sequence
  chemically synthesized
gcagaagcctgagcttctgg

SEQ ID NO: 53437 - DNA, 20 bp, Artificial Sequence
  chemically synthesized
cttctgggggtccttcccaa

SEQ ID NO: 53438 - DNA, 20 bp, Artificial Sequence
  chemically synthesized
gggggtccttcccaatggcc

SEQ ID NO: 53439 - DNA, 20 bp, Artificial Sequence
  chemically synthesized
ttcccaatggcctggcccac

SEQ ID NO: 53440 - DNA, 20 bp, Artificial Sequence
  chemically synthesized
cccactggatgtgccctcct

SEQ ID NO: 53441 - DNA, 20 bp, Artificial Sequence
  chemically synthesized
tctctgtgcctacgttttat

SEQ ID NO: 53442 - DNA, 20 bp, Artificial Sequence
  chemically synthesized
tgcctacgttttattagtta

SEQ ID NO: 53443 - DNA, 20 bp, Artificial Sequence
  chemically synthesized
tacgttttattagttacagc

SEQ ID NO: 53444 - DNA, 20 bp, Artificial Sequence
  chemically synthesized
ttttattagttacagccaga

SEQ ID NO: 53445 - DNA, 20 bp, Artificial Sequence
  chemically synthesized
gttactgtcaaatcaaatga

SEQ ID NO: 53446 - DNA, 20 bp, Artificial Sequence
  chemically synthesized
caaatgatagatttcatttt

SEQ ID NO: 53447 - DNA, 20 bp, Artificial Sequence
  chemically synthesized
atttcattttcagtatgtaa

SEQ ID NO: 53448 - DNA, 20 bp, Artificial Sequence
  chemically synthesized
tttcattttcagtatgtaat

SEQ ID NO: 53449 - DNA, 20 bp, Artificial Sequence
  chemically synthesized
cattttcagtatgtaatagg

SEQ ID NO: 53450 - DNA, 20 bp, Artificial Sequence
  chemically synthesized
gaagcccctccctcacccta

SEQ ID NO: 53451 - DNA, 20 bp, Artificial Sequence
  chemically synthesized
cctccctcaccctaaagtct

SEQ ID NO: 53452 - DNA, 20 bp, Artificial Sequence
  chemically synthesized
taaagtctcagctgccctct

SEQ ID NO: 53453 - DNA, 20 bp, Artificial Sequence
  chemically synthesized
tctcagctgccctctaagac

SEQ ID NO: 53454 - DNA, 20 bp, Artificial Sequence
  chemically synthesized
ctctaagactagtactctct

SEQ ID NO: 53455 - DNA, 20 bp, Artificial Sequence
  chemically synthesized
tctaagactagtactctcta

SEQ ID NO: 53456 - DNA, 20 bp, Artificial Sequence
  chemically synthesized
actagtactctctaaggtac

SEQ ID NO: 53457 - DNA, 20 bp, Artificial Sequence
  chemically synthesized
aggtactagtatcccttcct

SEQ ID NO: 53458 - DNA, 20 bp, Artificial Sequence
  chemically synthesized
gtactagtatcccttcctca

SEQ ID NO: 53459 - DNA, 20 bp, Artificial Sequence
  chemically synthesized
cctttccctgaccccaaaac

SEQ ID NO: 53460 - DNA, 20 bp, Artificial Sequence
  chemically synthesized
ctttccctgaccccaaaact

SEQ ID NO: 53461 - DNA, 20 bp, Artificial Sequence
  chemically synthesized
tttccctgaccccaaaacta

SEQ ID NO: 53462 - DNA, 20 bp, Artificial Sequence
  chemically synthesized
ccctgaccccaaaactaggg

SEQ ID NO: 53463 - DNA, 20 bp, Artificial Sequence
  chemically synthesized
cctgaccccaaaactaggga

SEQ ID NO: 53464 - DNA, 20 bp, Artificial Sequence
  chemically synthesized
caaaactagggaaggtccct

SEQ ID NO: 53465 - DNA, 20 bp, Artificial Sequence
  chemically synthesized
cccttagttatttgctctca

SEQ ID NO: 53466 - DNA, 20 bp, Artificial Sequence
  chemically synthesized
cacagaccacgcatttacct

SEQ ID NO: 53467 - DNA, 20 bp, Artificial Sequence
  chemically synthesized
cagaccacgcatttacctca

SEQ ID NO: 53468 - DNA, 20 bp, Artificial Sequence
  chemically synthesized
tcagagcatattcactcatt

SEQ ID NO: 53469 - DNA, 20 bp, Artificial Sequence
  chemically synthesized
tcattcagctgttacttacc

SEQ ID NO: 53470 - DNA, 20 bp, Artificial Sequence
  chemically synthesized
gttacttaccaagcacctac

SEQ ID NO: 53471 - DNA, 20 bp, Artificial Sequence
  chemically synthesized
ttacttaccaagcacctact

SEQ ID NO: 53472 - DNA, 20 bp, Artificial Sequence
  chemically synthesized
acttaccaagcacctactgg

SEQ ID NO: 53473 - DNA, 20 bp, Artificial Sequence
  chemically synthesized
ctatacactgttctatgtgc

SEQ ID NO: 53474 - DNA, 20 bp, Artificial Sequence
  chemically synthesized
tatacactgttctatgtgct

SEQ ID NO: 53475 - DNA, 20 bp, Artificial Sequence
  chemically synthesized
atacactgttctatgtgcta

SEQ ID NO: 53476 - DNA, 20 bp, Artificial Sequence
  chemically synthesized
tgtgctagggatacctctgt

SEQ ID NO: 53477 - DNA, 20 bp, Artificial Sequence
  chemically synthesized
acctctgtcagtgaacaaca

SEQ ID NO: 53478 - DNA, 20 bp, Artificial Sequence
  chemically synthesized
cagtgaacaacacagacaca

SEQ ID NO: 53479 - DNA, 20 bp, Artificial Sequence
  chemically synthesized
cacaaagatccctgcccttg

SEQ ID NO: 53480 - DNA, 20 bp, Artificial Sequence
  chemically synthesized
caaagatccctgcccttgtg

SEQ ID NO: 53481 - DNA, 20 bp, Artificial Sequence
  chemically synthesized
ttgtggagctgaaatctgaa

SEQ ID NO: 53482 - DNA, 20 bp, Artificial Sequence
  chemically synthesized
gtggagctgaaatctgaata

SEQ ID NO: 53483 - DNA, 20 bp, Artificial Sequence
  chemically synthesized
tggagctgaaatctgaatag

SEQ ID NO: 53484 - DNA, 20 bp, Artificial Sequence
  chemically synthesized
gagctgaaatctgaatagag

SEQ ID NO: 53485 - DNA, 20 bp, Artificial Sequence
  chemically synthesized
agctgaaatctgaatagagg

SEQ ID NO: 53486 - DNA, 20 bp, Artificial Sequence
  chemically synthesized
atacaaaaattataataaat

SEQ ID NO: 53487 - DNA, 20 bp, Artificial Sequence
  chemically synthesized
attataataaataagtaaac

SEQ ID NO: 53488 - DNA, 20 bp, Artificial Sequence
  chemically synthesized
ttataataaataagtaaact

SEQ ID NO: 53489 - DNA, 20 bp, Artificial Sequence
  chemically synthesized
aataaataagtaaactaggc

SEQ ID NO: 53490 - DNA, 20 bp, Artificial Sequence
  chemically synthesized
taagtaaactaggccagttg

SEQ ID NO: 53491 - DNA, 20 bp, Artificial Sequence
  chemically synthesized
gttgctcatgcctgtaatcc

SEQ ID NO: 53492 - DNA, 20 bp, Artificial Sequence
  chemically synthesized
tgcctgtaatcccagcactt

SEQ ID NO: 53493 - DNA, 20 bp, Artificial Sequence
  chemically synthesized
gcctgtaatcccagcacttt

SEQ ID NO: 53494 - DNA, 20 bp, Artificial Sequence
  chemically synthesized
tgtaatcccagcactttggg

SEQ ID NO: 53495 - DNA, 20 bp, Artificial Sequence
  chemically synthesized
tcccagcactttgggaagcc

SEQ ID NO: 53496 - DNA, 20 bp, Artificial Sequence
  chemically synthesized
cccagcactttgggaagcca

SEQ ID NO: 53497 - DNA, 20 bp, Artificial Sequence
  chemically synthesized
agcactttgggaagccaagg

SEQ ID NO: 53498 - DNA, 20 bp, Artificial Sequence
  chemically synthesized
gcactttgggaagccaaggt

SEQ ID NO: 53499 - DNA, 20 bp, Artificial Sequence
  chemically synthesized
ctttgggaagccaaggtagg

SEQ ID NO: 53500 - DNA, 20 bp, Artificial Sequence
  chemically synthesized
ccaaggtaggtagatcacct

SEQ ID NO: 53501 - DNA, 20 bp, Artificial Sequence
  chemically synthesized
caaggtaggtagatcacctg

SEQ ID NO: 53502 - DNA, 20 bp, Artificial Sequence
  chemically synthesized
gtaggtagatcacctgaggt

SEQ ID NO: 53503 - DNA, 20 bp, Artificial Sequence
  chemically synthesized
taggtagatcacctgaggtc

SEQ ID NO: 53504 - DNA, 20 bp, Artificial Sequence
  chemically synthesized
ggtagatcacctgaggtcag

SEQ ID NO: 53505 - DNA, 20 bp, Artificial Sequence
  chemically synthesized
tgaggtcaggagttcaaaac

SEQ ID NO: 53506 - DNA, 20 bp, Artificial Sequence
  chemically synthesized
tcaggagttcaaaaccagcc

SEQ ID NO: 53507 - DNA, 20 bp, Artificial Sequence
  chemically synthesized
aatcctgtctttactaaaaa

SEQ ID NO: 53508 - DNA, 20 bp, Artificial Sequence
  chemically synthesized
tttactaaaaatggaaaaat

SEQ ID NO: 53509 - DNA, 20 bp, Artificial Sequence
  chemically synthesized
ctaaaaatggaaaaattggt

SEQ ID NO: 53510 - DNA, 20 bp, Artificial Sequence
  chemically synthesized
taaaaatggaaaaattggtc

SEQ ID NO: 53511 - DNA, 20 bp, Artificial Sequence
  chemically synthesized
gaaaaattggtcaggcgtga

SEQ ID NO: 53512 - DNA, 20 bp, Artificial Sequence
  chemically synthesized
ggcgtgatggcacacgcctg

SEQ ID NO: 53513 - DNA, 20 bp, Artificial Sequence
  chemically synthesized
atggcacacgcctgtagtct

SEQ ID NO: 53514 - DNA, 20 bp, Artificial Sequence
  chemically synthesized
cgcctgtagtctcagctacc

SEQ ID NO: 53515 - DNA, 20 bp, Artificial Sequence
  chemically synthesized
gcctgtagtctcagctacct

SEQ ID NO: 53516 - DNA, 20 bp, Artificial Sequence
  chemically synthesized
ctgtagtctcagctacctgg

SEQ ID NO: 53517 - DNA, 20 bp, Artificial Sequence
  chemically synthesized
tgtagtctcagctacctggg

SEQ ID NO: 53518 - DNA, 20 bp, Artificial Sequence
  chemically synthesized
tctcagctacctgggaggct

SEQ ID NO: 53519 - DNA, 20 bp, Artificial Sequence
  chemically synthesized
ctcagctacctgggaggctg

SEQ ID NO: 53520 - DNA, 20 bp, Artificial Sequence
  chemically synthesized
agctacctgggaggctgagg

SEQ ID NO: 53521 - DNA, 20 bp, Artificial Sequence
  chemically synthesized
gctacctgggaggctgaggc

SEQ ID NO: 53522 - DNA, 20 bp, Artificial Sequence
  chemically synthesized
tacctgggaggctgaggcag

SEQ ID NO: 53523 - DNA, 20 bp, Artificial Sequence
  chemically synthesized
gcaggagaatcgcttgaacc

SEQ ID NO: 53524 - DNA, 20 bp, Artificial Sequence
  chemically synthesized
caggagaatcgcttgaacct

SEQ ID NO: 53525 - DNA, 20 bp, Artificial Sequence
  chemically synthesized
ggagaatcgcttgaacctgg

SEQ ID NO: 53526 - DNA, 20 bp, Artificial Sequence
  chemically synthesized
gagaatcgcttgaacctggg

SEQ ID NO: 53527 - DNA, 20 bp, Artificial Sequence
  chemically synthesized
aatcgcttgaacctgggagg

SEQ ID NO: 53528 - DNA, 20 bp, Artificial Sequence
  chemically synthesized
tcgcttgaacctgggaggca

SEQ ID NO: 53529 - DNA, 20 bp, Artificial Sequence
  chemically synthesized
cgcttgaacctgggaggcag

SEQ ID NO: 53530 - DNA, 20 bp, Artificial Sequence
  chemically synthesized
aacctgggaggcagaggttg

SEQ ID NO: 53531 - DNA, 20 bp, Artificial Sequence
  chemically synthesized
ggcagaggttgcagtgaacc

SEQ ID NO: 53532 - DNA, 20 bp, Artificial Sequence
  chemically synthesized
aggttgcagtgaaccgagat

SEQ ID NO: 53533 - DNA, 20 bp, Artificial Sequence
  chemically synthesized
gagatcggaccactgcactc

SEQ ID NO: 53534 - DNA, 20 bp, Artificial Sequence
  chemically synthesized
ctgcactccagcctgaatga

SEQ ID NO: 53535 - DNA, 20 bp, Artificial Sequence
  chemically synthesized
tccagcctgaatgacagaac

SEQ ID NO: 53536 - DNA, 20 bp, Artificial Sequence
  chemically synthesized
gagactctgtctcaaaaaaa

SEQ ID NO: 53537 - DNA, 20 bp, Artificial Sequence
  chemically synthesized
aaaagtaaactattaatatg

SEQ ID NO: 53538 - DNA, 20 bp, Artificial Sequence
  chemically synthesized
aaagtaaactattaatatgt

SEQ ID NO: 53539 - DNA, 20 bp, Artificial Sequence
  chemically synthesized
taaactattaatatgtagga

SEQ ID NO: 53540 - DNA, 20 bp, Artificial Sequence
  chemically synthesized
aaactattaatatgtaggat

SEQ ID NO: 53541 - DNA, 20 bp, Artificial Sequence
  chemically synthesized
tattaatatgtaggataggc

SEQ ID NO: 53542 - DNA, 20 bp, Artificial Sequence
  chemically synthesized
attaatatgtaggataggcc

SEQ ID NO: 53543 - DNA, 20 bp, Artificial Sequence
  chemically synthesized
tatgtaggataggccaggca

SEQ ID NO: 53544 - DNA, 20 bp, Artificial Sequence
  chemically synthesized
gtaggataggccaggcacgg

SEQ ID NO: 53545 - DNA, 20 bp, Artificial Sequence
  chemically synthesized
ggtggctcaccctgtaatcc

SEQ ID NO: 53546 - DNA, 20 bp, Artificial Sequence
  chemically synthesized
accctgtaatcccagcactt

SEQ ID NO: 53547 - DNA, 20 bp, Artificial Sequence
  chemically synthesized
ccctgtaatcccagcacttt

SEQ ID NO: 53548 - DNA, 20 bp, Artificial Sequence
  chemically synthesized
ctgtaatcccagcactttgg

SEQ ID NO: 53549 - DNA, 20 bp, Artificial Sequence
  chemically synthesized
tgtaatcccagcactttggg

SEQ ID NO: 53550 - DNA, 20 bp, Artificial Sequence
  chemically synthesized
tcccagcactttgggaggct

SEQ ID NO: 53551 - DNA, 20 bp, Artificial Sequence
  chemically synthesized
cccagcactttgggaggctg

SEQ ID NO: 53552 - DNA, 20 bp, Artificial Sequence
  chemically synthesized
agcactttgggaggctgagg

SEQ ID NO: 53553 - DNA, 20 bp, Artificial Sequence
  chemically synthesized
gcactttgggaggctgaggc

SEQ ID NO: 53554 - DNA, 20 bp, Artificial Sequence
  chemically synthesized
ctttgggaggctgaggcggg

SEQ ID NO: 53555 - DNA, 20 bp, Artificial Sequence
  chemically synthesized
ctgaggcgggtggatcacct

SEQ ID NO: 53556 - DNA, 20 bp, Artificial Sequence
  chemically synthesized
tgaggcgggtggatcacctg

SEQ ID NO: 53557 - DNA, 20 bp, Artificial Sequence
  chemically synthesized
gcgggtggatcacctgaggt

SEQ ID NO: 53558 - DNA, 20 bp, Artificial Sequence
  chemically synthesized
cgggtggatcacctgaggtg

SEQ ID NO: 53559 - DNA, 20 bp, Artificial Sequence
  chemically synthesized
ggtggatcacctgaggtgag

SEQ ID NO: 53560 - DNA, 20 bp, Artificial Sequence
  chemically synthesized
tcacctgaggtgaggagttc

SEQ ID NO: 53561 - DNA, 20 bp, Artificial Sequence
  chemically synthesized
tgaggtgaggagttcaagac

SEQ ID NO: 53562 - DNA, 20 bp, Artificial Sequence
  chemically synthesized
tgaggagttcaagaccagcc

SEQ ID NO: 53563 - DNA, 20 bp, Artificial Sequence
  chemically synthesized
caagaccagcctggccaaca

SEQ ID NO: 53564 - DNA, 20 bp, Artificial Sequence
  chemically synthesized
tctactaaaaatacaaaaat

SEQ ID NO: 53565 - DNA, 20 bp, Artificial Sequence
  chemically synthesized
ctaaaaatacaaaaattagc

SEQ ID NO: 53566 - DNA, 20 bp, Artificial Sequence
  chemically synthesized
taaaaatacaaaaattagct

SEQ ID NO: 53567 - DNA, 20 bp, Artificial Sequence
  chemically synthesized
caaaaattagctgggtgtcc

SEQ ID NO: 53568 - DNA, 20 bp, Artificial Sequence
  chemically synthesized
ctggtgcatgcctgtaatct

SEQ ID NO: 53569 - DNA, 20 bp, Artificial Sequence
  chemically synthesized
tgcctgtaatctgagctact

SEQ ID NO: 53570 - DNA, 20 bp, Artificial Sequence
  chemically synthesized
gcctgtaatctgagctactc

SEQ ID NO: 53571 - DNA, 20 bp, Artificial Sequence
  chemically synthesized
ctgtaatctgagctactcag

SEQ ID NO: 53572 - DNA, 20 bp, Artificial Sequence
  chemically synthesized
tgtaatctgagctactcagg

SEQ ID NO: 53573 - DNA, 20 bp, Artificial Sequence
  chemically synthesized
tctgagctactcaggaggct

SEQ ID NO: 53574 - DNA, 20 bp, Artificial Sequence
  chemically synthesized
ctgagctactcaggaggcta

SEQ ID NO: 53575 - DNA, 20 bp, Artificial Sequence
  chemically synthesized
agctactcaggaggctaagg

SEQ ID NO: 53576 - DNA, 20 bp, Artificial Sequence
  chemically synthesized
gctactcaggaggctaaggc

SEQ ID NO: 53577 - DNA, 20 bp, Artificial Sequence
  chemically synthesized
tactcaggaggctaaggcag

SEQ ID NO: 53578 - DNA, 20 bp, Artificial Sequence
  chemically synthesized
gcaggagaatcgcttgaacc

SEQ ID NO: 53579 - DNA, 20 bp, Artificial Sequence
  chemically synthesized
caggagaatcgcttgaacct

SEQ ID NO: 53580 - DNA, 20 bp, Artificial Sequence
  chemically synthesized
ggagaatcgcttgaacctgg

SEQ ID NO: 53581 - DNA, 20 bp, Artificial Sequence
  chemically synthesized
gagaatcgcttgaacctggg

SEQ ID NO: 53582 - DNA, 20 bp, Artificial Sequence
  chemically synthesized
aatcgcttgaacctgggagg

SEQ ID NO: 53583 - DNA, 20 bp, Artificial Sequence
  chemically synthesized
gcttgaacctgggaggtggt

SEQ ID NO: 53584 - DNA, 20 bp, Artificial Sequence
  chemically synthesized
aacctgggaggtggtgagcc

SEQ ID NO: 53585 - DNA, 20 bp, Artificial Sequence
  chemically synthesized
aagattgcgccattgcactc

SEQ ID NO: 53586 - DNA, 20 bp, Artificial Sequence
  chemically synthesized
tgcgccattgcactccagcc

SEQ ID NO: 53587 - DNA, 20 bp, Artificial Sequence
  chemically synthesized
gcgccattgcactccagcct

SEQ ID NO: 53588 - DNA, 20 bp, Artificial Sequence
  chemically synthesized
tccagcctgggcgacaaaat

SEQ ID NO: 53589 - DNA, 20 bp, Artificial Sequence
  chemically synthesized
cacacacacacatataatac

SEQ ID NO: 53590 - DNA, 20 bp, Artificial Sequence
  chemically synthesized
tactagaaaatgattgttta

SEQ ID NO: 53591 - DNA, 20 bp, Artificial Sequence
  chemically synthesized
actagaaaatgattgtttat

SEQ ID NO: 53592 - DNA, 20 bp, Artificial Sequence
  chemically synthesized
tataggcaaaaaaaaaaaaa

SEQ ID NO: 53593 - DNA, 20 bp, Artificial Sequence
  chemically synthesized
aggcaaaaaaaaaaaaaaag

SEQ ID NO: 53594 - DNA, 20 bp, Artificial Sequence
  chemically synthesized
caaaaaaaaaaaaaaagaag

SEQ ID NO: 53595 - DNA, 20 bp, Artificial Sequence
  chemically synthesized
aaaaaaaaaaaaagaagaag

SEQ ID NO: 53596 - DNA, 20 bp, Artificial Sequence
  chemically synthesized
aaaaaaaaaagaagaagaag

SEQ ID NO: 53597 - DNA, 20 bp, Artificial Sequence
  chemically synthesized
aaaaagaagaagaagaagaa

SEQ ID NO: 53598 - DNA, 20 bp, Artificial Sequence
  chemically synthesized
aaaagaagaagaagaagaaa

SEQ ID NO: 53599 - DNA, 20 bp, Artificial Sequence
  chemically synthesized
gaagaagaagaagaaaagga

SEQ ID NO: 53600 - DNA, 20 bp, Artificial Sequence
  chemically synthesized
aagaagaagaagaaaaggaa

SEQ ID NO: 53601 - DNA, 20 bp, Artificial Sequence
  chemically synthesized
gaagaagaagaaaaggaaag

SEQ ID NO: 53602 - DNA, 20 bp, Artificial Sequence
  chemically synthesized
gaagaagaaaaggaaaggag

SEQ ID NO: 53603 - DNA, 20 bp, Artificial Sequence
  chemically synthesized
aagaagaaaaggaaaggaga

SEQ ID NO: 53604 - DNA, 20 bp, Artificial Sequence
  chemically synthesized
agaaaaggaaaggagaagga

SEQ ID NO: 53605 - DNA, 20 bp, Artificial Sequence
  chemically synthesized
aaaggaaaggagaaggaaag

SEQ ID NO: 53606 - DNA, 20 bp, Artificial Sequence
  chemically synthesized
aaggaaaggagaaggaaaga

SEQ ID NO: 53607 - DNA, 20 bp, Artificial Sequence
  chemically synthesized
gaaggaccaaacatcttttg

SEQ ID NO: 53608 - DNA, 20 bp, Artificial Sequence
  chemically synthesized
tatgtttgctttcatcataa

SEQ ID NO: 53609 - DNA, 20 bp, Artificial Sequence
  chemically synthesized
catcataacagcttgttatc

SEQ ID NO: 53610 - DNA, 20 bp, Artificial Sequence
  chemically synthesized
atcataacagcttgttatca

SEQ ID NO: 53611 - DNA, 20 bp, Artificial Sequence
  chemically synthesized
gaatttctccctgaaattaa

SEQ ID NO: 53612 - DNA, 20 bp, Artificial Sequence
  chemically synthesized
atttctccctgaaattaatg

SEQ ID NO: 53613 - DNA, 20 bp, Artificial Sequence
  chemically synthesized
tttctccctgaaattaatgg

SEQ ID NO: 53614 - DNA, 20 bp, Artificial Sequence
  chemically synthesized
ccctgaaattaatggaggca

SEQ ID NO: 53615 - DNA, 20 bp, Artificial Sequence
  chemically synthesized
aaattaatggaggcacagac

SEQ ID NO: 53616 - DNA, 20 bp, Artificial Sequence
  chemically synthesized
taatggaggcacagactgga

SEQ ID NO: 53617 - DNA, 20 bp, Artificial Sequence
  chemically synthesized
ggcacagactggaaagttta

SEQ ID NO: 53618 - DNA, 20 bp, Artificial Sequence
  chemically synthesized
acagactggaaagtttaaag

SEQ ID NO: 53619 - DNA, 20 bp, Artificial Sequence
  chemically synthesized
ggaaagtttaaagtggcttt

SEQ ID NO: 53620 - DNA, 20 bp, Artificial Sequence
  chemically synthesized
aaagtttaaagtggctttaa

SEQ ID NO: 53621 - DNA, 20 bp, Artificial Sequence
  chemically synthesized
aagtttaaagtggctttaag

SEQ ID NO: 53622 - DNA, 20 bp, Artificial Sequence
  chemically synthesized
ctttaagaggttattttatt

SEQ ID NO: 53623 - DNA, 20 bp, Artificial Sequence
  chemically synthesized
tatttagtcctctgtcttaa

SEQ ID NO: 53624 - DNA, 20 bp, Artificial Sequence
  chemically synthesized
ttagtcctctgtcttaatag

SEQ ID NO: 53625 - DNA, 20 bp, Artificial Sequence
  chemically synthesized
aaattattatctctgctcct

SEQ ID NO: 53626 - DNA, 20 bp, Artificial Sequence
  chemically synthesized
aattattatctctgctcctt

SEQ ID NO: 53627 - DNA, 20 bp, Artificial Sequence
  chemically synthesized
tattatctctgctccttagg

SEQ ID NO: 53628 - DNA, 20 bp, Artificial Sequence
  chemically synthesized
ttatctctgctccttaggta

SEQ ID NO: 53629 - DNA, 20 bp, Artificial Sequence
  chemically synthesized
tctctgctccttaggtagag

SEQ ID NO: 53630 - DNA, 20 bp, Artificial Sequence
  chemically synthesized
gctccttaggtagagtagct

SEQ ID NO: 53631 - DNA, 20 bp, Artificial Sequence
  chemically synthesized
ctccttaggtagagtagcta

SEQ ID NO: 53632 - DNA, 20 bp, Artificial Sequence
  chemically synthesized
taggtagagtagctaaggct

SEQ ID NO: 53633 - DNA, 20 bp, Artificial Sequence
  chemically synthesized
tagagtagctaaggctcaga

SEQ ID NO: 53634 - DNA, 20 bp, Artificial Sequence
  chemically synthesized
agtagctaaggctcagaaag

SEQ ID NO: 53635 - DNA, 20 bp, Artificial Sequence
  chemically synthesized
gtagctaaggctcagaaagt

SEQ ID NO: 53636 - DNA, 20 bp, Artificial Sequence
  chemically synthesized
ctaaggctcagaaagtaggc

SEQ ID NO: 53637 - DNA, 20 bp, Artificial Sequence
  chemically synthesized
taaggctcagaaagtaggcc

SEQ ID NO: 53638 - DNA, 20 bp, Artificial Sequence
  chemically synthesized
ctcagaaagtaggccgggcg

SEQ ID NO: 53639 - DNA, 20 bp, Artificial Sequence
  chemically synthesized
agaaagtaggccgggcgcgg

SEQ ID NO: 53640 - DNA, 20 bp, Artificial Sequence
  chemically synthesized
gtggctcacgcctgtaatcc

SEQ ID NO: 53641 - DNA, 20 bp, Artificial Sequence
  chemically synthesized
cgcctgtaatcctagcactt

SEQ ID NO: 53642 - DNA, 20 bp, Artificial Sequence
  chemically synthesized
gcctgtaatcctagcacttt

SEQ ID NO: 53643 - DNA, 20 bp, Artificial Sequence
  chemically synthesized
ctgtaatcctagcactttgg

SEQ ID NO: 53644 - DNA, 20 bp, Artificial Sequence
  chemically synthesized
tgtaatcctagcactttggg

SEQ ID NO: 53645 - DNA, 20 bp, Artificial Sequence
  chemically synthesized
agcactttgggaggccaacg

SEQ ID NO: 53646 - DNA, 20 bp, Artificial Sequence
  chemically synthesized
gcactttgggaggccaacgc

SEQ ID NO: 53647 - DNA, 20 bp, Artificial Sequence
  chemically synthesized
ctttgggaggccaacgcagg

SEQ ID NO: 53648 - DNA, 20 bp, Artificial Sequence
  chemically synthesized
ccaacgcaggtggatcacct

SEQ ID NO: 53649 - DNA, 20 bp, Artificial Sequence
  chemically synthesized
caacgcaggtggatcacctg

SEQ ID NO: 53650 - DNA, 20 bp, Artificial Sequence
  chemically synthesized
gcaggtggatcacctgaggt

SEQ ID NO: 53651 - DNA, 20 bp, Artificial Sequence
  chemically synthesized
caggtggatcacctgaggtc

SEQ ID NO: 53652 - DNA, 20 bp, Artificial Sequence
  chemically synthesized
ggtggatcacctgaggtcag

SEQ ID NO: 53653 - DNA, 20 bp, Artificial Sequence
  chemically synthesized
tcacctgaggtcaggagttt

SEQ ID NO: 53654 - DNA, 20 bp, Artificial Sequence
  chemically synthesized
tgaggtcaggagtttgagac

SEQ ID NO: 53655 - DNA, 20 bp, Artificial Sequence
  chemically synthesized
tcaggagtttgagaccagcc

SEQ ID NO: 53656 - DNA, 20 bp, Artificial Sequence
  chemically synthesized
tgagaccagcctggccaaca

SEQ ID NO: 53657 - DNA, 20 bp, Artificial Sequence
  chemically synthesized
aataaaaaaatacaaaaact

SEQ ID NO: 53658 - DNA, 20 bp, Artificial Sequence
  chemically synthesized
aaaaaatacaaaaacttagc

SEQ ID NO: 53659 - DNA, 20 bp, Artificial Sequence
  chemically synthesized
aaaaatacaaaaacttagcc

SEQ ID NO: 53660 - DNA, 20 bp, Artificial Sequence
  chemically synthesized
tacaaaaacttagccaggca

SEQ ID NO: 53661 - DNA, 20 bp, Artificial Sequence
  chemically synthesized
aaaaacttagccaggcatgg

SEQ ID NO: 53662 - DNA, 20 bp, Artificial Sequence
  chemically synthesized
aacttagccaggcatggtgg

SEQ ID NO: 53663 - DNA, 20 bp, Artificial Sequence
  chemically synthesized
acttagccaggcatggtggc

SEQ ID NO: 53664 - DNA, 20 bp, Artificial Sequence
  chemically synthesized
gtggcgggcgcctgtaatcc

SEQ ID NO: 53665 - DNA, 20 bp, Artificial Sequence
  chemically synthesized
cgcctgtaatcccagctacc

SEQ ID NO: 53666 - DNA, 20 bp, Artificial Sequence
  chemically synthesized
gcctgtaatcccagctaccc

SEQ ID NO: 53667 - DNA, 20 bp, Artificial Sequence
  chemically synthesized
ctgtaatcccagctacccag

SEQ ID NO: 53668 - DNA, 20 bp, Artificial Sequence
  chemically synthesized
tgtaatcccagctacccagg

SEQ ID NO: 53669 - DNA, 20 bp, Artificial Sequence
  chemically synthesized
cccagctacccaggaggctg

SEQ ID NO: 53670 - DNA, 20 bp, Artificial Sequence
  chemically synthesized
agctacccaggaggctgcgg

SEQ ID NO: 53671 - DNA, 20 bp, Artificial Sequence
  chemically synthesized
gctacccaggaggctgcggc

SEQ ID NO: 53672 - DNA, 20 bp, Artificial Sequence
  chemically synthesized
tacccaggaggctgcggcag

SEQ ID NO: 53673 - DNA, 20 bp, Artificial Sequence
  chemically synthesized
gcaggagaatcacttcaacc

SEQ ID NO: 53674 - DNA, 20 bp, Artificial Sequence
  chemically synthesized
caggagaatcacttcaaccc

SEQ ID NO: 53675 - DNA, 20 bp, Artificial Sequence
  chemically synthesized
ggagaatcacttcaacccgg

SEQ ID NO: 53676 - DNA, 20 bp, Artificial Sequence
  chemically synthesized
gagaatcacttcaacccggg

SEQ ID NO: 53677 - DNA, 20 bp, Artificial Sequence
  chemically synthesized
aatcacttcaacccgggagg

SEQ ID NO: 53678 - DNA, 20 bp, Artificial Sequence
  chemically synthesized
tcacttcaacccgggaggca

SEQ ID NO: 53679 - DNA, 20 bp, Artificial Sequence
  chemically synthesized
cacttcaacccgggaggcag

SEQ ID NO: 53680 - DNA, 20 bp, Artificial Sequence
  chemically synthesized
aacccgggaggcagaggttg

SEQ ID NO: 53681 - DNA, 20 bp, Artificial Sequence
  chemically synthesized
cgggaggcagaggttgcagt

SEQ ID NO: 53682 - DNA, 20 bp, Artificial Sequence
  chemically synthesized
gaaatcacaccactgcactc

SEQ ID NO: 53683 - DNA, 20 bp, Artificial Sequence
  chemically synthesized
acaccactgcactccagcct

SEQ ID NO: 53684 - DNA, 20 bp, Artificial Sequence
  chemically synthesized
ctgcactccagccttggtga

SEQ ID NO: 53685 - DNA, 20 bp, Artificial Sequence
  chemically synthesized
gcactccagccttggtgaca

SEQ ID NO: 53686 - DNA, 20 bp, Artificial Sequence
  chemically synthesized
tccagccttggtgacagaga

SEQ ID NO: 53687 - DNA, 20 bp, Artificial Sequence
  chemically synthesized
gtgacagagaaagattctgt

SEQ ID NO: 53688 - DNA, 20 bp, Artificial Sequence
  chemically synthesized
tgacagagaaagattctgtc

SEQ ID NO: 53689 - DNA, 20 bp, Artificial Sequence
  chemically synthesized
ctgtcaggaaaaaaaaaaaa

SEQ ID NO: 53690 - DNA, 20 bp, Artificial Sequence
  chemically synthesized
aaagtttaaatgaattaccc

SEQ ID NO: 53691 - DNA, 20 bp, Artificial Sequence
  chemically synthesized
aagtttaaatgaattaccca

SEQ ID NO: 53692 - DNA, 20 bp, Artificial Sequence
  chemically synthesized
tacccaaggtatataattgt

SEQ ID NO: 53693 - DNA, 20 bp, Artificial Sequence
  chemically synthesized
aggtatataattgttagtgt

SEQ ID NO: 53694 - DNA, 20 bp, Artificial Sequence
  chemically synthesized
tatataattgttagtgttag

SEQ ID NO: 53695 - DNA, 20 bp, Artificial Sequence
  chemically synthesized
atataattgttagtgttaga

SEQ ID NO: 53696 - DNA, 20 bp, Artificial Sequence
  chemically synthesized
taattgttagtgttagaagg

SEQ ID NO: 53697 - DNA, 20 bp, Artificial Sequence
  chemically synthesized
ttgttagtgttagaaggaag

SEQ ID NO: 53698 - DNA, 20 bp, Artificial Sequence
  chemically synthesized
ttagtgttagaaggaagaag

SEQ ID NO: 53699 - DNA, 20 bp, Artificial Sequence
  chemically synthesized
tagtgttagaaggaagaaga

SEQ ID NO: 53700 - DNA, 20 bp, Artificial Sequence
  chemically synthesized
agtgttagaaggaagaagaa

SEQ ID NO: 53701 - DNA, 20 bp, Artificial Sequence
  chemically synthesized
tgttagaaggaagaagaagg

SEQ ID NO: 53702 - DNA, 20 bp, Artificial Sequence
  chemically synthesized
gttagaaggaagaagaaggg

SEQ ID NO: 53703 - DNA, 20 bp, Artificial Sequence
  chemically synthesized
ttagaaggaagaagaaggga

SEQ ID NO: 53704 - DNA, 20 bp, Artificial Sequence
  chemically synthesized
agaaggaagaagaagggagg

SEQ ID NO: 53705 - DNA, 20 bp, Artificial Sequence
  chemically synthesized
gaaggaagaagaagggaggg

SEQ ID NO: 53706 - DNA, 20 bp, Artificial Sequence
  chemically synthesized
ggaagaagaagggagggagg

SEQ ID NO: 53707 - DNA, 20 bp, Artificial Sequence
  chemically synthesized
gaagaagaagggagggagga

SEQ ID NO: 53708 - DNA, 20 bp, Artificial Sequence
  chemically synthesized
gaagaagggagggaggaagg

SEQ ID NO: 53709 - DNA, 20 bp, Artificial Sequence
  chemically synthesized
aagaagggagggaggaagga

SEQ ID NO: 53710 - DNA, 20 bp, Artificial Sequence
  chemically synthesized
agaagggagggaggaaggaa

SEQ ID NO: 53711 - DNA, 20 bp, Artificial Sequence
  chemically synthesized
aagggagggaggaaggaagg

SEQ ID NO: 53712 - DNA, 20 bp, Artificial Sequence
  chemically synthesized
gagggaggaaggaagggaga

SEQ ID NO: 53713 - DNA, 20 bp, Artificial Sequence
  chemically synthesized
gaggaaggaagggagaaaga

SEQ ID NO: 53714 - DNA, 20 bp, Artificial Sequence
  chemically synthesized
aggaaggaagggagaaagaa

SEQ ID NO: 53715 - DNA, 20 bp, Artificial Sequence
  chemically synthesized
ggaaggaagggagaaagaaa

SEQ ID NO: 53716 - DNA, 20 bp, Artificial Sequence
  chemically synthesized
aggaagggagaaagaaaggg

SEQ ID NO: 53717 - DNA, 20 bp, Artificial Sequence
  chemically synthesized
ggaagggagaaagaaaggga

SEQ ID NO: 53718 - DNA, 20 bp, Artificial Sequence
  chemically synthesized
aagggagaaagaaagggaag

SEQ ID NO: 53719 - DNA, 20 bp, Artificial Sequence
  chemically synthesized
agggagaaagaaagggaagg

SEQ ID NO: 53720 - DNA, 20 bp, Artificial Sequence
  chemically synthesized
gagaaagaaagggaaggagg

SEQ ID NO: 53721 - DNA, 20 bp, Artificial Sequence
  chemically synthesized
agaaagaaagggaaggagga

SEQ ID NO: 53722 - DNA, 20 bp, Artificial Sequence
  chemically synthesized
gaaagaaagggaaggaggaa

SEQ ID NO: 53723 - DNA, 20 bp, Artificial Sequence
  chemically synthesized
aagaaagggaaggaggaagg

SEQ ID NO: 53724 - DNA, 20 bp, Artificial Sequence
  chemically synthesized
agaaagggaaggaggaaggg

SEQ ID NO: 53725 - DNA, 20 bp, Artificial Sequence
  chemically synthesized
gaaagggaaggaggaaggga

SEQ ID NO: 53726 - DNA, 20 bp, Artificial Sequence
  chemically synthesized
aagggaaggaggaagggagg

SEQ ID NO: 53727 - DNA, 20 bp, Artificial Sequence
  chemically synthesized
agggaaggaggaagggaggg

SEQ ID NO: 53728 - DNA, 20 bp, Artificial Sequence
  chemically synthesized
gggaaggaggaagggaggga

SEQ ID NO: 53729 - DNA, 20 bp, Artificial Sequence
  chemically synthesized
aaggaggaagggagggaggg

SEQ ID NO: 53730 - DNA, 20 bp, Artificial Sequence
  chemically synthesized
aggaagggagggagggaaga

SEQ ID NO: 53731 - DNA, 20 bp, Artificial Sequence
  chemically synthesized
agaaagcctttatttatcta

SEQ ID NO: 53732 - DNA, 20 bp, Artificial Sequence
  chemically synthesized
gaaagcctttatttatctat

SEQ ID NO: 53733 - DNA, 20 bp, Artificial Sequence
  chemically synthesized
aaagcctttatttatctatg

SEQ ID NO: 53734 - DNA, 20 bp, Artificial Sequence
  chemically synthesized
tatttatctatggggttccc

SEQ ID NO: 53735 - DNA, 20 bp, Artificial Sequence
  chemically synthesized
tatctatggggttccctgga

SEQ ID NO: 53736 - DNA, 20 bp, Artificial Sequence
  chemically synthesized
ctatggggttccctggaaag

SEQ ID NO: 53737 - DNA, 20 bp, Artificial Sequence
  chemically synthesized
tatggggttccctggaaagc

SEQ ID NO: 53738 - DNA, 20 bp, Artificial Sequence
  chemically synthesized
ccctggaaagcaggctgaaa

SEQ ID NO: 53739 - DNA, 20 bp, Artificial Sequence
  chemically synthesized
ctggaaagcaggctgaaatg

SEQ ID NO: 53740 - DNA, 20 bp, Artificial Sequence
  chemically synthesized
ctgaaatggagattcacgtg

SEQ ID NO: 53741 - DNA, 20 bp, Artificial Sequence
  chemically synthesized
tgaaatggagattcacgtgc

SEQ ID NO: 53742 - DNA, 20 bp, Artificial Sequence
  chemically synthesized
aaatggagattcacgtgcag

SEQ ID NO: 53743 - DNA, 20 bp, Artificial Sequence
  chemically synthesized
gagattcacgtgcaggagtt

SEQ ID NO: 53744 - DNA, 20 bp, Artificial Sequence
  chemically synthesized
gtgcaggagtttagatactc

SEQ ID NO: 53745 - DNA, 20 bp, Artificial Sequence
  chemically synthesized
tgcaggagtttagatactct

SEQ ID NO: 53746 - DNA, 20 bp, Artificial Sequence
  chemically synthesized
gcaggagtttagatactctg

SEQ ID NO: 53747 - DNA, 20 bp, Artificial Sequence
  chemically synthesized
actctggggaactatacttg

SEQ ID NO: 53748 - DNA, 20 bp, Artificial Sequence
  chemically synthesized
ctggggaactatacttgtag

SEQ ID NO: 53749 - DNA, 20 bp, Artificial Sequence
  chemically synthesized
tggggaactatacttgtaga

SEQ ID NO: 53750 - DNA, 20 bp, Artificial Sequence
  chemically synthesized
ggggaactatacttgtagaa

SEQ ID NO: 53751 - DNA, 20 bp, Artificial Sequence
  chemically synthesized
gaactatacttgtagaaggg

SEQ ID NO: 53752 - DNA, 20 bp, Artificial Sequence
  chemically synthesized
aactatacttgtagaaggga

SEQ ID NO: 53753 - DNA, 20 bp, Artificial Sequence
  chemically synthesized
tacttgtagaagggaaggaa

SEQ ID NO: 53754 - DNA, 20 bp, Artificial Sequence
  chemically synthesized
acttgtagaagggaaggaac

SEQ ID NO: 53755 - DNA, 20 bp, Artificial Sequence
  chemically synthesized
tagaagggaaggaacaggaa

SEQ ID NO: 53756 - DNA, 20 bp, Artificial Sequence
  chemically synthesized
agaagggaaggaacaggaac

SEQ ID NO: 53757 - DNA, 20 bp, Artificial Sequence
  chemically synthesized
gaagggaaggaacaggaaca

SEQ ID NO: 53758 - DNA, 20 bp, Artificial Sequence
  chemically synthesized
gggaaggaacaggaacaggg

SEQ ID NO: 53759 - DNA, 20 bp, Artificial Sequence
  chemically synthesized
aaggaacaggaacagggcag

SEQ ID NO: 53760 - DNA, 20 bp, Artificial Sequence
  chemically synthesized
aggaacaggaacagggcaga

SEQ ID NO: 53761 - DNA, 20 bp, Artificial Sequence
  chemically synthesized
gaacaggaacagggcagaag

SEQ ID NO: 53762 - DNA, 20 bp, Artificial Sequence
  chemically synthesized
acaggaacagggcagaagga

SEQ ID NO: 53763 - DNA, 20 bp, Artificial Sequence
  chemically synthesized
caggaacagggcagaaggag

SEQ ID NO: 53764 - DNA, 20 bp, Artificial Sequence
  chemically synthesized
acagggcagaaggagaggtc

SEQ ID NO: 53765 - DNA, 20 bp, Artificial Sequence
  chemically synthesized
ttctgcctcatccaacccca

SEQ ID NO: 53766 - DNA, 20 bp, Artificial Sequence
  chemically synthesized
gcctcatccaaccccacagc

SEQ ID NO: 53767 - DNA, 20 bp, Artificial Sequence
  chemically synthesized
caaccccacagcgagctctg

SEQ ID NO: 53768 - DNA, 20 bp, Artificial Sequence
  chemically synthesized
cccacagcgagctctgaagc

SEQ ID NO: 53769 - DNA, 20 bp, Artificial Sequence
  chemically synthesized
ccacagcgagctctgaagct

SEQ ID NO: 53770 - DNA, 20 bp, Artificial Sequence
  chemically synthesized
cacagcgagctctgaagctg

SEQ ID NO: 53771 - DNA, 20 bp, Artificial Sequence
  chemically synthesized
gcgagctctgaagctgggga

SEQ ID NO: 53772 - DNA, 20 bp, Artificial Sequence
  chemically synthesized
tgaagctggggatggctcct

SEQ ID NO: 53773 - DNA, 20 bp, Artificial Sequence
  chemically synthesized
aagctggggatggctcctca

SEQ ID NO: 53774 - DNA, 20 bp, Artificial Sequence
  chemically synthesized
tggggatggctcctcagagt

SEQ ID NO: 53775 - DNA, 20 bp, Artificial Sequence
  chemically synthesized
tggctcctcagagttggtcc

SEQ ID NO: 53776 - DNA, 20 bp, Artificial Sequence
  chemically synthesized
tcctcagagttggtccaagt

SEQ ID NO: 53777 - DNA, 20 bp, Artificial Sequence
  chemically synthesized
cctcagagttggtccaagtt

SEQ ID NO: 53778 - DNA, 20 bp, Artificial Sequence
  chemically synthesized
gagttggtccaagttgggac

SEQ ID NO: 53779 - DNA, 20 bp, Artificial Sequence
  chemically synthesized
agttggtccaagttgggaca

SEQ ID NO: 53780 - DNA, 20 bp, Artificial Sequence
  chemically synthesized
gttggtccaagttgggacaa

SEQ ID NO: 53781 - DNA, 20 bp, Artificial Sequence
  chemically synthesized
ccaagttgggacaagggaat

SEQ ID NO: 53782 - DNA, 20 bp, Artificial Sequence
  chemically synthesized
gggacaagggaatcagaccc

SEQ ID NO: 53783 - DNA, 20 bp, Artificial Sequence
  chemically synthesized
ggacaagggaatcagaccct

SEQ ID NO: 53784 - DNA, 20 bp, Artificial Sequence
  chemically synthesized
gacaagggaatcagaccctg

SEQ ID NO: 53785 - DNA, 20 bp, Artificial Sequence
  chemically synthesized
caagggaatcagaccctggg

SEQ ID NO: 53786 - DNA, 20 bp, Artificial Sequence
  chemically synthesized
agggaatcagaccctgggga

SEQ ID NO: 53787 - DNA, 20 bp, Artificial Sequence
  chemically synthesized
gggagagcgtaaccttgatc

SEQ ID NO: 53788 - DNA, 20 bp, Artificial Sequence
  chemically synthesized
ggagagcgtaaccttgatca

SEQ ID NO: 53789 - DNA, 20 bp, Artificial Sequence
  chemically synthesized
ttgatcaaggcgactctctt

SEQ ID NO: 53790 - DNA, 20 bp, Artificial Sequence
  chemically synthesized
caaggcgactctctttagcc

SEQ ID NO: 53791 - DNA, 20 bp, Artificial Sequence
  chemically synthesized
aaggcgactctctttagccc

SEQ ID NO: 53792 - DNA, 20 bp, Artificial Sequence
  chemically synthesized
aggcgactctctttagccca

SEQ ID NO: 53793 - DNA, 20 bp, Artificial Sequence
  chemically synthesized
tctttagcccagggcaatgc

SEQ ID NO: 53794 - DNA, 20 bp, Artificial Sequence
  chemically synthesized
ctttagcccagggcaatgcc

SEQ ID NO: 53795 - DNA, 20 bp, Artificial Sequence
  chemically synthesized
ttagcccagggcaatgccag

SEQ ID NO: 53796 - DNA, 20 bp, Artificial Sequence
  chemically synthesized
gcccagggcaatgccaggag

SEQ ID NO: 53797 - DNA, 20 bp, Artificial Sequence
  chemically synthesized
cccagggcaatgccaggaga

SEQ ID NO: 53798 - DNA, 20 bp, Artificial Sequence
  chemically synthesized
ggcaatgccaggagaaggct

SEQ ID NO: 53799 - DNA, 20 bp, Artificial Sequence
  chemically synthesized
caatgccaggagaaggctga

SEQ ID NO: 53800 - DNA, 20 bp, Artificial Sequence
  chemically synthesized
tgccaggagaaggctgagag

SEQ ID NO: 53801 - DNA, 20 bp, Artificial Sequence
  chemically synthesized
aggagaaggctgagagcaga

SEQ ID NO: 53802 - DNA, 20 bp, Artificial Sequence
  chemically synthesized
atctaccatcacactctcaa

SEQ ID NO: 53803 - DNA, 20 bp, Artificial Sequence
  chemically synthesized
actctcaacagctacgaaat

SEQ ID NO: 53804 - DNA, 20 bp, Artificial Sequence
  chemically synthesized
cagctacgaaataagtcctg

SEQ ID NO: 53805 - DNA, 20 bp, Artificial Sequence
  chemically synthesized
acgaaataagtcctgcagtt

SEQ ID NO: 53806 - DNA, 20 bp, Artificial Sequence
  chemically synthesized
cgaaataagtcctgcagttc

SEQ ID NO: 53807 - DNA, 20 bp, Artificial Sequence
  chemically synthesized
aaataagtcctgcagttcag

SEQ ID NO: 53808 - DNA, 20 bp, Artificial Sequence
  chemically synthesized
aataagtcctgcagttcagg

SEQ ID NO: 53809 - DNA, 20 bp, Artificial Sequence
  chemically synthesized
ataagtcctgcagttcagga

SEQ ID NO: 53810 - DNA, 20 bp, Artificial Sequence
  chemically synthesized
aagtcctgcagttcaggagg

SEQ ID NO: 53811 - DNA, 20 bp, Artificial Sequence
  chemically synthesized
agtcctgcagttcaggaggg

SEQ ID NO: 53812 - DNA, 20 bp, Artificial Sequence
  chemically synthesized
tgcagttcaggagggaggtc

SEQ ID NO: 53813 - DNA, 20 bp, Artificial Sequence
  chemically synthesized
gcagttcaggagggaggtct

SEQ ID NO: 53814 - DNA, 20 bp, Artificial Sequence
  chemically synthesized
gttcaggagggaggtctggg

SEQ ID NO: 53815 - DNA, 20 bp, Artificial Sequence
  chemically synthesized
gaggtctgggcggcacatct

SEQ ID NO: 53816 - DNA, 20 bp, Artificial Sequence
  chemically synthesized
aggtctgggcggcacatctc

SEQ ID NO: 53817 - DNA, 20 bp, Artificial Sequence
  chemically synthesized
tctcaggaccctctatctct

SEQ ID NO: 53818 - DNA, 20 bp, Artificial Sequence
  chemically synthesized
ctcaggaccctctatctctc

SEQ ID NO: 53819 - DNA, 20 bp, Artificial Sequence
  chemically synthesized
tcaggaccctctatctctca

SEQ ID NO: 53820 - DNA, 20 bp, Artificial Sequence
  chemically synthesized
ggaccctctatctctcaggg

SEQ ID NO: 53821 - DNA, 20 bp, Artificial Sequence
  chemically synthesized
accctctatctctcagggta

SEQ ID NO: 53822 - DNA, 20 bp, Artificial Sequence
  chemically synthesized
ccctctatctctcagggtag

SEQ ID NO: 53823 - DNA, 20 bp, Artificial Sequence
  chemically synthesized
tctctcagggtagaggaatt

SEQ ID NO: 53824 - DNA, 20 bp, Artificial Sequence
  chemically synthesized
cagggtagaggaattaagaa

SEQ ID NO: 53825 - DNA, 20 bp, Artificial Sequence
  chemically synthesized
agggtagaggaattaagaat

SEQ ID NO: 53826 - DNA, 20 bp, Artificial Sequence
  chemically synthesized
tagaggaattaagaatggga

SEQ ID NO: 53827 - DNA, 20 bp, Artificial Sequence
  chemically synthesized
agaggaattaagaatgggat

SEQ ID NO: 53828 - DNA, 20 bp, Artificial Sequence
  chemically synthesized
attaagaatgggatgggaac

SEQ ID NO: 53829 - DNA, 20 bp, Artificial Sequence
  chemically synthesized
agaatgggatgggaaccaga

SEQ ID NO: 53830 - DNA, 20 bp, Artificial Sequence
  chemically synthesized
gaatgggatgggaaccagac

SEQ ID NO: 53831 - DNA, 20 bp, Artificial Sequence
  chemically synthesized
gatgggaaccagacgggcca

SEQ ID NO: 53832 - DNA, 20 bp, Artificial Sequence
  chemically synthesized
gggaaccagacgggccatgg

SEQ ID NO: 53833 - DNA, 20 bp, Artificial Sequence
  chemically synthesized
cacctataatcccaacactt

SEQ ID NO: 53834 - DNA, 20 bp, Artificial Sequence
  chemically synthesized
acctataatcccaacacttt

SEQ ID NO: 53835 - DNA, 20 bp, Artificial Sequence
  chemically synthesized
ctataatcccaacactttgg

SEQ ID NO: 53836 - DNA, 20 bp, Artificial Sequence
  chemically synthesized
tataatcccaacactttggg

SEQ ID NO: 53837 - DNA, 20 bp, Artificial Sequence
  chemically synthesized
tcccaacactttgggaggcc

SEQ ID NO: 53838 - DNA, 20 bp, Artificial Sequence
  chemically synthesized
cccaacactttgggaggcca

SEQ ID NO: 53839 - DNA, 20 bp, Artificial Sequence
  chemically synthesized
ccaacactttgggaggccaa

SEQ ID NO: 53840 - DNA, 20 bp, Artificial Sequence
  chemically synthesized
acactttgggaggccaaggg

SEQ ID NO: 53841 - DNA, 20 bp, Artificial Sequence
  chemically synthesized
cactttgggaggccaagggt

SEQ ID NO: 53842 - DNA, 20 bp, Artificial Sequence
  chemically synthesized
ctttgggaggccaagggtag

SEQ ID NO: 53843 - DNA, 20 bp, Artificial Sequence
  chemically synthesized
tttgggaggccaagggtagg

SEQ ID NO: 53844 - DNA, 20 bp, Artificial Sequence
  chemically synthesized
caagggtaggaggattgctt

SEQ ID NO: 53845 - DNA, 20 bp, Artificial Sequence
  chemically synthesized
taggaggattgcttgagccc

SEQ ID NO: 53846 - DNA, 20 bp, Artificial Sequence
  chemically synthesized
ggaggattgcttgagcccaa

SEQ ID NO: 53847 - DNA, 20 bp, Artificial Sequence
  chemically synthesized
tgagcccaagagttcaaaac

SEQ ID NO: 53848 - DNA, 20 bp, Artificial Sequence
  chemically synthesized
ccaagagttcaaaaccagcc

SEQ ID NO: 53849 - DNA, 20 bp, Artificial Sequence
  chemically synthesized
caagagttcaaaaccagcct

SEQ ID NO: 53850 - DNA, 20 bp, Artificial Sequence
  chemically synthesized
tttaaaaaatttgctgtgtg

SEQ ID NO: 53851 - DNA, 20 bp, Artificial Sequence
  chemically synthesized
aaaaaatttgctgtgtgtgg

SEQ ID NO: 53852 - DNA, 20 bp, Artificial Sequence
  chemically synthesized
tgtgtggtggtgtgcacctg

SEQ ID NO: 53853 - DNA, 20 bp, Artificial Sequence
  chemically synthesized
gtggtgtgcacctgtggtcc

SEQ ID NO: 53854 - DNA, 20 bp, Artificial Sequence
  chemically synthesized
cacctgtggtcccagctact

SEQ ID NO: 53855 - DNA, 20 bp, Artificial Sequence
  chemically synthesized
acctgtggtcccagctactc

SEQ ID NO: 53856 - DNA, 20 bp, Artificial Sequence
  chemically synthesized
cctgtggtcccagctactca

SEQ ID NO: 53857 - DNA, 20 bp, Artificial Sequence
  chemically synthesized
ctgtggtcccagctactcag

SEQ ID NO: 53858 - DNA, 20 bp, Artificial Sequence
  chemically synthesized
tgtggtcccagctactcagg

SEQ ID NO: 53859 - DNA, 20 bp, Artificial Sequence
  chemically synthesized
tcccagctactcagggggct

SEQ ID NO: 53860 - DNA, 20 bp, Artificial Sequence
  chemically synthesized
cccagctactcagggggctg

SEQ ID NO: 53861 - DNA, 20 bp, Artificial Sequence
  chemically synthesized
agctactcagggggctgagg

SEQ ID NO: 53862 - DNA, 20 bp, Artificial Sequence
  chemically synthesized
gctactcagggggctgaggt

SEQ ID NO: 53863 - DNA, 20 bp, Artificial Sequence
  chemically synthesized
tactcagggggctgaggtgg

SEQ ID NO: 53864 - DNA, 20 bp, Artificial Sequence
  chemically synthesized
actcagggggctgaggtggg

SEQ ID NO: 53865 - DNA, 20 bp, Artificial Sequence
  chemically synthesized
ctgaggtgggaggattgctt

SEQ ID NO: 53866 - DNA, 20 bp, Artificial Sequence
  chemically synthesized
gtgggaggattgcttgagtc

SEQ ID NO: 53867 - DNA, 20 bp, Artificial Sequence
  chemically synthesized
tgggaggattgcttgagtcc

SEQ ID NO: 53868 - DNA, 20 bp, Artificial Sequence
  chemically synthesized
ggaggattgcttgagtccag

SEQ ID NO: 53869 - DNA, 20 bp, Artificial Sequence
  chemically synthesized
gaggattgcttgagtccagg

SEQ ID NO: 53870 - DNA, 20 bp, Artificial Sequence
  chemically synthesized
ttgcttgagtccaggaggtc

SEQ ID NO: 53871 - DNA, 20 bp, Artificial Sequence
  chemically synthesized
tgcttgagtccaggaggtcg

SEQ ID NO: 53872 - DNA, 20 bp, Artificial Sequence
  chemically synthesized
agtccaggaggtcgaggctg

SEQ ID NO: 53873 - DNA, 20 bp, Artificial Sequence
  chemically synthesized
caggaggtcgaggctgcagt

SEQ ID NO: 53874 - DNA, 20 bp, Artificial Sequence
  chemically synthesized
gctgcagtgagctatgatca

SEQ ID NO: 53875 - DNA, 20 bp, Artificial Sequence
  chemically synthesized
atgatcatggcactgcattg

SEQ ID NO: 53876 - DNA, 20 bp, Artificial Sequence
  chemically synthesized
catggcactgcattgcagcc

SEQ ID NO: 53877 - DNA, 20 bp, Artificial Sequence
  chemically synthesized
atggcactgcattgcagcct

SEQ ID NO: 53878 - DNA, 20 bp, Artificial Sequence
  chemically synthesized
ggcactgcattgcagcctag

SEQ ID NO: 53879 - DNA, 20 bp, Artificial Sequence
  chemically synthesized
gcattgcagcctaggagaca

SEQ ID NO: 53880 - DNA, 20 bp, Artificial Sequence
  chemically synthesized
tgcagcctaggagacaaagc

SEQ ID NO: 53881 - DNA, 20 bp, Artificial Sequence
  chemically synthesized
aaaacaaacaaataaaaaaa

SEQ ID NO: 53882 - DNA, 20 bp, Artificial Sequence
  chemically synthesized
aacaaataaaaaaacggaac

SEQ ID NO: 53883 - DNA, 20 bp, Artificial Sequence
  chemically synthesized
aaaaaaacggaaccggttgc

SEQ ID NO: 53884 - DNA, 20 bp, Artificial Sequence
  chemically synthesized
aaaacggaaccggttgcaag

SEQ ID NO: 53885 - DNA, 20 bp, Artificial Sequence
  chemically synthesized
aaacggaaccggttgcaagc

SEQ ID NO: 53886 - DNA, 20 bp, Artificial Sequence
  chemically synthesized
aacggaaccggttgcaagca

SEQ ID NO: 53887 - DNA, 20 bp, Artificial Sequence
  chemically synthesized
cggttgcaagcagggttaaa

SEQ ID NO: 53888 - DNA, 20 bp, Artificial Sequence
  chemically synthesized
gcaagcagggttaaatagcg

SEQ ID NO: 53889 - DNA, 20 bp, Artificial Sequence
  chemically synthesized
gcagggttaaatagcgtggt

SEQ ID NO: 53890 - DNA, 20 bp, Artificial Sequence
  chemically synthesized
agggttaaatagcgtggtca

SEQ ID NO: 53891 - DNA, 20 bp, Artificial Sequence
  chemically synthesized
gttaaatagcgtggtcagag

SEQ ID NO: 53892 - DNA, 20 bp, Artificial Sequence
  chemically synthesized
ttaaatagcgtggtcagagt

SEQ ID NO: 53893 - DNA, 20 bp, Artificial Sequence
  chemically synthesized
tggtcagagtaggactcact

SEQ ID NO: 53894 - DNA, 20 bp, Artificial Sequence
  chemically synthesized
gtaggactcactgagaatat

SEQ ID NO: 53895 - DNA, 20 bp, Artificial Sequence
  chemically synthesized
tcactgagaatatgagatct

SEQ ID NO: 53896 - DNA, 20 bp, Artificial Sequence
  chemically synthesized
gagaatatgagatctgagtc

SEQ ID NO: 53897 - DNA, 20 bp, Artificial Sequence
  chemically synthesized
gagatctgagtcaagtcttc

SEQ ID NO: 53898 - DNA, 20 bp, Artificial Sequence
  chemically synthesized
agatctgagtcaagtcttca

SEQ ID NO: 53899 - DNA, 20 bp, Artificial Sequence
  chemically synthesized
agtcaagtcttcaaggatgt

SEQ ID NO: 53900 - DNA, 20 bp, Artificial Sequence
  chemically synthesized
gtcaagtcttcaaggatgtg

SEQ ID NO: 53901 - DNA, 20 bp, Artificial Sequence
  chemically synthesized
aagtcttcaaggatgtgagg

SEQ ID NO: 53902 - DNA, 20 bp, Artificial Sequence
  chemically synthesized
cttcaaggatgtgaggaagt

SEQ ID NO: 53903 - DNA, 20 bp, Artificial Sequence
  chemically synthesized
gatgtgaggaagtaagtttc

SEQ ID NO: 53904 - DNA, 20 bp, Artificial Sequence
  chemically synthesized
gtgaggaagtaagtttctgg

SEQ ID NO: 53905 - DNA, 20 bp, Artificial Sequence
  chemically synthesized
aggaagtaagtttctggcag

SEQ ID NO: 53906 - DNA, 20 bp, Artificial Sequence
  chemically synthesized
gaagtaagtttctggcagaa

SEQ ID NO: 53907 - DNA, 20 bp, Artificial Sequence
  chemically synthesized
tttctggcagaagagctgtg

SEQ ID NO: 53908 - DNA, 20 bp, Artificial Sequence
  chemically synthesized
ttctggcagaagagctgtga

SEQ ID NO: 53909 - DNA, 20 bp, Artificial Sequence
  chemically synthesized
tctggcagaagagctgtgaa

SEQ ID NO: 53910 - DNA, 20 bp, Artificial Sequence
  chemically synthesized
aagagctgtgaagggctgtc

SEQ ID NO: 53911 - DNA, 20 bp, Artificial Sequence
  chemically synthesized
gctgtgaagggctgtctggc

SEQ ID NO: 53912 - DNA, 20 bp, Artificial Sequence
  chemically synthesized
tgtgaagggctgtctggcca

SEQ ID NO: 53913 - DNA, 20 bp, Artificial Sequence
  chemically synthesized
gaagggctgtctggccagag

SEQ ID NO: 53914 - DNA, 20 bp, Artificial Sequence
  chemically synthesized
cagagaagattgcaatgcaa

SEQ ID NO: 53915 - DNA, 20 bp, Artificial Sequence
  chemically synthesized
gattgcaatgcaaaagccct

SEQ ID NO: 53916 - DNA, 20 bp, Artificial Sequence
  chemically synthesized
attgcaatgcaaaagccctg

SEQ ID NO: 53917 - DNA, 20 bp, Artificial Sequence
  chemically synthesized
gcaatgcaaaagccctgagg

SEQ ID NO: 53918 - DNA, 20 bp, Artificial Sequence
  chemically synthesized
caatgcaaaagccctgaggt

SEQ ID NO: 53919 - DNA, 20 bp, Artificial Sequence
  chemically synthesized
ccctgaggtgggaacgtgtt

SEQ ID NO: 53920 - DNA, 20 bp, Artificial Sequence
  chemically synthesized
gaacgtgtttggtgtgttta

SEQ ID NO: 53921 - DNA, 20 bp, Artificial Sequence
  chemically synthesized
aacgtgtttggtgtgtttaa

SEQ ID NO: 53922 - DNA, 20 bp, Artificial Sequence
  chemically synthesized
tgtttggtgtgtttaaagga

SEQ ID NO: 53923 - DNA, 20 bp, Artificial Sequence
  chemically synthesized
tgtgtttaaaggaaagcaat

SEQ ID NO: 53924 - DNA, 20 bp, Artificial Sequence
  chemically synthesized
gtgtttaaaggaaagcaatg

SEQ ID NO: 53925 - DNA, 20 bp, Artificial Sequence
  chemically synthesized
ttaaaggaaagcaatgaggc

SEQ ID NO: 53926 - DNA, 20 bp, Artificial Sequence
  chemically synthesized
ggaaagcaatgaggccagtg

SEQ ID NO: 53927 - DNA, 20 bp, Artificial Sequence
  chemically synthesized
agcaatgaggccagtgtagc

SEQ ID NO: 53928 - DNA, 20 bp, Artificial Sequence
  chemically synthesized
tgaggccagtgtagccagaa

SEQ ID NO: 53929 - DNA, 20 bp, Artificial Sequence
  chemically synthesized
aggccagtgtagccagaaca

SEQ ID NO: 53930 - DNA, 20 bp, Artificial Sequence
  chemically synthesized
gtagccagaacagagtgtgc

SEQ ID NO: 53931 - DNA, 20 bp, Artificial Sequence
  chemically synthesized
tagccagaacagagtgtgca

SEQ ID NO: 53932 - DNA, 20 bp, Artificial Sequence
  chemically synthesized
gccagaacagagtgtgcaag

SEQ ID NO: 53933 - DNA, 20 bp, Artificial Sequence
  chemically synthesized
cagaacagagtgtgcaagga

SEQ ID NO: 53934 - DNA, 20 bp, Artificial Sequence
  chemically synthesized
aacagagtgtgcaaggagag

SEQ ID NO: 53935 - DNA, 20 bp, Artificial Sequence
  chemically synthesized
acagagtgtgcaaggagaga

SEQ ID NO: 53936 - DNA, 20 bp, Artificial Sequence
  chemically synthesized
gtgtgcaaggagagaaggaa

SEQ ID NO: 53937 - DNA, 20 bp, Artificial Sequence
  chemically synthesized
tgcaaggagagaaggaacag

SEQ ID NO: 53938 - DNA, 20 bp, Artificial Sequence
  chemically synthesized
gagagaaggaacagaagatg

SEQ ID NO: 53939 - DNA, 20 bp, Artificial Sequence
  chemically synthesized
gagaaggaacagaagatgtg

SEQ ID NO: 53940 - DNA, 20 bp, Artificial Sequence
  chemically synthesized
agaaggaacagaagatgtgg

SEQ ID NO: 53941 - DNA, 20 bp, Artificial Sequence
  chemically synthesized
gaaggaacagaagatgtgga

SEQ ID NO: 53942 - DNA, 20 bp, Artificial Sequence
  chemically synthesized
ggaacagaagatgtggaggg

SEQ ID NO: 53943 - DNA, 20 bp, Artificial Sequence
  chemically synthesized
agaagatgtggagggcagat

SEQ ID NO: 53944 - DNA, 20 bp, Artificial Sequence
  chemically synthesized
tcagtttgtaattgtacgcc

SEQ ID NO: 53945 - DNA, 20 bp, Artificial Sequence
  chemically synthesized
ctgattctttgtgtaatctc

SEQ ID NO: 53946 - DNA, 20 bp, Artificial Sequence
  chemically synthesized
tccagactgtattaaactgc

SEQ ID NO: 53947 - DNA, 20 bp, Artificial Sequence
  chemically synthesized
cagactgtattaaactgcaa

SEQ ID NO: 53948 - DNA, 20 bp, Artificial Sequence
  chemically synthesized
actgtattaaactgcaagag

SEQ ID NO: 53949 - DNA, 20 bp, Artificial Sequence
  chemically synthesized
ctgtattaaactgcaagagc

SEQ ID NO: 53950 - DNA, 20 bp, Artificial Sequence
  chemically synthesized
tgtattaaactgcaagagca

SEQ ID NO: 53951 - DNA, 20 bp, Artificial Sequence
  chemically synthesized
gcaagagcagggcccctctc

SEQ ID NO: 53952 - DNA, 20 bp, Artificial Sequence
  chemically synthesized
tttgctcatcattgtattcc

SEQ ID NO: 53953 - DNA, 20 bp, Artificial Sequence
  chemically synthesized
tgctcatcattgtattccca

SEQ ID NO: 53954 - DNA, 20 bp, Artificial Sequence
  chemically synthesized
ccagagccttgcacaatgct

SEQ ID NO: 53955 - DNA, 20 bp, Artificial Sequence
  chemically synthesized
cttgcacaatgcttggtgca

SEQ ID NO: 53956 - DNA, 20 bp, Artificial Sequence
  chemically synthesized
ttgcacaatgcttggtgcat

SEQ ID NO: 53957 - DNA, 20 bp, Artificial Sequence
  chemically synthesized
gcacaatgcttggtgcatag

SEQ ID NO: 53958 - DNA, 20 bp, Artificial Sequence
  chemically synthesized
aatgcttggtgcataggaga

SEQ ID NO: 53959 - DNA, 20 bp, Artificial Sequence
  chemically synthesized
tttgttaaataaatgaatta

SEQ ID NO: 53960 - DNA, 20 bp, Artificial Sequence
  chemically synthesized
aatgaattatggataacgaa

SEQ ID NO: 53961 - DNA, 20 bp, Artificial Sequence
  chemically synthesized
aattatggataacgaatgga

SEQ ID NO: 53962 - DNA, 20 bp, Artificial Sequence
  chemically synthesized
atggataacgaatggatggt

SEQ ID NO: 53963 - DNA, 20 bp, Artificial Sequence
  chemically synthesized
ataacgaatggatggtaaga

SEQ ID NO: 53964 - DNA, 20 bp, Artificial Sequence
  chemically synthesized
taacgaatggatggtaagat

SEQ ID NO: 53965 - DNA, 20 bp, Artificial Sequence
  chemically synthesized
cgaatggatggtaagatggg

SEQ ID NO: 53966 - DNA, 20 bp, Artificial Sequence
  chemically synthesized
tggatggtaagatgggtgga

SEQ ID NO: 53967 - DNA, 20 bp, Artificial Sequence
  chemically synthesized
tggtaagatgggtggatgga

SEQ ID NO: 53968 - DNA, 20 bp, Artificial Sequence
  chemically synthesized
ggtaagatgggtggatggat

SEQ ID NO: 53969 - DNA, 20 bp, Artificial Sequence
  chemically synthesized
gtaagatgggtggatggatg

SEQ ID NO: 53970 - DNA, 20 bp, Artificial Sequence
  chemically synthesized
taagatgggtggatggatgg

SEQ ID NO: 53971 - DNA, 20 bp, Artificial Sequence
  chemically synthesized
aagatgggtggatggatggg

SEQ ID NO: 53972 - DNA, 20 bp, Artificial Sequence
  chemically synthesized
gtggatggatggggggtgaa

SEQ ID NO: 53973 - DNA, 20 bp, Artificial Sequence
  chemically synthesized
atggatggggggtgaacgga

SEQ ID NO: 53974 - DNA, 20 bp, Artificial Sequence
  chemically synthesized
atggggggtgaacggatgga

SEQ ID NO: 53975 - DNA, 20 bp, Artificial Sequence
  chemically synthesized
tggggggtgaacggatggat

SEQ ID NO: 53976 - DNA, 20 bp, Artificial Sequence
  chemically synthesized
ggggggtgaacggatggatg

SEQ ID NO: 53977 - DNA, 20 bp, Artificial Sequence
  chemically synthesized
gggggtgaacggatggatgg

SEQ ID NO: 53978 - DNA, 20 bp, Artificial Sequence
  chemically synthesized
ggggtgaacggatggatggg

SEQ ID NO: 53979 - DNA, 20 bp, Artificial Sequence
  chemically synthesized
acggatggatggggggtgaa

SEQ ID NO: 53980 - DNA, 20 bp, Artificial Sequence
  chemically synthesized
atggatggggggtgaatgga

SEQ ID NO: 53981 - DNA, 20 bp, Artificial Sequence
  chemically synthesized
ggggtgaatggatggatgaa

SEQ ID NO: 53982 - DNA, 20 bp, Artificial Sequence
  chemically synthesized
gggtgaatggatggatgaat

SEQ ID NO: 53983 - DNA, 20 bp, Artificial Sequence
  chemically synthesized
tgaatggatggatgaatggg

SEQ ID NO: 53984 - DNA, 20 bp, Artificial Sequence
  chemically synthesized
tggatggatgaatgggtaga

SEQ ID NO: 53985 - DNA, 20 bp, Artificial Sequence
  chemically synthesized
ggatggatgaatgggtagat

SEQ ID NO: 53986 - DNA, 20 bp, Artificial Sequence
  chemically synthesized
tggatgaatgggtagatggg

SEQ ID NO: 53987 - DNA, 20 bp, Artificial Sequence
  chemically synthesized
tgaatgggtagatgggtgga

SEQ ID NO: 53988 - DNA, 20 bp, Artificial Sequence
  chemically synthesized
gaatgggtagatgggtggat

SEQ ID NO: 53989 - DNA, 20 bp, Artificial Sequence
  chemically synthesized
aatgggtagatgggtggata

SEQ ID NO: 53990 - DNA, 20 bp, Artificial Sequence
  chemically synthesized
atgggtagatgggtggatag

SEQ ID NO: 53991 - DNA, 20 bp, Artificial Sequence
  chemically synthesized
tgggtagatgggtggatagg

SEQ ID NO: 53992 - DNA, 20 bp, Artificial Sequence
  chemically synthesized
tagatgggtggataggggga

SEQ ID NO: 53993 - DNA, 20 bp, Artificial Sequence
  chemically synthesized
tgggtggatagggggatggc

SEQ ID NO: 53994 - DNA, 20 bp, Artificial Sequence
  chemically synthesized
gggtggatagggggatggct

SEQ ID NO: 53995 - DNA, 20 bp, Artificial Sequence
  chemically synthesized
tggatagggggatggctggg

SEQ ID NO: 53996 - DNA, 20 bp, Artificial Sequence
  chemically synthesized
tagggggatggctgggtggc

SEQ ID NO: 53997 - DNA, 20 bp, Artificial Sequence
  chemically synthesized
agggggatggctgggtggct

SEQ ID NO: 53998 - DNA, 20 bp, Artificial Sequence
  chemically synthesized
gggatggctgggtggctggg

SEQ ID NO: 53999 - DNA, 20 bp, Artificial Sequence
  chemically synthesized
gtagatgatgcactgtctcc

SEQ ID NO: 54000 - DNA, 20 bp, Artificial Sequence
  chemically synthesized
tgatgcactgtctcccagat

SEQ ID NO: 54001 - DNA, 20 bp, Artificial Sequence
  chemically synthesized
gatgcactgtctcccagatg

SEQ ID NO: 54002 - DNA, 20 bp, Artificial Sequence
  chemically synthesized
ccattctctttcctgccctt

SEQ ID NO: 54003 - DNA, 20 bp, Artificial Sequence
  chemically synthesized
cattctctttcctgcccttt

SEQ ID NO: 54004 - DNA, 20 bp, Artificial Sequence
  chemically synthesized
attctctttcctgcccttta

SEQ ID NO: 54005 - DNA, 20 bp, Artificial Sequence
  chemically synthesized
tctctttcctgccctttagg

SEQ ID NO: 54006 - DNA, 20 bp, Artificial Sequence
  chemically synthesized
tgccctttagggagcccctc

SEQ ID NO: 54007 - DNA, 20 bp, Artificial Sequence
  chemically synthesized
gagcccctctggccatgcca

SEQ ID NO: 54008 - DNA, 20 bp, Artificial Sequence
  chemically synthesized
agcccctctggccatgccat

SEQ ID NO: 54009 - DNA, 20 bp, Artificial Sequence
  chemically synthesized
ctctggccatgccatgggca

SEQ ID NO: 54010 - DNA, 20 bp, Artificial Sequence
  chemically synthesized
tggccatgccatgggcacag

SEQ ID NO: 54011 - DNA, 20 bp, Artificial Sequence
  chemically synthesized
ggccatgccatgggcacagc

SEQ ID NO: 54012 - DNA, 20 bp, Artificial Sequence
  chemically synthesized
agcaggtgtatactacgtga

SEQ ID NO: 54013 - DNA, 20 bp, Artificial Sequence
  chemically synthesized
catctactctttccatcttt

SEQ ID NO: 54014 - DNA, 20 bp, Artificial Sequence
  chemically synthesized
atctactctttccatctttc

SEQ ID NO: 54015 - DNA, 20 bp, Artificial Sequence
  chemically synthesized
tctactctttccatctttca

SEQ ID NO: 54016 - DNA, 20 bp, Artificial Sequence
  chemically synthesized
ctctttccatctttcaggga

SEQ ID NO: 54017 - DNA, 20 bp, Artificial Sequence
  chemically synthesized
ccatctttcagggaaagata

SEQ ID NO: 54018 - DNA, 20 bp, Artificial Sequence
  chemically synthesized
ggaaagataaagccgaccta

SEQ ID NO: 54019 - DNA, 20 bp, Artificial Sequence
  chemically synthesized
taaagccgacctacagattt

SEQ ID NO: 54020 - DNA, 20 bp, Artificial Sequence
  chemically synthesized
gccgacctacagatttcggt

SEQ ID NO: 54021 - DNA, 20 bp, Artificial Sequence
  chemically synthesized
tttcggtaagaactcaccac

SEQ ID NO: 54022 - DNA, 20 bp, Artificial Sequence
  chemically synthesized
ttcggtaagaactcaccact

SEQ ID NO: 54023 - DNA, 20 bp, Artificial Sequence
  chemically synthesized
tcggtaagaactcaccactg

SEQ ID NO: 54024 - DNA, 20 bp, Artificial Sequence
  chemically synthesized
aagaactcaccactggggtg

SEQ ID NO: 54025 - DNA, 20 bp, Artificial Sequence
  chemically synthesized
agaactcaccactggggtgt

SEQ ID NO: 54026 - DNA, 20 bp, Artificial Sequence
  chemically synthesized
actcaccactggggtgtagg

SEQ ID NO: 54027 - DNA, 20 bp, Artificial Sequence
  chemically synthesized
caccactggggtgtaggtgg

SEQ ID NO: 54028 - DNA, 20 bp, Artificial Sequence
  chemically synthesized
ccactggggtgtaggtggtg

SEQ ID NO: 54029 - DNA, 20 bp, Artificial Sequence
  chemically synthesized
cactggggtgtaggtggtgg

SEQ ID NO: 54030 - DNA, 20 bp, Artificial Sequence
  chemically synthesized
actggggtgtaggtggtgga

SEQ ID NO: 54031 - DNA, 20 bp, Artificial Sequence
  chemically synthesized
ggggtgtaggtggtggaggg

SEQ ID NO: 54032 - DNA, 20 bp, Artificial Sequence
  chemically synthesized
gggtgtaggtggtggagggc

SEQ ID NO: 54033 - DNA, 20 bp, Artificial Sequence
  chemically synthesized
gtgtaggtggtggagggcag

SEQ ID NO: 54034 - DNA, 20 bp, Artificial Sequence
  chemically synthesized
tgtaggtggtggagggcagg

SEQ ID NO: 54035 - DNA, 20 bp, Artificial Sequence
  chemically synthesized
aggtggtggagggcaggagg

SEQ ID NO: 54036 - DNA, 20 bp, Artificial Sequence
  chemically synthesized
gcaggaggcagctctctctg

SEQ ID NO: 54037 - DNA, 20 bp, Artificial Sequence
  chemically synthesized
tattcttcctcacatccccc

SEQ ID NO: 54038 - DNA, 20 bp, Artificial Sequence
  chemically synthesized
ccctagcccgctcccacacc

SEQ ID NO: 54039 - DNA, 20 bp, Artificial Sequence
  chemically synthesized
cctagcccgctcccacacct

SEQ ID NO: 54040 - DNA, 20 bp, Artificial Sequence
  chemically synthesized
agcccgctcccacacctggg

SEQ ID NO: 54041 - DNA, 20 bp, Artificial Sequence
  chemically synthesized
cacctgggcagccgctgatt

SEQ ID NO: 54042 - DNA, 20 bp, Artificial Sequence
  chemically synthesized
cctgggcagccgctgattaa

SEQ ID NO: 54043 - DNA, 20 bp, Artificial Sequence
  chemically synthesized
cagccgctgattaagagttg

SEQ ID NO: 54044 - DNA, 20 bp, Artificial Sequence
  chemically synthesized
gattaagagttgtggcactt

SEQ ID NO: 54045 - DNA, 20 bp, Artificial Sequence
  chemically synthesized
aagagttgtggcactttgga

SEQ ID NO: 54046 - DNA, 20 bp, Artificial Sequence
  chemically synthesized
agagttgtggcactttggat

SEQ ID NO: 54047 - DNA, 20 bp, Artificial Sequence
  chemically synthesized
gagttgtggcactttggata

SEQ ID NO: 54048 - DNA, 20 bp, Artificial Sequence
  chemically synthesized
ctttggatagggataaacct

SEQ ID NO: 54049 - DNA, 20 bp, Artificial Sequence
  chemically synthesized
ttggatagggataaacctca

SEQ ID NO: 54050 - DNA, 20 bp, Artificial Sequence
  chemically synthesized
atagggataaacctcagagt

SEQ ID NO: 54051 - DNA, 20 bp, Artificial Sequence
  chemically synthesized
tagggataaacctcagagtc

SEQ ID NO: 54052 - DNA, 20 bp, Artificial Sequence
  chemically synthesized
agggataaacctcagagtca

SEQ ID NO: 54053 - DNA, 20 bp, Artificial Sequence
  chemically synthesized
cctcagagtcagggaatgtt

SEQ ID NO: 54054 - DNA, 20 bp, Artificial Sequence
  chemically synthesized
ctcagagtcagggaatgttt

SEQ ID NO: 54055 - DNA, 20 bp, Artificial Sequence
  chemically synthesized
tcagggaatgtttgggctga

SEQ ID NO: 54056 - DNA, 20 bp, Artificial Sequence
  chemically synthesized
cagggaatgtttgggctgaa

SEQ ID NO: 54057 - DNA, 20 bp, Artificial Sequence
  chemically synthesized
agggaatgtttgggctgaaa

SEQ ID NO: 54058 - DNA, 20 bp, Artificial Sequence
  chemically synthesized
tgtttgggctgaaagggatc

SEQ ID NO: 54059 - DNA, 20 bp, Artificial Sequence
  chemically synthesized
ttgggctgaaagggatccag

SEQ ID NO: 54060 - DNA, 20 bp, Artificial Sequence
  chemically synthesized
tagtgcaatccgttgtttta

SEQ ID NO: 54061 - DNA, 20 bp, Artificial Sequence
  chemically synthesized
caatccgttgttttacagat

SEQ ID NO: 54062 - DNA, 20 bp, Artificial Sequence
  chemically synthesized
aatccgttgttttacagata

SEQ ID NO: 54063 - DNA, 20 bp, Artificial Sequence
  chemically synthesized
gttttacagataaggaaaca

SEQ ID NO: 54064 - DNA, 20 bp, Artificial Sequence
  chemically synthesized
aaacaaagcccaacaccatg

SEQ ID NO: 54065 - DNA, 20 bp, Artificial Sequence
  chemically synthesized
aacaaagcccaacaccatga

SEQ ID NO: 54066 - DNA, 20 bp, Artificial Sequence
  chemically synthesized
acaaagcccaacaccatgaa

SEQ ID NO: 54067 - DNA, 20 bp, Artificial Sequence
  chemically synthesized
atgaagggacttataaaaat

SEQ ID NO: 54068 - DNA, 20 bp, Artificial Sequence
  chemically synthesized
tgaagggacttataaaaata

SEQ ID NO: 54069 - DNA, 20 bp, Artificial Sequence
  chemically synthesized
agggacttataaaaataagg

SEQ ID NO: 54070 - DNA, 20 bp, Artificial Sequence
  chemically synthesized
cttataaaaataaggtagtg

SEQ ID NO: 54071 - DNA, 20 bp, Artificial Sequence
  chemically synthesized
ataaaaataaggtagtgaag

SEQ ID NO: 54072 - DNA, 20 bp, Artificial Sequence
  chemically synthesized
aaaataaggtagtgaagtag

SEQ ID NO: 54073 - DNA, 20 bp, Artificial Sequence
  chemically synthesized
ataaggtagtgaagtagcag

SEQ ID NO: 54074 - DNA, 20 bp, Artificial Sequence
  chemically synthesized
taaggtagtgaagtagcagc

SEQ ID NO: 54075 - DNA, 20 bp, Artificial Sequence
  chemically synthesized
aaggtagtgaagtagcagca

SEQ ID NO: 54076 - DNA, 20 bp, Artificial Sequence
  chemically synthesized
acccatgtctgtaccaacca

SEQ ID NO: 54077 - DNA, 20 bp, Artificial Sequence
  chemically synthesized
ccatgtctgtaccaaccaca

SEQ ID NO: 54078 - DNA, 20 bp, Artificial Sequence
  chemically synthesized
caaccacagagtcacccatc

SEQ ID NO: 54079 - DNA, 20 bp, Artificial Sequence
  chemically synthesized
aaccacagagtcacccatcc

SEQ ID NO: 54080 - DNA, 20 bp, Artificial Sequence
  chemically synthesized
cccatccaggttaaaataac

SEQ ID NO: 54081 - DNA, 20 bp, Artificial Sequence
  chemically synthesized
catccaggttaaaataacca

SEQ ID NO: 54082 - DNA, 20 bp, Artificial Sequence
  chemically synthesized
ggttaaaataaccagagaaa

SEQ ID NO: 54083 - DNA, 20 bp, Artificial Sequence
  chemically synthesized
taaaataaccagagaaacag

SEQ ID NO: 54084 - DNA, 20 bp, Artificial Sequence
  chemically synthesized
aacagaagatattcctacta

SEQ ID NO: 54085 - DNA, 20 bp, Artificial Sequence
  chemically synthesized
cagaagatattcctactaca

SEQ ID NO: 54086 - DNA, 20 bp, Artificial Sequence
  chemically synthesized
attcctactacagagaattc

SEQ ID NO: 54087 - DNA, 20 bp, Artificial Sequence
  chemically synthesized
ttcctactacagagaattcc

SEQ ID NO: 54088 - DNA, 20 bp, Artificial Sequence
  chemically synthesized
tacagagaattccgggtgtg

SEQ ID NO: 54089 - DNA, 20 bp, Artificial Sequence
  chemically synthesized
gaattccgggtgtgcagcca

SEQ ID NO: 54090 - DNA, 20 bp, Artificial Sequence
  chemically synthesized
tcctttttatttttattttt

SEQ ID NO: 54091 - DNA, 20 bp, Artificial Sequence
  chemically synthesized
ttatttttatttttgagatg

SEQ ID NO: 54092 - DNA, 20 bp, Artificial Sequence
  chemically synthesized
tgcagtctcgctctgtcatc

SEQ ID NO: 54093 - DNA, 20 bp, Artificial Sequence
  chemically synthesized
gcagtctcgctctgtcatcc

SEQ ID NO: 54094 - DNA, 20 bp, Artificial Sequence
  chemically synthesized
tcgctctgtcatccaggctg

SEQ ID NO: 54095 - DNA, 20 bp, Artificial Sequence
  chemically synthesized
ctgtcatccaggctgaagtg

SEQ ID NO: 54096 - DNA, 20 bp, Artificial Sequence
  chemically synthesized
tcatccaggctgaagtgcag

SEQ ID NO: 54097 - DNA, 20 bp, Artificial Sequence
  chemically synthesized
tcgctgcaacctctgcctcc

SEQ ID NO: 54098 - DNA, 20 bp, Artificial Sequence
  chemically synthesized
cgctgcaacctctgcctccc

SEQ ID NO: 54099 - DNA, 20 bp, Artificial Sequence
  chemically synthesized
aacctctgcctcccaggctc

SEQ ID NO: 54100 - DNA, 20 bp, Artificial Sequence
  chemically synthesized
ctcaagcgatcctcccacct

SEQ ID NO: 54101 - DNA, 20 bp, Artificial Sequence
  chemically synthesized
tcctcccacctcagccatct

SEQ ID NO: 54102 - DNA, 20 bp, Artificial Sequence
  chemically synthesized
tcccacctcagccatctgag

SEQ ID NO: 54103 - DNA, 20 bp, Artificial Sequence
  chemically synthesized
acctcagccatctgagtagc

SEQ ID NO: 54104 - DNA, 20 bp, Artificial Sequence
  chemically synthesized
cctcagccatctgagtagct

SEQ ID NO: 54105 - DNA, 20 bp, Artificial Sequence
  chemically synthesized
catctgagtagctgggacca

SEQ ID NO: 54106 - DNA, 20 bp, Artificial Sequence
  chemically synthesized
atctgagtagctgggaccac

SEQ ID NO: 54107 - DNA, 20 bp, Artificial Sequence
  chemically synthesized
cacaggccacacaccacacc

SEQ ID NO: 54108 - DNA, 20 bp, Artificial Sequence
  chemically synthesized
taatttctcgtatctttttg

SEQ ID NO: 54109 - DNA, 20 bp, Artificial Sequence
  chemically synthesized
atttctcgtatctttttgta

SEQ ID NO: 54110 - DNA, 20 bp, Artificial Sequence
  chemically synthesized
ctcgtatctttttgtagaga

SEQ ID NO: 54111 - DNA, 20 bp, Artificial Sequence
  chemically synthesized
cgtatctttttgtagagaca

SEQ ID NO: 54112 - DNA, 20 bp, Artificial Sequence
  chemically synthesized
cagagttctgctatgttgcc

SEQ ID NO: 54113 - DNA, 20 bp, Artificial Sequence
  chemically synthesized
agagttctgctatgttgccc

SEQ ID NO: 54114 - DNA, 20 bp, Artificial Sequence
  chemically synthesized
tctgctatgttgcccaggct

SEQ ID NO: 54115 - DNA, 20 bp, Artificial Sequence
  chemically synthesized
ctgctatgttgcccaggctc

SEQ ID NO: 54116 - DNA, 20 bp, Artificial Sequence
  chemically synthesized
tatgttgcccaggctcaggc

SEQ ID NO: 54117 - DNA, 20 bp, Artificial Sequence
  chemically synthesized
ctcaggctggtcttgatctc

SEQ ID NO: 54118 - DNA, 20 bp, Artificial Sequence
  chemically synthesized
tggtcttgatctcaagcaat

SEQ ID NO: 54119 - DNA, 20 bp, Artificial Sequence
  chemically synthesized
ctcaagcaattggcttgcct

SEQ ID NO: 54120 - DNA, 20 bp, Artificial Sequence
  chemically synthesized
gcctcagcctcctaaaatat

SEQ ID NO: 54121 - DNA, 20 bp, Artificial Sequence
  chemically synthesized
cctcagcctcctaaaatatt

SEQ ID NO: 54122 - DNA, 20 bp, Artificial Sequence
  chemically synthesized
ctcctaaaatattgggatta

SEQ ID NO: 54123 - DNA, 20 bp, Artificial Sequence
  chemically synthesized
tcctaaaatattgggattac

SEQ ID NO: 54124 - DNA, 20 bp, Artificial Sequence
  chemically synthesized
aatattgggattacaggcat

SEQ ID NO: 54125 - DNA, 20 bp, Artificial Sequence
  chemically synthesized
acaggcatgagccaccgcgc

SEQ ID NO: 54126 - DNA, 20 bp, Artificial Sequence
  chemically synthesized
gcaaatccttaattatcaaa

SEQ ID NO: 54127 - DNA, 20 bp, Artificial Sequence
  chemically synthesized
taattatcaaacagataaaa

SEQ ID NO: 54128 - DNA, 20 bp, Artificial Sequence
  chemically synthesized
aattatcaaacagataaaat

SEQ ID NO: 54129 - DNA, 20 bp, Artificial Sequence
  chemically synthesized
attatcaaacagataaaata

SEQ ID NO: 54130 - DNA, 20 bp, Artificial Sequence
  chemically synthesized
atcaaacagataaaataggg

SEQ ID NO: 54131 - DNA, 20 bp, Artificial Sequence
  chemically synthesized
aagttaaaattcatatacac

SEQ ID NO: 54132 - DNA, 20 bp, Artificial Sequence
  chemically synthesized
agttaaaattcatatacaca

SEQ ID NO: 54133 - DNA, 20 bp, Artificial Sequence
  chemically synthesized
gttaaaattcatatacacaa

SEQ ID NO: 54134 - DNA, 20 bp, Artificial Sequence
  chemically synthesized
caagggttaaccacttgcca

SEQ ID NO: 54135 - DNA, 20 bp, Artificial Sequence
  chemically synthesized
aagggttaaccacttgccac

SEQ ID NO: 54136 - DNA, 20 bp, Artificial Sequence
  chemically synthesized
ggcatttttttttttttttt

SEQ ID NO: 54137 - DNA, 20 bp, Artificial Sequence
  chemically synthesized
ttttttttttttttttgaga

SEQ ID NO: 54138 - DNA, 20 bp, Artificial Sequence
  chemically synthesized
cggaatctcgctctgttgcc

SEQ ID NO: 54139 - DNA, 20 bp, Artificial Sequence
  chemically synthesized
ggaatctcgctctgttgccc

SEQ ID NO: 54140 - DNA, 20 bp, Artificial Sequence
  chemically synthesized
tctcgctctgttgcccaggc

SEQ ID NO: 54141 - DNA, 20 bp, Artificial Sequence
  chemically synthesized
tcgctctgttgcccaggctg

SEQ ID NO: 54142 - DNA, 20 bp, Artificial Sequence
  chemically synthesized
ctgttgcccaggctggagtg

SEQ ID NO: 54143 - DNA, 20 bp, Artificial Sequence
  chemically synthesized
ttgcccaggctggagtgcag

SEQ ID NO: 54144 - DNA, 20 bp, Artificial Sequence
  chemically synthesized
tcactgcaacctccgcttcc

SEQ ID NO: 54145 - DNA, 20 bp, Artificial Sequence
  chemically synthesized
cactgcaacctccgcttcct

SEQ ID NO: 54146 - DNA, 20 bp, Artificial Sequence
  chemically synthesized
aacctccgcttcctgggttc

SEQ ID NO: 54147 - DNA, 20 bp, Artificial Sequence
  chemically synthesized
ttcaagctattcttctgcct

SEQ ID NO: 54148 - DNA, 20 bp, Artificial Sequence
  chemically synthesized
ttcttctgcctcagcctacc

SEQ ID NO: 54149 - DNA, 20 bp, Artificial Sequence
  chemically synthesized
ttctgcctcagcctaccgag

SEQ ID NO: 54150 - DNA, 20 bp, Artificial Sequence
  chemically synthesized
gcctcagcctaccgagtagc

SEQ ID NO: 54151 - DNA, 20 bp, Artificial Sequence
  chemically synthesized
cctcagcctaccgagtagct

SEQ ID NO: 54152 - DNA, 20 bp, Artificial Sequence
  chemically synthesized
ctaccgagtagctgggacta

SEQ ID NO: 54153 - DNA, 20 bp, Artificial Sequence
  chemically synthesized
taccgagtagctgggactac

SEQ ID NO: 54154 - DNA, 20 bp, Artificial Sequence
  chemically synthesized
caggcacgtgccaccacacc

SEQ ID NO: 54155 - DNA, 20 bp, Artificial Sequence
  chemically synthesized
ctggctaatttttttatttt

SEQ ID NO: 54156 - DNA, 20 bp, Artificial Sequence
  chemically synthesized
gctaatttttttatttttag

SEQ ID NO: 54157 - DNA, 20 bp, Artificial Sequence
  chemically synthesized
taatttttttatttttagta

SEQ ID NO: 54158 - DNA, 20 bp, Artificial Sequence
  chemically synthesized
ttttttatttttagtagaga

SEQ ID NO: 54159 - DNA, 20 bp, Artificial Sequence
  chemically synthesized
tttttatttttagtagagat

SEQ ID NO: 54160 - DNA, 20 bp, Artificial Sequence
  chemically synthesized
ttttatttttagtagagatg

SEQ ID NO: 54161 - DNA, 20 bp, Artificial Sequence
  chemically synthesized
gagatggggtttcaccatat

SEQ ID NO: 54162 - DNA, 20 bp, Artificial Sequence
  chemically synthesized
tggggtttcaccatattggc

SEQ ID NO: 54163 - DNA, 20 bp, Artificial Sequence
  chemically synthesized
ggggtttcaccatattggcc

SEQ ID NO: 54164 - DNA, 20 bp, Artificial Sequence
  chemically synthesized
tttcaccatattggccaggc

SEQ ID NO: 54165 - DNA, 20 bp, Artificial Sequence
  chemically synthesized
ctggtcttgaactcctgacc

SEQ ID NO: 54166 - DNA, 20 bp, Artificial Sequence
  chemically synthesized
acctagtgatccatccgcct

SEQ ID NO: 54167 - DNA, 20 bp, Artificial Sequence
  chemically synthesized
ccatccgcctcagcctccca

SEQ ID NO: 54168 - DNA, 20 bp, Artificial Sequence
  chemically synthesized
gcctcagcctcccaaagtgc

SEQ ID NO: 54169 - DNA, 20 bp, Artificial Sequence
  chemically synthesized
cctcagcctcccaaagtgct

SEQ ID NO: 54170 - DNA, 20 bp, Artificial Sequence
  chemically synthesized
ctcccaaagtgctgggattg

SEQ ID NO: 54171 - DNA, 20 bp, Artificial Sequence
  chemically synthesized
tcccaaagtgctgggattgc

SEQ ID NO: 54172 - DNA, 20 bp, Artificial Sequence
  chemically synthesized
agtgctgggattgcaggcat

SEQ ID NO: 54173 - DNA, 20 bp, Artificial Sequence
  chemically synthesized
caggcatgagccaccgcgcc

SEQ ID NO: 54174 - DNA, 20 bp, Artificial Sequence
  chemically synthesized
ggcctttttttttttttttt

SEQ ID NO: 54175 - DNA, 20 bp, Artificial Sequence
  chemically synthesized
ttttttttttttttttgaga

SEQ ID NO: 54176 - DNA, 20 bp, Artificial Sequence
  chemically synthesized
ttttttttttttttgagacg

SEQ ID NO: 54177 - DNA, 20 bp, Artificial Sequence
  chemically synthesized
ggagttttgctcttgttgcc

SEQ ID NO: 54178 - DNA, 20 bp, Artificial Sequence
  chemically synthesized
gagttttgctcttgttgccc

SEQ ID NO: 54179 - DNA, 20 bp, Artificial Sequence
  chemically synthesized
tttgctcttgttgcccaggc

SEQ ID NO: 54180 - DNA, 20 bp, Artificial Sequence
  chemically synthesized
tgctcttgttgcccaggcta

SEQ ID NO: 54181 - DNA, 20 bp, Artificial Sequence
  chemically synthesized
ttgttgcccaggctagagtg

SEQ ID NO: 54182 - DNA, 20 bp, Artificial Sequence
  chemically synthesized
ttgcccaggctagagtgcag

SEQ ID NO: 54183 - DNA, 20 bp, Artificial Sequence
  chemically synthesized
caggctagagtgcagtggcg

SEQ ID NO: 54184 - DNA, 20 bp, Artificial Sequence
  chemically synthesized
agagtgcagtggcgcagtct

SEQ ID NO: 54185 - DNA, 20 bp, Artificial Sequence
  chemically synthesized
cactgtaacctccacctcct

SEQ ID NO: 54186 - DNA, 20 bp, Artificial Sequence
  chemically synthesized
aacctccacctcctgagttc

SEQ ID NO: 54187 - DNA, 20 bp, Artificial Sequence
  chemically synthesized
ttcaagcaattctcctgcct

SEQ ID NO: 54188 - DNA, 20 bp, Artificial Sequence
  chemically synthesized
tcctgcctcagcctctcaaa

SEQ ID NO: 54189 - DNA, 20 bp, Artificial Sequence
  chemically synthesized
gcctcagcctctcaaatagc

SEQ ID NO: 54190 - DNA, 20 bp, Artificial Sequence
  chemically synthesized
cctcagcctctcaaatagct

SEQ ID NO: 54191 - DNA, 20 bp, Artificial Sequence
  chemically synthesized
ctctcaaatagctgggatta

SEQ ID NO: 54192 - DNA, 20 bp, Artificial Sequence
  chemically synthesized
tctcaaatagctgggattac

SEQ ID NO: 54193 - DNA, 20 bp, Artificial Sequence
  chemically synthesized
atagctgggattacaggcgt

SEQ ID NO: 54194 - DNA, 20 bp, Artificial Sequence
  chemically synthesized
caggcgtgagccaccccacc

SEQ ID NO: 54195 - DNA, 20 bp, Artificial Sequence
  chemically synthesized
taattttgtaattttttttt

SEQ ID NO: 54196 - DNA, 20 bp, Artificial Sequence
  chemically synthesized
ttttgtaattttttttttag

SEQ ID NO: 54197 - DNA, 20 bp, Artificial Sequence
  chemically synthesized
ttgtaattttttttttagta

SEQ ID NO: 54198 - DNA, 20 bp, Artificial Sequence
  chemically synthesized
aattttttttttagtagaga

SEQ ID NO: 54199 - DNA, 20 bp, Artificial Sequence
  chemically synthesized
attttttttttagtagagat

SEQ ID NO: 54200 - DNA, 20 bp, Artificial Sequence
  chemically synthesized
ttttttttttagtagagatg

SEQ ID NO: 54201 - DNA, 20 bp, Artificial Sequence
  chemically synthesized
atggggtttcacctgttgat

SEQ ID NO: 54202 - DNA, 20 bp, Artificial Sequence
  chemically synthesized
tggggtttcacctgttgatc

SEQ ID NO: 54203 - DNA, 20 bp, Artificial Sequence
  chemically synthesized
gtttcacctgttgatcaggc

SEQ ID NO: 54204 - DNA, 20 bp, Artificial Sequence
  chemically synthesized
ggtctcaaactcctgacctc

SEQ ID NO: 54205 - DNA, 20 bp, Artificial Sequence
  chemically synthesized
ctcaagtgatccacccacct

SEQ ID NO: 54206 - DNA, 20 bp, Artificial Sequence
  chemically synthesized
ccacccacctcggcctccca

SEQ ID NO: 54207 - DNA, 20 bp, Artificial Sequence
  chemically synthesized
acctcggcctcccaaagtgc

SEQ ID NO: 54208 - DNA, 20 bp, Artificial Sequence
  chemically synthesized
cctcggcctcccaaagtgct

SEQ ID NO: 54209 - DNA, 20 bp, Artificial Sequence
  chemically synthesized
tcccaaagtgctgggattac

SEQ ID NO: 54210 - DNA, 20 bp, Artificial Sequence
  chemically synthesized
agtgctgggattacaagcat

SEQ ID NO: 54211 - DNA, 20 bp, Artificial Sequence
  chemically synthesized
caagcataagccaccgtgcc

SEQ ID NO: 54212 - DNA, 20 bp, Artificial Sequence
  chemically synthesized
gtcaattttgatctttttta

SEQ ID NO: 54213 - DNA, 20 bp, Artificial Sequence
  chemically synthesized
caattttgatcttttttaaa

SEQ ID NO: 54214 - DNA, 20 bp, Artificial Sequence
  chemically synthesized
tttgatcttttttaaagaga

SEQ ID NO: 54215 - DNA, 20 bp, Artificial Sequence
  chemically synthesized
ttgatcttttttaaagagac

SEQ ID NO: 54216 - DNA, 20 bp, Artificial Sequence
  chemically synthesized
tgatcttttttaaagagaca

SEQ ID NO: 54217 - DNA, 20 bp, Artificial Sequence
  chemically synthesized
gatcttttttaaagagacag

SEQ ID NO: 54218 - DNA, 20 bp, Artificial Sequence
  chemically synthesized
aggggtcttgctatgttgcc

SEQ ID NO: 54219 - DNA, 20 bp, Artificial Sequence
  chemically synthesized
tcttgctatgttgcccagac

SEQ ID NO: 54220 - DNA, 20 bp, Artificial Sequence
  chemically synthesized
ccagactagtcttgaactcc

SEQ ID NO: 54221 - DNA, 20 bp, Artificial Sequence
  chemically synthesized
agtcttgaactcctggcctc

SEQ ID NO: 54222 - DNA, 20 bp, Artificial Sequence
  chemically synthesized
ctcaagtgatcctctcacct

SEQ ID NO: 54223 - DNA, 20 bp, Artificial Sequence
  chemically synthesized
cctctcacctcggcctccca

SEQ ID NO: 54224 - DNA, 20 bp, Artificial Sequence
  chemically synthesized
acctcggcctcccaaagtat

SEQ ID NO: 54225 - DNA, 20 bp, Artificial Sequence
  chemically synthesized
cctcggcctcccaaagtatt

SEQ ID NO: 54226 - DNA, 20 bp, Artificial Sequence
  chemically synthesized
ctcccaaagtattgggatta

SEQ ID NO: 54227 - DNA, 20 bp, Artificial Sequence
  chemically synthesized
tcccaaagtattgggattac

SEQ ID NO: 54228 - DNA, 20 bp, Artificial Sequence
  chemically synthesized
agtattgggattacaggtct

SEQ ID NO: 54229 - DNA, 20 bp, Artificial Sequence
  chemically synthesized
caggtctgagccgctgcacc

SEQ ID NO: 54230 - DNA, 20 bp, Artificial Sequence
  chemically synthesized
ccgctgcacccagcccccaa

SEQ ID NO: 54231 - DNA, 20 bp, Artificial Sequence
  chemically synthesized
cgctgcacccagcccccaac

SEQ ID NO: 54232 - DNA, 20 bp, Artificial Sequence
  chemically synthesized
cagcccccaacaggcatctt

SEQ ID NO: 54233 - DNA, 20 bp, Artificial Sequence
  chemically synthesized
acaggcatctttggactttt

SEQ ID NO: 54234 - DNA, 20 bp, Artificial Sequence
  chemically synthesized
atctttggacttttgagtac

SEQ ID NO: 54235 - DNA, 20 bp, Artificial Sequence
  chemically synthesized
taatttacaaaaattccact

SEQ ID NO: 54236 - DNA, 20 bp, Artificial Sequence
  chemically synthesized
atttacaaaaattccactga

SEQ ID NO: 54237 - DNA, 20 bp, Artificial Sequence
  chemically synthesized
aaattccactgagagcacct

SEQ ID NO: 54238 - DNA, 20 bp, Artificial Sequence
  chemically synthesized
ctgagagcacctaagtttgc

SEQ ID NO: 54239 - DNA, 20 bp, Artificial Sequence
  chemically synthesized
tgagagcacctaagtttgcc

SEQ ID NO: 54240 - DNA, 20 bp, Artificial Sequence
  chemically synthesized
gccaggctccaacatttctg

SEQ ID NO: 54241 - DNA, 20 bp, Artificial Sequence
  chemically synthesized
ccaggctccaacatttctgc

SEQ ID NO: 54242 - DNA, 20 bp, Artificial Sequence
  chemically synthesized
caggctccaacatttctgca

SEQ ID NO: 54243 - DNA, 20 bp, Artificial Sequence
  chemically synthesized
aggctccaacatttctgcag

SEQ ID NO: 54244 - DNA, 20 bp, Artificial Sequence
  chemically synthesized
aggggctgttttctttgctg

SEQ ID NO: 54245 - DNA, 20 bp, Artificial Sequence
  chemically synthesized
ggggctgttttctttgctga

SEQ ID NO: 54246 - DNA, 20 bp, Artificial Sequence
  chemically synthesized
tctgcacctgtgttctgtta

SEQ ID NO: 54247 - DNA, 20 bp, Artificial Sequence
  chemically synthesized
tatggttgcctcttctgttg

SEQ ID NO: 54248 - DNA, 20 bp, Artificial Sequence
  chemically synthesized
atggttgcctcttctgttgc

SEQ ID NO: 54249 - DNA, 20 bp, Artificial Sequence
  chemically synthesized
ggtgcttgaatgtcattttg

SEQ ID NO: 54250 - DNA, 20 bp, Artificial Sequence
  chemically synthesized
cttgaatgtcattttgtggt

SEQ ID NO: 54251 - DNA, 20 bp, Artificial Sequence
  chemically synthesized
ttgaatgtcattttgtggtt

SEQ ID NO: 54252 - DNA, 20 bp, Artificial Sequence
  chemically synthesized
tcattttgtggttgggattc

SEQ ID NO: 54253 - DNA, 20 bp, Artificial Sequence
  chemically synthesized
cattttgtggttgggattct

SEQ ID NO: 54254 - DNA, 20 bp, Artificial Sequence
  chemically synthesized
ggttgggattctgggctgtg

SEQ ID NO: 54255 - DNA, 20 bp, Artificial Sequence
  chemically synthesized
tgctgctcattttcctcatc

SEQ ID NO: 54256 - DNA, 20 bp, Artificial Sequence
  chemically synthesized
tttcctcatcaagttgttgc

SEQ ID NO: 54257 - DNA, 20 bp, Artificial Sequence
  chemically synthesized
tcctcatcaagttgttgctg

SEQ ID NO: 54258 - DNA, 20 bp, Artificial Sequence
  chemically synthesized
agttgttgctggagtcctgt

SEQ ID NO: 54259 - DNA, 20 bp, Artificial Sequence
  chemically synthesized
gttgttgctggagtcctgtc

SEQ ID NO: 54260 - DNA, 20 bp, Artificial Sequence
  chemically synthesized
tgctggagtcctgtcaggta

SEQ ID NO: 54261 - DNA, 20 bp, Artificial Sequence
  chemically synthesized
gctggagtcctgtcaggtat

SEQ ID NO: 54262 - DNA, 20 bp, Artificial Sequence
  chemically synthesized
attccgtttctctccctaat

SEQ ID NO: 54263 - DNA, 20 bp, Artificial Sequence
  chemically synthesized
ttccgtttctctccctaatc

SEQ ID NO: 54264 - DNA, 20 bp, Artificial Sequence
  chemically synthesized
ccctaatcaggacaaaatcc

SEQ ID NO: 54265 - DNA, 20 bp, Artificial Sequence
  chemically synthesized
aggacaaaatcccagcattc

SEQ ID NO: 54266 - DNA, 20 bp, Artificial Sequence
  chemically synthesized
agccacatcctgtgtgtaat

SEQ ID NO: 54267 - DNA, 20 bp, Artificial Sequence
  chemically synthesized
ctgtgtgtaatcagtactgt

SEQ ID NO: 54268 - DNA, 20 bp, Artificial Sequence
  chemically synthesized
cagtactgttagcatttctg

SEQ ID NO: 54269 - DNA, 20 bp, Artificial Sequence
  chemically synthesized
agtactgttagcatttctgt

SEQ ID NO: 54270 - DNA, 20 bp, Artificial Sequence
  chemically synthesized
ttagcatttctgtgggttga

SEQ ID NO: 54271 - DNA, 20 bp, Artificial Sequence
  chemically synthesized
atttctgtgggttgaaagtc

SEQ ID NO: 54272 - DNA, 20 bp, Artificial Sequence
  chemically synthesized
gtgggttgaaagtcaagaat

SEQ ID NO: 54273 - DNA, 20 bp, Artificial Sequence
  chemically synthesized
ttgaaatgattaatttctat

SEQ ID NO: 54274 - DNA, 20 bp, Artificial Sequence
  chemically synthesized
gaaatgattaatttctataa

SEQ ID NO: 54275 - DNA, 20 bp, Artificial Sequence
  chemically synthesized
ttaatttctataagagtgcc

SEQ ID NO: 54276 - DNA, 20 bp, Artificial Sequence
  chemically synthesized
tataagagtgcccagatcta

SEQ ID NO: 54277 - DNA, 20 bp, Artificial Sequence
  chemically synthesized
gatctatagaatgaattgtg

SEQ ID NO: 54278 - DNA, 20 bp, Artificial Sequence
  chemically synthesized
ctatagaatgaattgtgtag

SEQ ID NO: 54279 - DNA, 20 bp, Artificial Sequence
  chemically synthesized
attaacgcaccaaattgaat

SEQ ID NO: 54280 - DNA, 20 bp, Artificial Sequence
  chemically synthesized
attgaattagcttgaaatct

SEQ ID NO: 54281 - DNA, 20 bp, Artificial Sequence
  chemically synthesized
tgaattagcttgaaatctca

SEQ ID NO: 54282 - DNA, 20 bp, Artificial Sequence
  chemically synthesized
ttacaatctttatttcttac

SEQ ID NO: 54283 - DNA, 20 bp, Artificial Sequence
  chemically synthesized
tatttcttactggtcttcaa

SEQ ID NO: 54284 - DNA, 20 bp, Artificial Sequence
  chemically synthesized
atttcttactggtcttcaac

SEQ ID NO: 54285 - DNA, 20 bp, Artificial Sequence
  chemically synthesized
acaggccctaatttactttt

SEQ ID NO: 54286 - DNA, 20 bp, Artificial Sequence
  chemically synthesized
caggccctaatttacttttc

SEQ ID NO: 54287 - DNA, 20 bp, Artificial Sequence
  chemically synthesized
aggccctaatttacttttca

SEQ ID NO: 54288 - DNA, 20 bp, Artificial Sequence
  chemically synthesized
aacaaattaacacgatgtcc

SEQ ID NO: 54289 - DNA, 20 bp, Artificial Sequence
  chemically synthesized
acaaattaacacgatgtcct

SEQ ID NO: 54290 - DNA, 20 bp, Artificial Sequence
  chemically synthesized
attaacacgatgtcctagga

SEQ ID NO: 54291 - DNA, 20 bp, Artificial Sequence
  chemically synthesized
acattcatttgcaaacctaa

SEQ ID NO: 54292 - DNA, 20 bp, Artificial Sequence
  chemically synthesized
gcaaacctaatagataactg

SEQ ID NO: 54293 - DNA, 20 bp, Artificial Sequence
  chemically synthesized
actgcagttgatctctttta

SEQ ID NO: 54294 - DNA, 20 bp, Artificial Sequence
  chemically synthesized
ctgcagttgatctcttttat

SEQ ID NO: 54295 - DNA, 20 bp, Artificial Sequence
  chemically synthesized
gttgatctcttttataggtt

SEQ ID NO: 54296 - DNA, 20 bp, Artificial Sequence
  chemically synthesized
tgatctcttttataggttca

SEQ ID NO: 54297 - DNA, 20 bp, Artificial Sequence
  chemically synthesized
tttttttgtttttttttttt

SEQ ID NO: 54298 - DNA, 20 bp, Artificial Sequence
  chemically synthesized
tttgttttttttttttgaga

SEQ ID NO: 54299 - DNA, 20 bp, Artificial Sequence
  chemically synthesized
tgttttttttttttgagatg

SEQ ID NO: 54300 - DNA, 20 bp, Artificial Sequence
  chemically synthesized
tggagtctcgctctgtgacc

SEQ ID NO: 54301 - DNA, 20 bp, Artificial Sequence
  chemically synthesized
ggagtctcgctctgtgaccc

SEQ ID NO: 54302 - DNA, 20 bp, Artificial Sequence
  chemically synthesized
tctcgctctgtgacccaggc

SEQ ID NO: 54303 - DNA, 20 bp, Artificial Sequence
  chemically synthesized
tcgctctgtgacccaggcta

SEQ ID NO: 54304 - DNA, 20 bp, Artificial Sequence
  chemically synthesized
ctgtgacccaggctagagtg

SEQ ID NO: 54305 - DNA, 20 bp, Artificial Sequence
  chemically synthesized
tgacccaggctagagtgcag

SEQ ID NO: 54306 - DNA, 20 bp, Artificial Sequence
  chemically synthesized
agagtgcagtggtgcgatct

SEQ ID NO: 54307 - DNA, 20 bp, Artificial Sequence
  chemically synthesized
gtgcgatctcggctcactgc

SEQ ID NO: 54308 - DNA, 20 bp, Artificial Sequence
  chemically synthesized
tcactgcaagctccacctcc

SEQ ID NO: 54309 - DNA, 20 bp, Artificial Sequence
  chemically synthesized
cactgcaagctccacctcct

SEQ ID NO: 54310 - DNA, 20 bp, Artificial Sequence
  chemically synthesized
ttcacgccattctcctgcct

SEQ ID NO: 54311 - DNA, 20 bp, Artificial Sequence
  chemically synthesized
tctcctgcctcagcctctcc

SEQ ID NO: 54312 - DNA, 20 bp, Artificial Sequence
  chemically synthesized
cctgcctcagcctctccgag

SEQ ID NO: 54313 - DNA, 20 bp, Artificial Sequence
  chemically synthesized
cctcagcctctccgagtagc

SEQ ID NO: 54314 - DNA, 20 bp, Artificial Sequence
  chemically synthesized
ctcagcctctccgagtagct

SEQ ID NO: 54315 - DNA, 20 bp, Artificial Sequence
  chemically synthesized
tctccgagtagctgggacta

SEQ ID NO: 54316 - DNA, 20 bp, Artificial Sequence
  chemically synthesized
ctccgagtagctgggactac

SEQ ID NO: 54317 - DNA, 20 bp, Artificial Sequence
  chemically synthesized
caggcgcccgccaccatgcc

SEQ ID NO: 54318 - DNA, 20 bp, Artificial Sequence
  chemically synthesized
cggctaattttttgtatttt

SEQ ID NO: 54319 - DNA, 20 bp, Artificial Sequence
  chemically synthesized
ctaattttttgtatttttag

SEQ ID NO: 54320 - DNA, 20 bp, Artificial Sequence
  chemically synthesized
aattttttgtatttttagca

SEQ ID NO: 54321 - DNA, 20 bp, Artificial Sequence
  chemically synthesized
ttttgtatttttagcagaga

SEQ ID NO: 54322 - DNA, 20 bp, Artificial Sequence
  chemically synthesized
tttgtatttttagcagagac

SEQ ID NO: 54323 - DNA, 20 bp, Artificial Sequence
  chemically synthesized
ttgtatttttagcagagacg

SEQ ID NO: 54324 - DNA, 20 bp, Artificial Sequence
  chemically synthesized
gcagagacggggtttcaccg

SEQ ID NO: 54325 - DNA, 20 bp, Artificial Sequence
  chemically synthesized
acctcgtgatccgcccgcct

SEQ ID NO: 54326 - DNA, 20 bp, Artificial Sequence
  chemically synthesized
ccgcccgcctcggcctccca

SEQ ID NO: 54327 - DNA, 20 bp, Artificial Sequence
  chemically synthesized
gcctcggcctcccaaagcgc

SEQ ID NO: 54328 - DNA, 20 bp, Artificial Sequence
  chemically synthesized
cctcggcctcccaaagcgct

SEQ ID NO: 54329 - DNA, 20 bp, Artificial Sequence
  chemically synthesized
tcccaaagcgctgggattac

SEQ ID NO: 54330 - DNA, 20 bp, Artificial Sequence
  chemically synthesized
cccaaagcgctgggattaca

SEQ ID NO: 54331 - DNA, 20 bp, Artificial Sequence
  chemically synthesized
ccaaagcgctgggattacaa

SEQ ID NO: 54332 - DNA, 20 bp, Artificial Sequence
  chemically synthesized
agcgctgggattacaagggt

SEQ ID NO: 54333 - DNA, 20 bp, Artificial Sequence
  chemically synthesized
tgcctgaatatgtgttttct

SEQ ID NO: 54334 - DNA, 20 bp, Artificial Sequence
  chemically synthesized
ttttcttagatccaattaac

SEQ ID NO: 54335 - DNA, 20 bp, Artificial Sequence
  chemically synthesized
tttcttagatccaattaaca

SEQ ID NO: 54336 - DNA, 20 bp, Artificial Sequence
  chemically synthesized
ttcttagatccaattaacaa

SEQ ID NO: 54337 - DNA, 20 bp, Artificial Sequence
  chemically synthesized
tagatccaattaacaagggt

SEQ ID NO: 54338 - DNA, 20 bp, Artificial Sequence
  chemically synthesized
ccaattaacaagggtaagac

SEQ ID NO: 54339 - DNA, 20 bp, Artificial Sequence
  chemically synthesized
acaagggtaagacaagattt

SEQ ID NO: 54340 - DNA, 20 bp, Artificial Sequence
  chemically synthesized
ggtaagacaagatttaagtt

SEQ ID NO: 54341 - DNA, 20 bp, Artificial Sequence
  chemically synthesized
acaagatttaagttaagcat

SEQ ID NO: 54342 - DNA, 20 bp, Artificial Sequence
  chemically synthesized
gatttaagttaagcataaga

SEQ ID NO: 54343 - DNA, 20 bp, Artificial Sequence
  chemically synthesized
taagcataagaaagattttg

SEQ ID NO: 54344 - DNA, 20 bp, Artificial Sequence
  chemically synthesized
aagcataagaaagattttgt

SEQ ID NO: 54345 - DNA, 20 bp, Artificial Sequence
  chemically synthesized
gcataagaaagattttgtgg

SEQ ID NO: 54346 - DNA, 20 bp, Artificial Sequence
  chemically synthesized
cataagaaagattttgtggg

SEQ ID NO: 54347 - DNA, 20 bp, Artificial Sequence
  chemically synthesized
aaagattttgtgggaggcac

SEQ ID NO: 54348 - DNA, 20 bp, Artificial Sequence
  chemically synthesized
tgtgggaggcactggaatat

SEQ ID NO: 54349 - DNA, 20 bp, Artificial Sequence
  chemically synthesized
ataagaccttaacaaaactg

SEQ ID NO: 54350 - DNA, 20 bp, Artificial Sequence
  chemically synthesized
aaactgtggaatttctcccc

SEQ ID NO: 54351 - DNA, 20 bp, Artificial Sequence
  chemically synthesized
actgtggaatttctcccctg

SEQ ID NO: 54352 - DNA, 20 bp, Artificial Sequence
  chemically synthesized
tttctcccctggagatttgt

SEQ ID NO: 54353 - DNA, 20 bp, Artificial Sequence
  chemically synthesized
cccctggagatttgtaagaa

SEQ ID NO: 54354 - DNA, 20 bp, Artificial Sequence
  chemically synthesized
agatttgtaagaacggaaca

SEQ ID NO: 54355 - DNA, 20 bp, Artificial Sequence
  chemically synthesized
tttgtaagaacggaacatag

SEQ ID NO: 54356 - DNA, 20 bp, Artificial Sequence
  chemically synthesized
acggaacatagcagcattca

SEQ ID NO: 54357 - DNA, 20 bp, Artificial Sequence
  chemically synthesized
gaacatagcagcattcaaag

SEQ ID NO: 54358 - DNA, 20 bp, Artificial Sequence
  chemically synthesized
agcattcaaagaagaatgtt

SEQ ID NO: 54359 - DNA, 20 bp, Artificial Sequence
  chemically synthesized
caaagaagaatgttgagaac

SEQ ID NO: 54360 - DNA, 20 bp, Artificial Sequence
  chemically synthesized
aaagaagaatgttgagaaca

SEQ ID NO: 54361 - DNA, 20 bp, Artificial Sequence
  chemically synthesized
aagaagaatgttgagaacaa

SEQ ID NO: 54362 - DNA, 20 bp, Artificial Sequence
  chemically synthesized
gaagaatgttgagaacaagg

SEQ ID NO: 54363 - DNA, 20 bp, Artificial Sequence
  chemically synthesized
gttgagaacaagggagataa

SEQ ID NO: 54364 - DNA, 20 bp, Artificial Sequence
  chemically synthesized
caagggagataatggtttca

SEQ ID NO: 54365 - DNA, 20 bp, Artificial Sequence
  chemically synthesized
tggtttcatggtaatcacaa

SEQ ID NO: 54366 - DNA, 20 bp, Artificial Sequence
  chemically synthesized
tggtaatcacaaaagtaaca

SEQ ID NO: 54367 - DNA, 20 bp, Artificial Sequence
  chemically synthesized
cacaaaagtaacacagcatt

SEQ ID NO: 54368 - DNA, 20 bp, Artificial Sequence
  chemically synthesized
agtaacacagcatttagtac

SEQ ID NO: 54369 - DNA, 20 bp, Artificial Sequence
  chemically synthesized
gtaacacagcatttagtact

SEQ ID NO: 54370 - DNA, 20 bp, Artificial Sequence
  chemically synthesized
tagtactgggttccatgttt

SEQ ID NO: 54371 - DNA, 20 bp, Artificial Sequence
  chemically synthesized
agtactgggttccatgtttg

SEQ ID NO: 54372 - DNA, 20 bp, Artificial Sequence
  chemically synthesized
actgggttccatgtttgagg

SEQ ID NO: 54373 - DNA, 20 bp, Artificial Sequence
  chemically synthesized
tccatgtttgaggaagaacc

SEQ ID NO: 54374 - DNA, 20 bp, Artificial Sequence
  chemically synthesized
atgtttgaggaagaacctgg

SEQ ID NO: 54375 - DNA, 20 bp, Artificial Sequence
  chemically synthesized
gccatatcacatgaaaaacc

SEQ ID NO: 54376 - DNA, 20 bp, Artificial Sequence
  chemically synthesized
ccatatcacatgaaaaacct

SEQ ID NO: 54377 - DNA, 20 bp, Artificial Sequence
  chemically synthesized
atgaaaaacctgggaatgtt

SEQ ID NO: 54378 - DNA, 20 bp, Artificial Sequence
  chemically synthesized
tgaaaaacctgggaatgttt

SEQ ID NO: 54379 - DNA, 20 bp, Artificial Sequence
  chemically synthesized
aaacctgggaatgtttaggt

SEQ ID NO: 54380 - DNA, 20 bp, Artificial Sequence
  chemically synthesized
acctgggaatgtttaggtta

SEQ ID NO: 54381 - DNA, 20 bp, Artificial Sequence
  chemically synthesized
ctgggaatgtttaggttaga

SEQ ID NO: 54382 - DNA, 20 bp, Artificial Sequence
  chemically synthesized
aactgtgttcaaatgtgtga

SEQ ID NO: 54383 - DNA, 20 bp, Artificial Sequence
  chemically synthesized
ctgtgttcaaatgtgtgaca

SEQ ID NO: 54384 - DNA, 20 bp, Artificial Sequence
  chemically synthesized
tgtgttcaaatgtgtgacag

SEQ ID NO: 54385 - DNA, 20 bp, Artificial Sequence
  chemically synthesized
gtgttcaaatgtgtgacaga

SEQ ID NO: 54386 - DNA, 20 bp, Artificial Sequence
  chemically synthesized
caaatgtgtgacagagggac

SEQ ID NO: 54387 - DNA, 20 bp, Artificial Sequence
  chemically synthesized
tcatcacttactaactcctg

SEQ ID NO: 54388 - DNA, 20 bp, Artificial Sequence
  chemically synthesized
cacttactaactcctgcaga

SEQ ID NO: 54389 - DNA, 20 bp, Artificial Sequence
  chemically synthesized
taactcctgcagaaagaact

SEQ ID NO: 54390 - DNA, 20 bp, Artificial Sequence
  chemically synthesized
gcagaaagaactgagaaaaa

SEQ ID NO: 54391 - DNA, 20 bp, Artificial Sequence
  chemically synthesized
aaagaactgagaaaaataga

SEQ ID NO: 54392 - DNA, 20 bp, Artificial Sequence
  chemically synthesized
ctgagaaaaatagacagtat

SEQ ID NO: 54393 - DNA, 20 bp, Artificial Sequence
  chemically synthesized
gagaaaaatagacagtatta

SEQ ID NO: 54394 - DNA, 20 bp, Artificial Sequence
  chemically synthesized
agaaaaatagacagtattag

SEQ ID NO: 54395 - DNA, 20 bp, Artificial Sequence
  chemically synthesized
gaaaaatagacagtattaga

SEQ ID NO: 54396 - DNA, 20 bp, Artificial Sequence
  chemically synthesized
aaaaatagacagtattagag

SEQ ID NO: 54397 - DNA, 20 bp, Artificial Sequence
  chemically synthesized
aaaatagacagtattagagg

SEQ ID NO: 54398 - DNA, 20 bp, Artificial Sequence
  chemically synthesized
agacagtattagagggggac

SEQ ID NO: 54399 - DNA, 20 bp, Artificial Sequence
  chemically synthesized
agagggggaccagtttcaca

SEQ ID NO: 54400 - DNA, 20 bp, Artificial Sequence
  chemically synthesized
gggaccagtttcacacagac

SEQ ID NO: 54401 - DNA, 20 bp, Artificial Sequence
  chemically synthesized
ggaccagtttcacacagaca

SEQ ID NO: 54402 - DNA, 20 bp, Artificial Sequence
  chemically synthesized
ccagtttcacacagacaagg

SEQ ID NO: 54403 - DNA, 20 bp, Artificial Sequence
  chemically synthesized
acagacaaggaagaactatt

SEQ ID NO: 54404 - DNA, 20 bp, Artificial Sequence
  chemically synthesized
tcagcaatcaattccgttca

SEQ ID NO: 54405 - DNA, 20 bp, Artificial Sequence
  chemically synthesized
aattccgttcaaagataaaa

SEQ ID NO: 54406 - DNA, 20 bp, Artificial Sequence
  chemically synthesized
aaagataaaatggactgtta

SEQ ID NO: 54407 - DNA, 20 bp, Artificial Sequence
  chemically synthesized
gataaaatggactgttatag

SEQ ID NO: 54408 - DNA, 20 bp, Artificial Sequence
  chemically synthesized
ataaaatggactgttatagt

SEQ ID NO: 54409 - DNA, 20 bp, Artificial Sequence
  chemically synthesized
taaaatggactgttatagtg

SEQ ID NO: 54410 - DNA, 20 bp, Artificial Sequence
  chemically synthesized
aaaatggactgttatagtgg

SEQ ID NO: 54411 - DNA, 20 bp, Artificial Sequence
  chemically synthesized
tggactgttatagtgggggt

SEQ ID NO: 54412 - DNA, 20 bp, Artificial Sequence
  chemically synthesized
ggggtgagctccctacctct

SEQ ID NO: 54413 - DNA, 20 bp, Artificial Sequence
  chemically synthesized
gggtgagctccctacctctg

SEQ ID NO: 54414 - DNA, 20 bp, Artificial Sequence
  chemically synthesized
ggtgagctccctacctctga

SEQ ID NO: 54415 - DNA, 20 bp, Artificial Sequence
  chemically synthesized
cctacctctgagggtatttc

SEQ ID NO: 54416 - DNA, 20 bp, Artificial Sequence
  chemically synthesized
acctctgagggtatttcaag

SEQ ID NO: 54417 - DNA, 20 bp, Artificial Sequence
  chemically synthesized
ctctgagggtatttcaagta

SEQ ID NO: 54418 - DNA, 20 bp, Artificial Sequence
  chemically synthesized
gagggtatttcaagtagaga

SEQ ID NO: 54419 - DNA, 20 bp, Artificial Sequence
  chemically synthesized
agggtatttcaagtagagat

SEQ ID NO: 54420 - DNA, 20 bp, Artificial Sequence
  chemically synthesized
ggtatttcaagtagagatag

SEQ ID NO: 54421 - DNA, 20 bp, Artificial Sequence
  chemically synthesized
gtatttcaagtagagatagg

SEQ ID NO: 54422 - DNA, 20 bp, Artificial Sequence
  chemically synthesized
gtagagataggaggacctcc

SEQ ID NO: 54423 - DNA, 20 bp, Artificial Sequence
  chemically synthesized
gagataggaggacctcctgg

SEQ ID NO: 54424 - DNA, 20 bp, Artificial Sequence
  chemically synthesized
agataggaggacctcctggt

SEQ ID NO: 54425 - DNA, 20 bp, Artificial Sequence
  chemically synthesized
cctggtaggaaatttgcata

SEQ ID NO: 54426 - DNA, 20 bp, Artificial Sequence
  chemically synthesized
ggtaggaaatttgcatacgg

SEQ ID NO: 54427 - DNA, 20 bp, Artificial Sequence
  chemically synthesized
gtaggaaatttgcatacggt

SEQ ID NO: 54428 - DNA, 20 bp, Artificial Sequence
  chemically synthesized
aggaaatttgcatacggtgg

SEQ ID NO: 54429 - DNA, 20 bp, Artificial Sequence
  chemically synthesized
gtgggagattgtacgtgata

SEQ ID NO: 54430 - DNA, 20 bp, Artificial Sequence
  chemically synthesized
gatatggcacctccatctga

SEQ ID NO: 54431 - DNA, 20 bp, Artificial Sequence
  chemically synthesized
tatggcacctccatctgaaa

SEQ ID NO: 54432 - DNA, 20 bp, Artificial Sequence
  chemically synthesized
catctgaaagagtctatatt

SEQ ID NO: 54433 - DNA, 20 bp, Artificial Sequence
  chemically synthesized
atctgaaagagtctatattg

SEQ ID NO: 54434 - DNA, 20 bp, Artificial Sequence
  chemically synthesized
tctgaaagagtctatattga

SEQ ID NO: 54435 - DNA, 20 bp, Artificial Sequence
  chemically synthesized
gaaagagtctatattgaggg

SEQ ID NO: 54436 - DNA, 20 bp, Artificial Sequence
  chemically synthesized
aaagagtctatattgagggc

SEQ ID NO: 54437 - DNA, 20 bp, Artificial Sequence
  chemically synthesized
agtctatattgagggcaggc

SEQ ID NO: 54438 - DNA, 20 bp, Artificial Sequence
  chemically synthesized
tctatattgagggcaggctg

SEQ ID NO: 54439 - DNA, 20 bp, Artificial Sequence
  chemically synthesized
gggcaggctggagtcacaca

SEQ ID NO: 54440 - DNA, 20 bp, Artificial Sequence
  chemically synthesized
ggcaggctggagtcacacat

SEQ ID NO: 54441 - DNA, 20 bp, Artificial Sequence
  chemically synthesized
ctggagtcacacatgggaat

SEQ ID NO: 54442 - DNA, 20 bp, Artificial Sequence
  chemically synthesized
agtcacacatgggaataagc

SEQ ID NO: 54443 - DNA, 20 bp, Artificial Sequence
  chemically synthesized
gtcacacatgggaataagcc

SEQ ID NO: 54444 - DNA, 20 bp, Artificial Sequence
  chemically synthesized
ccatctgtgatttaattcca

SEQ ID NO: 54445 - DNA, 20 bp, Artificial Sequence
  chemically synthesized
gtgatttaattccacagtcg

SEQ ID NO: 54446 - DNA, 20 bp, Artificial Sequence
  chemically synthesized
ttaattccacagtcgcagaa

SEQ ID NO: 54447 - DNA, 20 bp, Artificial Sequence
  chemically synthesized
ttccacagtcgcagaacgga

SEQ ID NO: 54448 - DNA, 20 bp, Artificial Sequence
  chemically synthesized
cactcctccaaacccacctc

SEQ ID NO: 54449 - DNA, 20 bp, Artificial Sequence
  chemically synthesized
ctccaaacccacctctagca

SEQ ID NO: 54450 - DNA, 20 bp, Artificial Sequence
  chemically synthesized
tccaaacccacctctagcaa

SEQ ID NO: 54451 - DNA, 20 bp, Artificial Sequence
  chemically synthesized
caaatccttcctatctctca

SEQ ID NO: 54452 - DNA, 20 bp, Artificial Sequence
  chemically synthesized
cagtcatgctttcttccact

SEQ ID NO: 54453 - DNA, 20 bp, Artificial Sequence
  chemically synthesized
agtcatgctttcttccactc

SEQ ID NO: 54454 - DNA, 20 bp, Artificial Sequence
  chemically synthesized
ccactcaggcattgctgttg

SEQ ID NO: 54455 - DNA, 20 bp, Artificial Sequence
  chemically synthesized
attgctgttgcagaaacttt

SEQ ID NO: 54456 - DNA, 20 bp, Artificial Sequence
  chemically synthesized
gaaactttcagccacatcca

SEQ ID NO: 54457 - DNA, 20 bp, Artificial Sequence
  chemically synthesized
atccacagcatctataatgc

SEQ ID NO: 54458 - DNA, 20 bp, Artificial Sequence
  chemically synthesized
gcatctataatgccagcctc

SEQ ID NO: 54459 - DNA, 20 bp, Artificial Sequence
  chemically synthesized
ctcattaccttcttcctgtt

SEQ ID NO: 54460 - DNA, 20 bp, Artificial Sequence
  chemically synthesized
ttcctgttcagcttcgccat

SEQ ID NO: 54461 - DNA, 20 bp, Artificial Sequence
  chemically synthesized
tcggattttatctgctgctc

SEQ ID NO: 54462 - DNA, 20 bp, Artificial Sequence
  chemically synthesized
cggattttatctgctgctca

SEQ ID NO: 54463 - DNA, 20 bp, Artificial Sequence
  chemically synthesized
ggattttatctgctgctcaa

SEQ ID NO: 54464 - DNA, 20 bp, Artificial Sequence
  chemically synthesized
ttatctgctgctcaagggac

SEQ ID NO: 54465 - DNA, 20 bp, Artificial Sequence
  chemically synthesized
tatctgctgctcaagggact

SEQ ID NO: 54466 - DNA, 20 bp, Artificial Sequence
  chemically synthesized
gctgctcaagggactgggtg

SEQ ID NO: 54467 - DNA, 20 bp, Artificial Sequence
  chemically synthesized
gactgggtgtagacctcctg

SEQ ID NO: 54468 - DNA, 20 bp, Artificial Sequence
  chemically synthesized
tgtagacctcctgtggactc

SEQ ID NO: 54469 - DNA, 20 bp, Artificial Sequence
  chemically synthesized
tagacctcctgtggactctg

SEQ ID NO: 54470 - DNA, 20 bp, Artificial Sequence
  chemically synthesized
cctcctgtggactctggaga

SEQ ID NO: 54471 - DNA, 20 bp, Artificial Sequence
  chemically synthesized
tgtggactctggagaaagcc

SEQ ID NO: 54472 - DNA, 20 bp, Artificial Sequence
  chemically synthesized
tggactctggagaaagccca

SEQ ID NO: 54473 - DNA, 20 bp, Artificial Sequence
  chemically synthesized
ggactctggagaaagcccag

SEQ ID NO: 54474 - DNA, 20 bp, Artificial Sequence
  chemically synthesized
ctctggagaaagcccagagg

SEQ ID NO: 54475 - DNA, 20 bp, Artificial Sequence
  chemically synthesized
agaaagcccagaggtggtgc

SEQ ID NO: 54476 - DNA, 20 bp, Artificial Sequence
  chemically synthesized
aagcccagaggtggtgcgag

SEQ ID NO: 54477 - DNA, 20 bp, Artificial Sequence
  chemically synthesized
ccagaggtggtgcgagcagc

SEQ ID NO: 54478 - DNA, 20 bp, Artificial Sequence
  chemically synthesized
ggtggtgcgagcagccagaa

SEQ ID NO: 54479 - DNA, 20 bp, Artificial Sequence
  chemically synthesized
gtggtgcgagcagccagaat

SEQ ID NO: 54480 - DNA, 20 bp, Artificial Sequence
  chemically synthesized
attgacaccacaccctttgc

SEQ ID NO: 54481 - DNA, 20 bp, Artificial Sequence
  chemically synthesized
caccctttgccagcctcctc

SEQ ID NO: 54482 - DNA, 20 bp, Artificial Sequence
  chemically synthesized
tgccagcctcctcaagaacc

SEQ ID NO: 54483 - DNA, 20 bp, Artificial Sequence
  chemically synthesized
gccagcctcctcaagaacct

SEQ ID NO: 54484 - DNA, 20 bp, Artificial Sequence
  chemically synthesized
aagaacctgggcacgctctt

SEQ ID NO: 54485 - DNA, 20 bp, Artificial Sequence
  chemically synthesized
cctgggcacgctctttggcc

SEQ ID NO: 54486 - DNA, 20 bp, Artificial Sequence
  chemically synthesized
ctgggcacgctctttggcct

SEQ ID NO: 54487 - DNA, 20 bp, Artificial Sequence
  chemically synthesized
tgggcacgctctttggcctg

SEQ ID NO: 54488 - DNA, 20 bp, Artificial Sequence
  chemically synthesized
cacgctctttggcctggggc

SEQ ID NO: 54489 - DNA, 20 bp, Artificial Sequence
  chemically synthesized
ctggggctggctctcaactc

SEQ ID NO: 54490 - DNA, 20 bp, Artificial Sequence
  chemically synthesized
gctctcaactccagcatgta

SEQ ID NO: 54491 - DNA, 20 bp, Artificial Sequence
  chemically synthesized
ctctcaactccagcatgtac

SEQ ID NO: 54492 - DNA, 20 bp, Artificial Sequence
  chemically synthesized
tctcaactccagcatgtaca

SEQ ID NO: 54493 - DNA, 20 bp, Artificial Sequence
  chemically synthesized
tcaactccagcatgtacagg

SEQ ID NO: 54494 - DNA, 20 bp, Artificial Sequence
  chemically synthesized
aactccagcatgtacaggga

SEQ ID NO: 54495 - DNA, 20 bp, Artificial Sequence
  chemically synthesized
gcatgtacagggagagctgc

SEQ ID NO: 54496 - DNA, 20 bp, Artificial Sequence
  chemically synthesized
catgtacagggagagctgca

SEQ ID NO: 54497 - DNA, 20 bp, Artificial Sequence
  chemically synthesized
atgtacagggagagctgcaa

SEQ ID NO: 54498 - DNA, 20 bp, Artificial Sequence
  chemically synthesized
tgtacagggagagctgcaag

SEQ ID NO: 54499 - DNA, 20 bp, Artificial Sequence
  chemically synthesized
gagagctgcaaggggaaact

SEQ ID NO: 54500 - DNA, 20 bp, Artificial Sequence
  chemically synthesized
gctgcaaggggaaactcagc

SEQ ID NO: 54501 - DNA, 20 bp, Artificial Sequence
  chemically synthesized
gcaaggggaaactcagcaag

SEQ ID NO: 54502 - DNA, 20 bp, Artificial Sequence
  chemically synthesized
aagtggctcccattccgcct

SEQ ID NO: 54503 - DNA, 20 bp, Artificial Sequence
  chemically synthesized
attccgcctcagctctattg

SEQ ID NO: 54504 - DNA, 20 bp, Artificial Sequence
  chemically synthesized
ctccttgaaacccccatccc

SEQ ID NO: 54505 - DNA, 20 bp, Artificial Sequence
  chemically synthesized
tgaaacccccatcccaagtc

SEQ ID NO: 54506 - DNA, 20 bp, Artificial Sequence
  chemically synthesized
acccccatcccaagtcgagc

SEQ ID NO: 54507 - DNA, 20 bp, Artificial Sequence
  chemically synthesized
tctacgtcttgtccttctgc

SEQ ID NO: 54508 - DNA, 20 bp, Artificial Sequence
  chemically synthesized
tacgtcttgtccttctgcaa

SEQ ID NO: 54509 - DNA, 20 bp, Artificial Sequence
  chemically synthesized
cttgtccttctgcaagagtg

SEQ ID NO: 54510 - DNA, 20 bp, Artificial Sequence
  chemically synthesized
gtccttctgcaagagtgcgg

SEQ ID NO: 54511 - DNA, 20 bp, Artificial Sequence
  chemically synthesized
caagagtgcggtagtgcccc

SEQ ID NO: 54512 - DNA, 20 bp, Artificial Sequence
  chemically synthesized
gtagtgcccctggcatccgt

SEQ ID NO: 54513 - DNA, 20 bp, Artificial Sequence
  chemically synthesized
tcatcccctactgcctcgcc

SEQ ID NO: 54514 - DNA, 20 bp, Artificial Sequence
  chemically synthesized
catcccctactgcctcgccc

SEQ ID NO: 54515 - DNA, 20 bp, Artificial Sequence
  chemically synthesized
ctactgcctcgcccaggtcc

SEQ ID NO: 54516 - DNA, 20 bp, Artificial Sequence
  chemically synthesized
tactgcctcgcccaggtcct

SEQ ID NO: 54517 - DNA, 20 bp, Artificial Sequence
  chemically synthesized
gcctcgcccaggtcctgggc

SEQ ID NO: 54518 - DNA, 20 bp, Artificial Sequence
  chemically synthesized
aggtcctgggccagccgcac

SEQ ID NO: 54519 - DNA, 20 bp, Artificial Sequence
  chemically synthesized
tcctgggccagccgcacaag

SEQ ID NO: 54520 - DNA, 20 bp, Artificial Sequence
  chemically synthesized
gccgcacaagaagtcgttgt

SEQ ID NO: 54521 - DNA, 20 bp, Artificial Sequence
  chemically synthesized
cgcacaagaagtcgttgtaa

SEQ ID NO: 54522 - DNA, 20 bp, Artificial Sequence
  chemically synthesized
agaagtcgttgtaagagatg

SEQ ID NO: 54523 - DNA, 20 bp, Artificial Sequence
  chemically synthesized
aagtcgttgtaagagatgtg

SEQ ID NO: 54524 - DNA, 20 bp, Artificial Sequence
  chemically synthesized
tgtaagagatgtggagtctt

SEQ ID NO: 54525 - DNA, 20 bp, Artificial Sequence
  chemically synthesized
tgtggagtcttcggtgttta

SEQ ID NO: 54526 - DNA, 20 bp, Artificial Sequence
  chemically synthesized
tttaaagtcaacaaccatgc

SEQ ID NO: 54527 - DNA, 20 bp, Artificial Sequence
  chemically synthesized
ttaaagtcaacaaccatgcc

SEQ ID NO: 54528 - DNA, 20 bp, Artificial Sequence
  chemically synthesized
taaagtcaacaaccatgcca

SEQ ID NO: 54529 - DNA, 20 bp, Artificial Sequence
  chemically synthesized
caacaaccatgccagggatt

SEQ ID NO: 54530 - DNA, 20 bp, Artificial Sequence
  chemically synthesized
aacaaccatgccagggattg

SEQ ID NO: 54531 - DNA, 20 bp, Artificial Sequence
  chemically synthesized
caaccatgccagggattgag

SEQ ID NO: 54532 - DNA, 20 bp, Artificial Sequence
  chemically synthesized
aaccatgccagggattgagg

SEQ ID NO: 54533 - DNA, 20 bp, Artificial Sequence
  chemically synthesized
ttgaggaggactactatttg

SEQ ID NO: 54534 - DNA, 20 bp, Artificial Sequence
  chemically synthesized
aggactactatttgaagcaa

SEQ ID NO: 54535 - DNA, 20 bp, Artificial Sequence
  chemically synthesized
ggactactatttgaagcaat

SEQ ID NO: 54536 - DNA, 20 bp, Artificial Sequence
  chemically synthesized
ctatttgaagcaatgggcac

SEQ ID NO: 54537 - DNA, 20 bp, Artificial Sequence
  chemically synthesized
aagcaatgggcactggtatt

SEQ ID NO: 54538 - DNA, 20 bp, Artificial Sequence
  chemically synthesized
gcaatgggcactggtatttg

SEQ ID NO: 54539 - DNA, 20 bp, Artificial Sequence
  chemically synthesized
tgggcactggtatttggagc

SEQ ID NO: 54540 - DNA, 20 bp, Artificial Sequence
  chemically synthesized
tgccatccattctgccgtcg

SEQ ID NO: 54541 - DNA, 20 bp, Artificial Sequence
  chemically synthesized
gccgtcgtggaattaaatca

SEQ ID NO: 54542 - DNA, 20 bp, Artificial Sequence
  chemically synthesized
tcgtggaattaaatcacgga

SEQ ID NO: 54543 - DNA, 20 bp, Artificial Sequence
  chemically synthesized
tggaattaaatcacggatgg

SEQ ID NO: 54544 - DNA, 20 bp, Artificial Sequence
  chemically synthesized
ttaaatcacggatggcagat

SEQ ID NO: 54545 - DNA, 20 bp, Artificial Sequence
  chemically synthesized
aaatcacggatggcagattg

SEQ ID NO: 54546 - DNA, 20 bp, Artificial Sequence
  chemically synthesized
aatcacggatggcagattgg

SEQ ID NO: 54547 - DNA, 20 bp, Artificial Sequence
  chemically synthesized
atcacggatggcagattgga

SEQ ID NO: 54548 - DNA, 20 bp, Artificial Sequence
  chemically synthesized
tggcagattggagggtcgcc

SEQ ID NO: 54549 - DNA, 20 bp, Artificial Sequence
  chemically synthesized
cttattcccatgtgtgactc

SEQ ID NO: 54550 - DNA, 20 bp, Artificial Sequence
  chemically synthesized
gtgtgactccagcctgccct

SEQ ID NO: 54551 - DNA, 20 bp, Artificial Sequence
  chemically synthesized
actccagcctgccctcagca

SEQ ID NO: 54552 - DNA, 20 bp, Artificial Sequence
  chemically synthesized
gccctcagcacagactcttt

SEQ ID NO: 54553 - DNA, 20 bp, Artificial Sequence
  chemically synthesized
tcagcacagactctttcaga

SEQ ID NO: 54554 - DNA, 20 bp, Artificial Sequence
  chemically synthesized
agcacagactctttcagatg

SEQ ID NO: 54555 - DNA, 20 bp, Artificial Sequence
  chemically synthesized
gcacagactctttcagatgg

SEQ ID NO: 54556 - DNA, 20 bp, Artificial Sequence
  chemically synthesized
atatcacgtacaccatatgc

SEQ ID NO: 54557 - DNA, 20 bp, Artificial Sequence
  chemically synthesized
accatatgcaagtttcccgc

SEQ ID NO: 54558 - DNA, 20 bp, Artificial Sequence
  chemically synthesized
ccatatgcaagtttcccgcc

SEQ ID NO: 54559 - DNA, 20 bp, Artificial Sequence
  chemically synthesized
atatgcaagtttcccgccag

SEQ ID NO: 54560 - DNA, 20 bp, Artificial Sequence
  chemically synthesized
tatgcaagtttcccgccagg

SEQ ID NO: 54561 - DNA, 20 bp, Artificial Sequence
  chemically synthesized
ctctacttgaatactctcac

SEQ ID NO: 54562 - DNA, 20 bp, Artificial Sequence
  chemically synthesized
tacttgaatactctcacaag

SEQ ID NO: 54563 - DNA, 20 bp, Artificial Sequence
  chemically synthesized
acttgaatactctcacaagt

SEQ ID NO: 54564 - DNA, 20 bp, Artificial Sequence
  chemically synthesized
cttgaatactctcacaagta

SEQ ID NO: 54565 - DNA, 20 bp, Artificial Sequence
  chemically synthesized
tgaatactctcacaagtagg

SEQ ID NO: 54566 - DNA, 20 bp, Artificial Sequence
  chemically synthesized
agtagggagctcactcccac

SEQ ID NO: 54567 - DNA, 20 bp, Artificial Sequence
  chemically synthesized
ggagctcactcccactggaa

SEQ ID NO: 54568 - DNA, 20 bp, Artificial Sequence
  chemically synthesized
cagcccattttatctttgaa

SEQ ID NO: 54569 - DNA, 20 bp, Artificial Sequence
  chemically synthesized
atctttgaatggtcttctgc

SEQ ID NO: 54570 - DNA, 20 bp, Artificial Sequence
  chemically synthesized
gtcttctgccagcccatttt

SEQ ID NO: 54571 - DNA, 20 bp, Artificial Sequence
  chemically synthesized
tcttctgccagcccattttg

SEQ ID NO: 54572 - DNA, 20 bp, Artificial Sequence
  chemically synthesized
ctgccagcccattttgaggc

SEQ ID NO: 54573 - DNA, 20 bp, Artificial Sequence
  chemically synthesized
gccagcccattttgaggcca

SEQ ID NO: 54574 - DNA, 20 bp, Artificial Sequence
  chemically synthesized
ccagcccattttgaggccag

SEQ ID NO: 54575 - DNA, 20 bp, Artificial Sequence
  chemically synthesized
tttgaggccagaggtgctgt

SEQ ID NO: 54576 - DNA, 20 bp, Artificial Sequence
  chemically synthesized
ggccagaggtgctgtcagct

SEQ ID NO: 54577 - DNA, 20 bp, Artificial Sequence
  chemically synthesized
gccagaggtgctgtcagctc

SEQ ID NO: 54578 - DNA, 20 bp, Artificial Sequence
  chemically synthesized
agaggtgctgtcagctcagg

SEQ ID NO: 54579 - DNA, 20 bp, Artificial Sequence
  chemically synthesized
ttttacaatcctaatcatat

SEQ ID NO: 54580 - DNA, 20 bp, Artificial Sequence
  chemically synthesized
tttacaatcctaatcatatt

SEQ ID NO: 54581 - DNA, 20 bp, Artificial Sequence
  chemically synthesized
tattgggtaatgtttttgaa

SEQ ID NO: 54582 - DNA, 20 bp, Artificial Sequence
  chemically synthesized
atgtttttgaaaagctaatg

SEQ ID NO: 54583 - DNA, 20 bp, Artificial Sequence
  chemically synthesized
gaaaagctaatgaagctatt

SEQ ID NO: 54584 - DNA, 20 bp, Artificial Sequence
  chemically synthesized
agctaatgaagctattgaga

SEQ ID NO: 54585 - DNA, 20 bp, Artificial Sequence
  chemically synthesized
tattgagaaagacctgttgc

SEQ ID NO: 54586 - DNA, 20 bp, Artificial Sequence
  chemically synthesized
tgagaaagacctgttgctag

SEQ ID NO: 54587 - DNA, 20 bp, Artificial Sequence
  chemically synthesized
aaagacctgttgctagaagt

SEQ ID NO: 54588 - DNA, 20 bp, Artificial Sequence
  chemically synthesized
aagacctgttgctagaagtt

SEQ ID NO: 54589 - DNA, 20 bp, Artificial Sequence
  chemically synthesized
tgctagaagttgggttgttc

SEQ ID NO: 54590 - DNA, 20 bp, Artificial Sequence
  chemically synthesized
ttgttctggattttcccctg

SEQ ID NO: 54591 - DNA, 20 bp, Artificial Sequence
  chemically synthesized
ttcttccgtcacatatacaa

SEQ ID NO: 54592 - DNA, 20 bp, Artificial Sequence
  chemically synthesized
tccgtcacatatacaaaagc

SEQ ID NO: 54593 - DNA, 20 bp, Artificial Sequence
  chemically synthesized
atatacaaaagcaagacttc

SEQ ID NO: 54594 - DNA, 20 bp, Artificial Sequence
  chemically synthesized
tatacaaaagcaagacttcc

SEQ ID NO: 54595 - DNA, 20 bp, Artificial Sequence
  chemically synthesized
acaaaagcaagacttccagg

SEQ ID NO: 54596 - DNA, 20 bp, Artificial Sequence
  chemically synthesized
caaaagcaagacttccaggt

SEQ ID NO: 54597 - DNA, 20 bp, Artificial Sequence
  chemically synthesized
aaaagcaagacttccaggta

SEQ ID NO: 54598 - DNA, 20 bp, Artificial Sequence
  chemically synthesized
gcaagacttccaggtagggc

SEQ ID NO: 54599 - DNA, 20 bp, Artificial Sequence
  chemically synthesized
tccaggtagggccagctcac

SEQ ID NO: 54600 - DNA, 20 bp, Artificial Sequence
  chemically synthesized
gtagggccagctcacaagcc

SEQ ID NO: 54601 - DNA, 20 bp, Artificial Sequence
  chemically synthesized
tagggccagctcacaagccc

SEQ ID NO: 54602 - DNA, 20 bp, Artificial Sequence
  chemically synthesized
gccagctcacaagcccaggc

SEQ ID NO: 54603 - DNA, 20 bp, Artificial Sequence
  chemically synthesized
cagctcacaagcccaggctg

SEQ ID NO: 54604 - DNA, 20 bp, Artificial Sequence
  chemically synthesized
ccaggctggagatcctaact

SEQ ID NO: 54605 - DNA, 20 bp, Artificial Sequence
  chemically synthesized
tacctgtgttcattcttacc

SEQ ID NO: 54606 - DNA, 20 bp, Artificial Sequence
  chemically synthesized
gtgttcattcttaccgagaa

SEQ ID NO: 54607 - DNA, 20 bp, Artificial Sequence
  chemically synthesized
tgttcattcttaccgagaaa

SEQ ID NO: 54608 - DNA, 20 bp, Artificial Sequence
  chemically synthesized
ttcattcttaccgagaaaag

SEQ ID NO: 54609 - DNA, 20 bp, Artificial Sequence
  chemically synthesized
ttcttaccgagaaaaggaga

SEQ ID NO: 54610 - DNA, 20 bp, Artificial Sequence
  chemically synthesized
tcttaccgagaaaaggagaa

SEQ ID NO: 54611 - DNA, 20 bp, Artificial Sequence
  chemically synthesized
ttaccgagaaaaggagaaag

SEQ ID NO: 54612 - DNA, 20 bp, Artificial Sequence
  chemically synthesized
gaaaggagctctgaatctga

SEQ ID NO: 54613 - DNA, 20 bp, Artificial Sequence
  chemically synthesized
aaaggagctctgaatctgat

SEQ ID NO: 54614 - DNA, 20 bp, Artificial Sequence
  chemically synthesized
agctctgaatctgataggaa

SEQ ID NO: 54615 - DNA, 20 bp, Artificial Sequence
  chemically synthesized
tctgaatctgataggaaaag

SEQ ID NO: 54616 - DNA, 20 bp, Artificial Sequence
  chemically synthesized
ctgaatctgataggaaaaga

SEQ ID NO: 54617 - DNA, 20 bp, Artificial Sequence
  chemically synthesized
ataggaaaagaaggctgcct

SEQ ID NO: 54618 - DNA, 20 bp, Artificial Sequence
  chemically synthesized
taggaaaagaaggctgccta

SEQ ID NO: 54619 - DNA, 20 bp, Artificial Sequence
  chemically synthesized
ggaaaagaaggctgcctaag

SEQ ID NO: 54620 - DNA, 20 bp, Artificial Sequence
  chemically synthesized
gaaaagaaggctgcctaagg

SEQ ID NO: 54621 - DNA, 20 bp, Artificial Sequence
  chemically synthesized
aaagaaggctgcctaaggag

SEQ ID NO: 54622 - DNA, 20 bp, Artificial Sequence
  chemically synthesized
gctgcctaaggaggagtttt

SEQ ID NO: 54623 - DNA, 20 bp, Artificial Sequence
  chemically synthesized
aaggaggagtttttagtatg

SEQ ID NO: 54624 - DNA, 20 bp, Artificial Sequence
  chemically synthesized
tagtatgtggcgtatcatgc

SEQ ID NO: 54625 - DNA, 20 bp, Artificial Sequence
  chemically synthesized
tatcatgcaagtgctatgcc

SEQ ID NO: 54626 - DNA, 20 bp, Artificial Sequence
  chemically synthesized
tatgccaagccatgtctaaa

SEQ ID NO: 54627 - DNA, 20 bp, Artificial Sequence
  chemically synthesized
tctaaatggctttaattata

SEQ ID NO: 54628 - DNA, 20 bp, Artificial Sequence
  chemically synthesized
attatatagtaatgcactct

SEQ ID NO: 54629 - DNA, 20 bp, Artificial Sequence
  chemically synthesized
tagtaatgcactctcagtaa

SEQ ID NO: 54630 - DNA, 20 bp, Artificial Sequence
  chemically synthesized
agtaatgcactctcagtaat

SEQ ID NO: 54631 - DNA, 20 bp, Artificial Sequence
  chemically synthesized
gtaatgcactctcagtaatg

SEQ ID NO: 54632 - DNA, 20 bp, Artificial Sequence
  chemically synthesized
taatgcactctcagtaatgg

SEQ ID NO: 54633 - DNA, 20 bp, Artificial Sequence
  chemically synthesized
cactctcagtaatgggggac

SEQ ID NO: 54634 - DNA, 20 bp, Artificial Sequence
  chemically synthesized
cagtaatgggggaccagctt

SEQ ID NO: 54635 - DNA, 20 bp, Artificial Sequence
  chemically synthesized
accagcttaagtataattaa

SEQ ID NO: 54636 - DNA, 20 bp, Artificial Sequence
  chemically synthesized
gcttaagtataattaataga

SEQ ID NO: 54637 - DNA, 20 bp, Artificial Sequence
  chemically synthesized
aagtataattaatagatggt

SEQ ID NO: 54638 - DNA, 20 bp, Artificial Sequence
  chemically synthesized
tataattaatagatggttag

SEQ ID NO: 54639 - DNA, 20 bp, Artificial Sequence
  chemically synthesized
ataattaatagatggttagt

SEQ ID NO: 54640 - DNA, 20 bp, Artificial Sequence
  chemically synthesized
taattaatagatggttagtg

SEQ ID NO: 54641 - DNA, 20 bp, Artificial Sequence
  chemically synthesized
tagtggggtaattctgcttc

SEQ ID NO: 54642 - DNA, 20 bp, Artificial Sequence
  chemically synthesized
acatgttcatcgtatttcct

SEQ ID NO: 54643 - DNA, 20 bp, Artificial Sequence
  chemically synthesized
tatttccttggatttctgaa

SEQ ID NO: 54644 - DNA, 20 bp, Artificial Sequence
  chemically synthesized
cttggatttctgaatggctg

SEQ ID NO: 54645 - DNA, 20 bp, Artificial Sequence
  chemically synthesized
tctgaatggctgcagtgacc

SEQ ID NO: 54646 - DNA, 20 bp, Artificial Sequence
  chemically synthesized
cagtgacccagatattgcac

SEQ ID NO: 54647 - DNA, 20 bp, Artificial Sequence
  chemically synthesized
agtgacccagatattgcact

SEQ ID NO: 54648 - DNA, 20 bp, Artificial Sequence
  chemically synthesized
ttgcactaggtcaaaacatt

SEQ ID NO: 54649 - DNA, 20 bp, Artificial Sequence
  chemically synthesized
tgcactaggtcaaaacattc

SEQ ID NO: 54650 - DNA, 20 bp, Artificial Sequence
  chemically synthesized
taggtcaaaacattcaggta

SEQ ID NO: 54651 - DNA, 20 bp, Artificial Sequence
  chemically synthesized
cattacatcatcctccttat

SEQ ID NO: 54652 - DNA, 20 bp, Artificial Sequence
  chemically synthesized
catcatcctccttataagcc

SEQ ID NO: 54653 - DNA, 20 bp, Artificial Sequence
  chemically synthesized
aagcccagctctgctttttc

SEQ ID NO: 54654 - DNA, 20 bp, Artificial Sequence
  chemically synthesized
ctttttccagattcttccac

SEQ ID NO: 54655 - DNA, 20 bp, Artificial Sequence
  chemically synthesized
tggctccacatccaccccac

SEQ ID NO: 54656 - DNA, 20 bp, Artificial Sequence
  chemically synthesized
catccaccccactggatctt

SEQ ID NO: 54657 - DNA, 20 bp, Artificial Sequence
  chemically synthesized
ccaccccactggatcttcag

SEQ ID NO: 54658 - DNA, 20 bp, Artificial Sequence
  chemically synthesized
caccccactggatcttcaga

SEQ ID NO: 54659 - DNA, 20 bp, Artificial Sequence
  chemically synthesized
ccactggatcttcagaaggc

SEQ ID NO: 54660 - DNA, 20 bp, Artificial Sequence
  chemically synthesized
actggatcttcagaaggcta

SEQ ID NO: 54661 - DNA, 20 bp, Artificial Sequence
  chemically synthesized
ctggatcttcagaaggctag

SEQ ID NO: 54662 - DNA, 20 bp, Artificial Sequence
  chemically synthesized
tggatcttcagaaggctaga

SEQ ID NO: 54663 - DNA, 20 bp, Artificial Sequence
  chemically synthesized
agaaggctagagggcgactc

SEQ ID NO: 54664 - DNA, 20 bp, Artificial Sequence
  chemically synthesized
aggctagagggcgactctgg

SEQ ID NO: 54665 - DNA, 20 bp, Artificial Sequence
  chemically synthesized
gtgcttttgtatgtttcaat

SEQ ID NO: 54666 - DNA, 20 bp, Artificial Sequence
  chemically synthesized
tgcttttgtatgtttcaatt

SEQ ID NO: 54667 - DNA, 20 bp, Artificial Sequence
  chemically synthesized
tcaattaggctctgaaatct

SEQ ID NO: 54668 - DNA, 20 bp, Artificial Sequence
  chemically synthesized
caattaggctctgaaatctt

SEQ ID NO: 54669 - DNA, 20 bp, Artificial Sequence
  chemically synthesized
gaaatcttgggcaaaatgac

SEQ ID NO: 54670 - DNA, 20 bp, Artificial Sequence
  chemically synthesized
aaatcttgggcaaaatgaca

SEQ ID NO: 54671 - DNA, 20 bp, Artificial Sequence
  chemically synthesized
aatcttgggcaaaatgacaa

SEQ ID NO: 54672 - DNA, 20 bp, Artificial Sequence
  chemically synthesized
atcttgggcaaaatgacaag

SEQ ID NO: 54673 - DNA, 20 bp, Artificial Sequence
  chemically synthesized
cttgggcaaaatgacaaggg

SEQ ID NO: 54674 - DNA, 20 bp, Artificial Sequence
  chemically synthesized
ttgggcaaaatgacaagggg

SEQ ID NO: 54675 - DNA, 20 bp, Artificial Sequence
  chemically synthesized
tgggcaaaatgacaagggga

SEQ ID NO: 54676 - DNA, 20 bp, Artificial Sequence
  chemically synthesized
caaaatgacaaggggagggc

SEQ ID NO: 54677 - DNA, 20 bp, Artificial Sequence
  chemically synthesized
aaaatgacaaggggagggcc

SEQ ID NO: 54678 - DNA, 20 bp, Artificial Sequence
  chemically synthesized
gagggccaggattcctctct

SEQ ID NO: 54679 - DNA, 20 bp, Artificial Sequence
  chemically synthesized
agggccaggattcctctctc

SEQ ID NO: 54680 - DNA, 20 bp, Artificial Sequence
  chemically synthesized
attcctctctcaggtcactc

SEQ ID NO: 54681 - DNA, 20 bp, Artificial Sequence
  chemically synthesized
ccagtgttacttttaattcc

SEQ ID NO: 54682 - DNA, 20 bp, Artificial Sequence
  chemically synthesized
agtgttacttttaattccta

SEQ ID NO: 54683 - DNA, 20 bp, Artificial Sequence
  chemically synthesized
gtgttacttttaattcctag

SEQ ID NO: 54684 - DNA, 20 bp, Artificial Sequence
  chemically synthesized
tgttacttttaattcctaga

SEQ ID NO: 54685 - DNA, 20 bp, Artificial Sequence
  chemically synthesized
atgactcctttctctatccc

SEQ ID NO: 54686 - DNA, 20 bp, Artificial Sequence
  chemically synthesized
ttctctatcccaagccaacc

SEQ ID NO: 54687 - DNA, 20 bp, Artificial Sequence
  chemically synthesized
ctctatcccaagccaaccaa

SEQ ID NO: 54688 - DNA, 20 bp, Artificial Sequence
  chemically synthesized
caaccaagagcacattctta

SEQ ID NO: 54689 - DNA, 20 bp, Artificial Sequence
  chemically synthesized
aaccaagagcacattcttaa

SEQ ID NO: 54690 - DNA, 20 bp, Artificial Sequence
  chemically synthesized
agagcacattcttaaaggaa

SEQ ID NO: 54691 - DNA, 20 bp, Artificial Sequence
  chemically synthesized
ctctcttttttttttttttt

SEQ ID NO: 54692 - DNA, 20 bp, Artificial Sequence
  chemically synthesized
ctttttttttttttttgaga

SEQ ID NO: 54693 - DNA, 20 bp, Artificial Sequence
  chemically synthesized
tttttttttttttttgagac

SEQ ID NO: 54694 - DNA, 20 bp, Artificial Sequence
  chemically synthesized
ttttttttttttttgagaca

SEQ ID NO: 54695 - DNA, 20 bp, Artificial Sequence
  chemically synthesized
cagggtctcactatgttgcc

SEQ ID NO: 54696 - DNA, 20 bp, Artificial Sequence
  chemically synthesized
agggtctcactatgttgccc

SEQ ID NO: 54697 - DNA, 20 bp, Artificial Sequence
  chemically synthesized
ccaggctgctcttgaattcc

SEQ ID NO: 54698 - DNA, 20 bp, Artificial Sequence
  chemically synthesized
caggctgctcttgaattcct

SEQ ID NO: 54699 - DNA, 20 bp, Artificial Sequence
  chemically synthesized
gctcttgaattcctgggctc

SEQ ID NO: 54700 - DNA, 20 bp, Artificial Sequence
  chemically synthesized
cttgaattcctgggctcaag

SEQ ID NO: 54701 - DNA, 20 bp, Artificial Sequence
  chemically synthesized
gcagtcctcccaccctacca

SEQ ID NO: 54702 - DNA, 20 bp, Artificial Sequence
  chemically synthesized
ccctaccacagcgtcccgcg

SEQ ID NO: 54703 - DNA, 20 bp, Artificial Sequence
  chemically synthesized
accacagcgtcccgcgtagc

SEQ ID NO: 54704 - DNA, 20 bp, Artificial Sequence
  chemically synthesized
ccacagcgtcccgcgtagct

SEQ ID NO: 54705 - DNA, 20 bp, Artificial Sequence
  chemically synthesized
gtcccgcgtagctgggacta

SEQ ID NO: 54706 - DNA, 20 bp, Artificial Sequence
  chemically synthesized
tcccgcgtagctgggactac

SEQ ID NO: 54707 - DNA, 20 bp, Artificial Sequence
  chemically synthesized
gtagctgggactacaggtgc

SEQ ID NO: 54708 - DNA, 20 bp, Artificial Sequence
  chemically synthesized
caggtgcaagccactatgtc

SEQ ID NO: 54709 - DNA, 20 bp, Artificial Sequence
  chemically synthesized
tgcaagccactatgtccagc

SEQ ID NO: 54710 - DNA, 20 bp, Artificial Sequence
  chemically synthesized
ttctttttttttcttttttt

SEQ ID NO: 54711 - DNA, 20 bp, Artificial Sequence
  chemically synthesized
ttttttttctttttttgaga

SEQ ID NO: 54712 - DNA, 20 bp, Artificial Sequence
  chemically synthesized
gagacggcgcacctatcacc

SEQ ID NO: 54713 - DNA, 20 bp, Artificial Sequence
  chemically synthesized
agacggcgcacctatcaccc

SEQ ID NO: 54714 - DNA, 20 bp, Artificial Sequence
  chemically synthesized
ggcgcacctatcacccaggc

SEQ ID NO: 54715 - DNA, 20 bp, Artificial Sequence
  chemically synthesized
cgcacctatcacccaggctg

SEQ ID NO: 54716 - DNA, 20 bp, Artificial Sequence
  chemically synthesized
acctatcacccaggctggag

SEQ ID NO: 54717 - DNA, 20 bp, Artificial Sequence
  chemically synthesized
ctatcacccaggctggagtg

SEQ ID NO: 54718 - DNA, 20 bp, Artificial Sequence
  chemically synthesized
tcacccaggctggagtggag

SEQ ID NO: 54719 - DNA, 20 bp, Artificial Sequence
  chemically synthesized
ggagtggagtggcacgatct

SEQ ID NO: 54720 - DNA, 20 bp, Artificial Sequence
  chemically synthesized
tcactgcaacctcttcctcc

SEQ ID NO: 54721 - DNA, 20 bp, Artificial Sequence
  chemically synthesized
caacctcttcctcctggttc

SEQ ID NO: 54722 - DNA, 20 bp, Artificial Sequence
  chemically synthesized
ttcaagcgattctcatgtct

SEQ ID NO: 54723 - DNA, 20 bp, Artificial Sequence
  chemically synthesized
ttctcatgtctcagcctcct

SEQ ID NO: 54724 - DNA, 20 bp, Artificial Sequence
  chemically synthesized
tcatgtctcagcctcctcag

SEQ ID NO: 54725 - DNA, 20 bp, Artificial Sequence
  chemically synthesized
gtctcagcctcctcagtagc

SEQ ID NO: 54726 - DNA, 20 bp, Artificial Sequence
  chemically synthesized
tctcagcctcctcagtagct

SEQ ID NO: 54727 - DNA, 20 bp, Artificial Sequence
  chemically synthesized
tcctcagtagctaggactac

SEQ ID NO: 54728 - DNA, 20 bp, Artificial Sequence
  chemically synthesized
accggcgtgcaccaccatgc

SEQ ID NO: 54729 - DNA, 20 bp, Artificial Sequence
  chemically synthesized
ccggcgtgcaccaccatgcc

SEQ ID NO: 54730 - DNA, 20 bp, Artificial Sequence
  chemically synthesized
caggctaatttttatatttt

SEQ ID NO: 54731 - DNA, 20 bp, Artificial Sequence
  chemically synthesized
tttttatatttttagaattt

SEQ ID NO: 54732 - DNA, 20 bp, Artificial Sequence
  chemically synthesized
ttatatttttagaattttag

SEQ ID NO: 54733 - DNA, 20 bp, Artificial Sequence
  chemically synthesized
atatttttagaattttagaa

SEQ ID NO: 54734 - DNA, 20 bp, Artificial Sequence
  chemically synthesized
ttttagaattttagaagaga

SEQ ID NO: 54735 - DNA, 20 bp, Artificial Sequence
  chemically synthesized
tttagaattttagaagagat

SEQ ID NO: 54736 - DNA, 20 bp, Artificial Sequence
  chemically synthesized
gagatgggatttcatcatgt

SEQ ID NO: 54737 - DNA, 20 bp, Artificial Sequence
  chemically synthesized
tgggatttcatcatgttggc

SEQ ID NO: 54738 - DNA, 20 bp, Artificial Sequence
  chemically synthesized
gggatttcatcatgttggcc

SEQ ID NO: 54739 - DNA, 20 bp, Artificial Sequence
  chemically synthesized
tttcatcatgttggccaggc

SEQ ID NO: 54740 - DNA, 20 bp, Artificial Sequence
  chemically synthesized
ggtctcgaactcctgacctc

SEQ ID NO: 54741 - DNA, 20 bp, Artificial Sequence
  chemically synthesized
ctcaagtgatccacctgcct

SEQ ID NO: 54742 - DNA, 20 bp, Artificial Sequence
  chemically synthesized
tccacctgccttggcctccc

SEQ ID NO: 54743 - DNA, 20 bp, Artificial Sequence
  chemically synthesized
ccacctgccttggcctccca

SEQ ID NO: 54744 - DNA, 20 bp, Artificial Sequence
  chemically synthesized
gccttggcctcccaaggtgc

SEQ ID NO: 54745 - DNA, 20 bp, Artificial Sequence
  chemically synthesized
ccttggcctcccaaggtgct

SEQ ID NO: 54746 - DNA, 20 bp, Artificial Sequence
  chemically synthesized
ctcccaaggtgctaggatta

SEQ ID NO: 54747 - DNA, 20 bp, Artificial Sequence
  chemically synthesized
tcccaaggtgctaggattac

SEQ ID NO: 54748 - DNA, 20 bp, Artificial Sequence
  chemically synthesized
ggtgctaggattacaggcat

SEQ ID NO: 54749 - DNA, 20 bp, Artificial Sequence
  chemically synthesized
acaggcatgagccaccgcac

SEQ ID NO: 54750 - DNA, 20 bp, Artificial Sequence
  chemically synthesized
caggcatgagccaccgcacc

SEQ ID NO: 54751 - DNA, 20 bp, Artificial Sequence
  chemically synthesized
tttcaatctcatctgatatg

SEQ ID NO: 54752 - DNA, 20 bp, Artificial Sequence
  chemically synthesized
tcaatctcatctgatatgca

SEQ ID NO: 54753 - DNA, 20 bp, Artificial Sequence
  chemically synthesized
acccacctaccccccaaaaa

SEQ ID NO: 54754 - DNA, 20 bp, Artificial Sequence
  chemically synthesized
ctaccccccaaaaaaagctg

SEQ ID NO: 54755 - DNA, 20 bp, Artificial Sequence
  chemically synthesized
gctgaagcctatttatttga

SEQ ID NO: 54756 - DNA, 20 bp, Artificial Sequence
  chemically synthesized
tgtttttgctactaattata

SEQ ID NO: 54757 - DNA, 20 bp, Artificial Sequence
  chemically synthesized
ctgctcataacatctttgaa

SEQ ID NO: 54758 - DNA, 20 bp, Artificial Sequence
  chemically synthesized
aaaagaaaaatatatatgtg

SEQ ID NO: 54759 - DNA, 20 bp, Artificial Sequence
  chemically synthesized
atatgtgcagtattttatta

SEQ ID NO: 54760 - DNA, 20 bp, Artificial Sequence
  chemically synthesized
attaaagcaacattttattt

SEQ ID NO: 54761 - DNA, 20 bp, Artificial Sequence
  chemically synthesized
caacattttatttaagaata

SEQ ID NO: 54762 - DNA, 20 bp, Artificial Sequence
  chemically synthesized
tcttgttaattactatattt

SEQ ID NO: 54763 - DNA, 20 bp, Artificial Sequence
  chemically synthesized
tttagatgcaatgtgatctg

SEQ ID NO: 54764 - DNA, 20 bp, Artificial Sequence
  chemically synthesized
tgatctgaagtttctaattc

SEQ ID NO: 54765 - DNA, 20 bp, Artificial Sequence
  chemically synthesized
ttctggcccaactaaatttc

SEQ ID NO: 54766 - DNA, 20 bp, Artificial Sequence
  chemically synthesized
gtttccctaaacaaataatt

SEQ ID NO: 54767 - DNA, 20 bp, Artificial Sequence
  chemically synthesized
ctgtgcctgcattttccctt

SEQ ID NO: 54768 - DNA, 20 bp, Artificial Sequence
  chemically synthesized
gtgcctgcattttccctttg

SEQ ID NO: 54769 - DNA, 20 bp, Artificial Sequence
  chemically synthesized
cctgcattttccctttggag

SEQ ID NO: 54770 - DNA, 20 bp, Artificial Sequence
  chemically synthesized
attttccctttggagaagaa

SEQ ID NO: 54771 - DNA, 20 bp, Artificial Sequence
  chemically synthesized
gaagaaaagtgctctctctt

SEQ ID NO: 54772 - DNA, 20 bp, Artificial Sequence
  chemically synthesized
tgctctctcttgagttgacc

SEQ ID NO: 54773 - DNA, 20 bp, Artificial Sequence
  chemically synthesized
ctctctcttgagttgaccga

SEQ ID NO: 54774 - DNA, 20 bp, Artificial Sequence
  chemically synthesized
gagttgaccgagagtcccat

SEQ ID NO: 54775 - DNA, 20 bp, Artificial Sequence
  chemically synthesized
agttgaccgagagtcccatt

SEQ ID NO: 54776 - DNA, 20 bp, Artificial Sequence
  chemically synthesized
gttgaccgagagtcccatta

SEQ ID NO: 54777 - DNA, 20 bp, Artificial Sequence
  chemically synthesized
accgagagtcccattaggga

SEQ ID NO: 54778 - DNA, 20 bp, Artificial Sequence
  chemically synthesized
ccgagagtcccattagggat

SEQ ID NO: 54779 - DNA, 20 bp, Artificial Sequence
  chemically synthesized
cgagagtcccattagggata

SEQ ID NO: 54780 - DNA, 20 bp, Artificial Sequence
  chemically synthesized
agagtcccattagggatagg

SEQ ID NO: 54781 - DNA, 20 bp, Artificial Sequence
  chemically synthesized
gggagacttaaatgcatcca

SEQ ID NO: 54782 - DNA, 20 bp, Artificial Sequence
  chemically synthesized
ggagacttaaatgcatccac

SEQ ID NO: 54783 - DNA, 20 bp, Artificial Sequence
  chemically synthesized
gagacttaaatgcatccaca

SEQ ID NO: 54784 - DNA, 20 bp, Artificial Sequence
  chemically synthesized
agacttaaatgcatccacag

SEQ ID NO: 54785 - DNA, 20 bp, Artificial Sequence
  chemically synthesized
taaatgcatccacaggggca

SEQ ID NO: 54786 - DNA, 20 bp, Artificial Sequence
  chemically synthesized
aaatgcatccacaggggcac

SEQ ID NO: 54787 - DNA, 20 bp, Artificial Sequence
  chemically synthesized
tgcatccacaggggcacagg

SEQ ID NO: 54788 - DNA, 20 bp, Artificial Sequence
  chemically synthesized
catccacaggggcacaggca

SEQ ID NO: 54789 - DNA, 20 bp, Artificial Sequence
  chemically synthesized
acaggggcacaggcagagtt

SEQ ID NO: 54790 - DNA, 20 bp, Artificial Sequence
  chemically synthesized
ggcagagttgagcacataaa

SEQ ID NO: 54791 - DNA, 20 bp, Artificial Sequence
  chemically synthesized
cagagttgagcacataaacg

SEQ ID NO: 54792 - DNA, 20 bp, Artificial Sequence
  chemically synthesized
agagttgagcacataaacgg

SEQ ID NO: 54793 - DNA, 20 bp, Artificial Sequence
  chemically synthesized
cataaacggaggcccaaaat

SEQ ID NO: 54794 - DNA, 20 bp, Artificial Sequence
  chemically synthesized
acggaggcccaaaatcagca

SEQ ID NO: 54795 - DNA, 20 bp, Artificial Sequence
  chemically synthesized
gcccaaaatcagcatagaac

SEQ ID NO: 54796 - DNA, 20 bp, Artificial Sequence
  chemically synthesized
aaaatcagcatagaaccaga

SEQ ID NO: 54797 - DNA, 20 bp, Artificial Sequence
  chemically synthesized
agcatagaaccagaaagatt

SEQ ID NO: 54798 - DNA, 20 bp, Artificial Sequence
  chemically synthesized
catagaaccagaaagattca

SEQ ID NO: 54799 - DNA, 20 bp, Artificial Sequence
  chemically synthesized
gaaccagaaagattcagagt

SEQ ID NO: 54800 - DNA, 20 bp, Artificial Sequence
  chemically synthesized
agaaagattcagagttggcc

SEQ ID NO: 54801 - DNA, 20 bp, Artificial Sequence
  chemically synthesized
agttggccaagaatgaacat

SEQ ID NO: 54802 - DNA, 20 bp, Artificial Sequence
  chemically synthesized
caagaatgaacattggctac

SEQ ID NO: 54803 - DNA, 20 bp, Artificial Sequence
  chemically synthesized
aacattggctaccagaccac

SEQ ID NO: 54804 - DNA, 20 bp, Artificial Sequence
  chemically synthesized
ttggctaccagaccacaagt

SEQ ID NO: 54805 - DNA, 20 bp, Artificial Sequence
  chemically synthesized
accagaccacaagtcagcat

SEQ ID NO: 54806 - DNA, 20 bp, Artificial Sequence
  chemically synthesized
agtcagcatgagttgctcta

SEQ ID NO: 54807 - DNA, 20 bp, Artificial Sequence
  chemically synthesized
atggcatcaaattgcaactt

SEQ ID NO: 54808 - DNA, 20 bp, Artificial Sequence
  chemically synthesized
ggcatcaaattgcaacttga

SEQ ID NO: 54809 - DNA, 20 bp, Artificial Sequence
  chemically synthesized
atcaaattgcaacttgagag

SEQ ID NO: 54810 - DNA, 20 bp, Artificial Sequence
  chemically synthesized
aattgcaacttgagagtaga

SEQ ID NO: 54811 - DNA, 20 bp, Artificial Sequence
  chemically synthesized
attgcaacttgagagtagat

SEQ ID NO: 54812 - DNA, 20 bp, Artificial Sequence
  chemically synthesized
gcaacttgagagtagatggg

SEQ ID NO: 54813 - DNA, 20 bp, Artificial Sequence
  chemically synthesized
caacttgagagtagatgggc

SEQ ID NO: 54814 - DNA, 20 bp, Artificial Sequence
  chemically synthesized
aacttgagagtagatgggca

SEQ ID NO: 54815 - DNA, 20 bp, Artificial Sequence
  chemically synthesized
ggcagggtcactatcaaatt

SEQ ID NO: 54816 - DNA, 20 bp, Artificial Sequence
  chemically synthesized
tcactatcaaattaagcaat

SEQ ID NO: 54817 - DNA, 20 bp, Artificial Sequence
  chemically synthesized
cactatcaaattaagcaatc

SEQ ID NO: 54818 - DNA, 20 bp, Artificial Sequence
  chemically synthesized
actatcaaattaagcaatca

SEQ ID NO: 54819 - DNA, 20 bp, Artificial Sequence
  chemically synthesized
attaagcaatcagggcacac

SEQ ID NO: 54820 - DNA, 20 bp, Artificial Sequence
  chemically synthesized
caatcagggcacacaagttg

SEQ ID NO: 54821 - DNA, 20 bp, Artificial Sequence
  chemically synthesized
acaagttgcagtaacacaac

SEQ ID NO: 54822 - DNA, 20 bp, Artificial Sequence
  chemically synthesized
ttgcagtaacacaacaagac

SEQ ID NO: 54823 - DNA, 20 bp, Artificial Sequence
  chemically synthesized
tgcagtaacacaacaagact

SEQ ID NO: 54824 - DNA, 20 bp, Artificial Sequence
  chemically synthesized
gtaacacaacaagactaggc

SEQ ID NO: 54825 - DNA, 20 bp, Artificial Sequence
  chemically synthesized
caacaagactaggccagctc

SEQ ID NO: 54826 - DNA, 20 bp, Artificial Sequence
  chemically synthesized
actaggccagctctggaatc

SEQ ID NO: 54827 - DNA, 20 bp, Artificial Sequence
  chemically synthesized
agctctggaatccagtaact

SEQ ID NO: 54828 - DNA, 20 bp, Artificial Sequence
  chemically synthesized
ggaatccagtaactcagtgt

SEQ ID NO: 54829 - DNA, 20 bp, Artificial Sequence
  chemically synthesized
tccagtaactcagtgtcagc

SEQ ID NO: 54830 - DNA, 20 bp, Artificial Sequence
  chemically synthesized
ccagtaactcagtgtcagca

SEQ ID NO: 54831 - DNA, 20 bp, Artificial Sequence
  chemically synthesized
actcagtgtcagcaaggttt

SEQ ID NO: 54832 - DNA, 20 bp, Artificial Sequence
  chemically synthesized
ctcagtgtcagcaaggtttt

SEQ ID NO: 54833 - DNA, 20 bp, Artificial Sequence
  chemically synthesized
gtcagcaaggttttgggtta

SEQ ID NO: 54834 - DNA, 20 bp, Artificial Sequence
  chemically synthesized
aaggttttgggttatagttc

SEQ ID NO: 54835 - DNA, 20 bp, Artificial Sequence
  chemically synthesized
ttttgggttatagttcaaga

SEQ ID NO: 54836 - DNA, 20 bp, Artificial Sequence
  chemically synthesized
atagttcaagaaagtctaaa

SEQ ID NO: 54837 - DNA, 20 bp, Artificial Sequence
  chemically synthesized
agttcaagaaagtctaaaca

SEQ ID NO: 54838 - DNA, 20 bp, Artificial Sequence
  chemically synthesized
caagaaagtctaaacagagc

SEQ ID NO: 54839 - DNA, 20 bp, Artificial Sequence
  chemically synthesized
agtctaaacagagccagtca

SEQ ID NO: 54840 - DNA, 20 bp, Artificial Sequence
  chemically synthesized
acagagccagtcacagcacc

SEQ ID NO: 54841 - DNA, 20 bp, Artificial Sequence
  chemically synthesized
cagagccagtcacagcacca

SEQ ID NO: 54842 - DNA, 20 bp, Artificial Sequence
  chemically synthesized
cacagcaccaaggaatgctc

SEQ ID NO: 54843 - DNA, 20 bp, Artificial Sequence
  chemically synthesized
acagcaccaaggaatgctca

SEQ ID NO: 54844 - DNA, 20 bp, Artificial Sequence
  chemically synthesized
cagcaccaaggaatgctcaa

SEQ ID NO: 54845 - DNA, 20 bp, Artificial Sequence
  chemically synthesized
gcaccaaggaatgctcaagg

SEQ ID NO: 54846 - DNA, 20 bp, Artificial Sequence
  chemically synthesized
aatgctcaagggagctattg

SEQ ID NO: 54847 - DNA, 20 bp, Artificial Sequence
  chemically synthesized
atgctcaagggagctattgc

SEQ ID NO: 54848 - DNA, 20 bp, Artificial Sequence
  chemically synthesized
ctattgcaggtttctctgct

SEQ ID NO: 54849 - DNA, 20 bp, Artificial Sequence
  chemically synthesized
attgcaggtttctctgctaa

SEQ ID NO: 54850 - DNA, 20 bp, Artificial Sequence
  chemically synthesized
ctaagagatttatttcatcc

SEQ ID NO: 54851 - DNA, 20 bp, Artificial Sequence
  chemically synthesized
taagagatttatttcatcct

SEQ ID NO: 54852 - DNA, 20 bp, Artificial Sequence
  chemically synthesized
gatttatttcatcctgggtg

SEQ ID NO: 54853 - DNA, 20 bp, Artificial Sequence
  chemically synthesized
atttatttcatcctgggtgc

SEQ ID NO: 54854 - DNA, 20 bp, Artificial Sequence
  chemically synthesized
tttatttcatcctgggtgca

SEQ ID NO: 54855 - DNA, 20 bp, Artificial Sequence
  chemically synthesized
ggtgcagggttcgacctcca

SEQ ID NO: 54856 - DNA, 20 bp, Artificial Sequence
  chemically synthesized
gtgcagggttcgacctccaa

SEQ ID NO: 54857 - DNA, 20 bp, Artificial Sequence
  chemically synthesized
tcaaatcatcaccgtatcaa

SEQ ID NO: 54858 - DNA, 20 bp, Artificial Sequence
  chemically synthesized
accgtatcaatggatttcct

SEQ ID NO: 54859 - DNA, 20 bp, Artificial Sequence
  chemically synthesized
ccgtatcaatggatttcctg

SEQ ID NO: 54860 - DNA, 20 bp, Artificial Sequence
  chemically synthesized
cgtatcaatggatttcctga

SEQ ID NO: 54861 - DNA, 20 bp, Artificial Sequence
  chemically synthesized
tcaatggatttcctgagggt

SEQ ID NO: 54862 - DNA, 20 bp, Artificial Sequence
  chemically synthesized
gctatttcacacctgaactc

SEQ ID NO: 54863 - DNA, 20 bp, Artificial Sequence
  chemically synthesized
tatttcacacctgaactccg

SEQ ID NO: 54864 - DNA, 20 bp, Artificial Sequence
  chemically synthesized
aactccggagtctgtatatt

SEQ ID NO: 54865 - DNA, 20 bp, Artificial Sequence
  chemically synthesized
actccggagtctgtatattc

SEQ ID NO: 54866 - DNA, 20 bp, Artificial Sequence
  chemically synthesized
ctccggagtctgtatattca

SEQ ID NO: 54867 - DNA, 20 bp, Artificial Sequence
  chemically synthesized
cggagtctgtatattcaggg

SEQ ID NO: 54868 - DNA, 20 bp, Artificial Sequence
  chemically synthesized
ggaagattgcattctcctac

SEQ ID NO: 54869 - DNA, 20 bp, Artificial Sequence
  chemically synthesized
ttgcattctcctactggatt

SEQ ID NO: 54870 - DNA, 20 bp, Artificial Sequence
  chemically synthesized
tgcattctcctactggattt

SEQ ID NO: 54871 - DNA, 20 bp, Artificial Sequence
  chemically synthesized
tcctactggatttgggctct

SEQ ID NO: 54872 - DNA, 20 bp, Artificial Sequence
  chemically synthesized
ctactggatttgggctctca

SEQ ID NO: 54873 - DNA, 20 bp, Artificial Sequence
  chemically synthesized
tactggatttgggctctcag

SEQ ID NO: 54874 - DNA, 20 bp, Artificial Sequence
  chemically synthesized
actggatttgggctctcaga

SEQ ID NO: 54875 - DNA, 20 bp, Artificial Sequence
  chemically synthesized
tgggctctcagagggcgttg

SEQ ID NO: 54876 - DNA, 20 bp, Artificial Sequence
  chemically synthesized
gggctctcagagggcgttgt

SEQ ID NO: 54877 - DNA, 20 bp, Artificial Sequence
  chemically synthesized
tcagagggcgttgtgggaac

SEQ ID NO: 54878 - DNA, 20 bp, Artificial Sequence
  chemically synthesized
cagagggcgttgtgggaacc

SEQ ID NO: 54879 - DNA, 20 bp, Artificial Sequence
  chemically synthesized
tgtgggaaccaggcccctca

SEQ ID NO: 54880 - DNA, 20 bp, Artificial Sequence
  chemically synthesized
aggcccctcacagaatcaaa

SEQ ID NO: 54881 - DNA, 20 bp, Artificial Sequence
  chemically synthesized
cagaatcaaatggtcccaac

SEQ ID NO: 54882 - DNA, 20 bp, Artificial Sequence
  chemically synthesized
agaatcaaatggtcccaacc

SEQ ID NO: 54883 - DNA, 20 bp, Artificial Sequence
  chemically synthesized
gaatcaaatggtcccaacca

SEQ ID NO: 54884 - DNA, 20 bp, Artificial Sequence
  chemically synthesized
atcaaatggtcccaaccagg

SEQ ID NO: 54885 - DNA, 20 bp, Artificial Sequence
  chemically synthesized
aatggtcccaaccagggaga

SEQ ID NO: 54886 - DNA, 20 bp, Artificial Sequence
  chemically synthesized
ccaaccagggagaaagaaaa

SEQ ID NO: 54887 - DNA, 20 bp, Artificial Sequence
  chemically synthesized
agtcttttttttttttttaa

SEQ ID NO: 54888 - DNA, 20 bp, Artificial Sequence
  chemically synthesized
tcttttttttttttttaata

SEQ ID NO: 54889 - DNA, 20 bp, Artificial Sequence
  chemically synthesized
ttttttttttttaatagaga

SEQ ID NO: 54890 - DNA, 20 bp, Artificial Sequence
  chemically synthesized
tttttttttttaatagagat

SEQ ID NO: 54891 - DNA, 20 bp, Artificial Sequence
  chemically synthesized
ttttttttttaatagagatg

SEQ ID NO: 54892 - DNA, 20 bp, Artificial Sequence
  chemically synthesized
tttttttttaatagagatgg

SEQ ID NO: 54893 - DNA, 20 bp, Artificial Sequence
  chemically synthesized
gggggtctcactatgctgcc

SEQ ID NO: 54894 - DNA, 20 bp, Artificial Sequence
  chemically synthesized
ggggtctcactatgctgccc

SEQ ID NO: 54895 - DNA, 20 bp, Artificial Sequence
  chemically synthesized
tctcactatgctgcccaggc

SEQ ID NO: 54896 - DNA, 20 bp, Artificial Sequence
  chemically synthesized
ccaggctggtcttgaactcc

SEQ ID NO: 54897 - DNA, 20 bp, Artificial Sequence
  chemically synthesized
caggctggtcttgaactcct

SEQ ID NO: 54898 - DNA, 20 bp, Artificial Sequence
  chemically synthesized
ggtcttgaactcctgggttc

SEQ ID NO: 54899 - DNA, 20 bp, Artificial Sequence
  chemically synthesized
ttcaagtgatcctcctgcct

SEQ ID NO: 54900 - DNA, 20 bp, Artificial Sequence
  chemically synthesized
cctcctgcctcagcctccca

SEQ ID NO: 54901 - DNA, 20 bp, Artificial Sequence
  chemically synthesized
gcctcagcctcccaaagtgc

SEQ ID NO: 54902 - DNA, 20 bp, Artificial Sequence
  chemically synthesized
cctcagcctcccaaagtgct

SEQ ID NO: 54903 - DNA, 20 bp, Artificial Sequence
  chemically synthesized
ctcccaaagtgctgggatta

SEQ ID NO: 54904 - DNA, 20 bp, Artificial Sequence
  chemically synthesized
aagtgctgggattacagtgt

SEQ ID NO: 54905 - DNA, 20 bp, Artificial Sequence
  chemically synthesized
acagtgtgagccactgcgct

SEQ ID NO: 54906 - DNA, 20 bp, Artificial Sequence
  chemically synthesized
tgtgagccactgcgcttggc

SEQ ID NO: 54907 - DNA, 20 bp, Artificial Sequence
  chemically synthesized
ccactgcgcttggccagaaa

SEQ ID NO: 54908 - DNA, 20 bp, Artificial Sequence
  chemically synthesized
ctgaactgaaccctactgct

SEQ ID NO: 54909 - DNA, 20 bp, Artificial Sequence
  chemically synthesized
tgaactgaaccctactgctt

SEQ ID NO: 54910 - DNA, 20 bp, Artificial Sequence
  chemically synthesized
tgaaccctactgcttaggca

SEQ ID NO: 54911 - DNA, 20 bp, Artificial Sequence
  chemically synthesized
ttgataatctatttgctccc

SEQ ID NO: 54912 - DNA, 20 bp, Artificial Sequence
  chemically synthesized
tgataatctatttgctccca

SEQ ID NO: 54913 - DNA, 20 bp, Artificial Sequence
  chemically synthesized
tctatttgctcccaaggacc

SEQ ID NO: 54914 - DNA, 20 bp, Artificial Sequence
  chemically synthesized
tgctcccaaggaccaagtcc

SEQ ID NO: 54915 - DNA, 20 bp, Artificial Sequence
  chemically synthesized
accaagtccaagatccttac

SEQ ID NO: 54916 - DNA, 20 bp, Artificial Sequence
  chemically synthesized
agtccaagatccttacaaga

SEQ ID NO: 54917 - DNA, 20 bp, Artificial Sequence
  chemically synthesized
gtccaagatccttacaagaa

SEQ ID NO: 54918 - DNA, 20 bp, Artificial Sequence
  chemically synthesized
tccttacaagaaaggtctgc

SEQ ID NO: 54919 - DNA, 20 bp, Artificial Sequence
  chemically synthesized
tacaagaaaggtctgccaga

SEQ ID NO: 54920 - DNA, 20 bp, Artificial Sequence
  chemically synthesized
aatactgcccccactccctg

SEQ ID NO: 54921 - DNA, 20 bp, Artificial Sequence
  chemically synthesized
ccccactccctgaagtttat

SEQ ID NO: 54922 - DNA, 20 bp, Artificial Sequence
  chemically synthesized
cccactccctgaagtttatg

SEQ ID NO: 54923 - DNA, 20 bp, Artificial Sequence
  chemically synthesized
ctgaagtttatgaggttgat

SEQ ID NO: 54924 - DNA, 20 bp, Artificial Sequence
  chemically synthesized
aggttgataagaaaacataa

SEQ ID NO: 54925 - DNA, 20 bp, Artificial Sequence
  chemically synthesized
ataagaaaacataacagata

SEQ ID NO: 54926 - DNA, 20 bp, Artificial Sequence
  chemically synthesized
cataacagataaagtttatt

SEQ ID NO: 54927 - DNA, 20 bp, Artificial Sequence
  chemically synthesized
attgagtgctaactttatgc

SEQ ID NO: 54928 - DNA, 20 bp, Artificial Sequence
  chemically synthesized
atttatacaattaactcgct

SEQ ID NO: 54929 - DNA, 20 bp, Artificial Sequence
  chemically synthesized
agttctcccaacatctctgt

SEQ ID NO: 54930 - DNA, 20 bp, Artificial Sequence
  chemically synthesized
ctcccaacatctctgtgagt

SEQ ID NO: 54931 - DNA, 20 bp, Artificial Sequence
  chemically synthesized
atttatccttatattacaaa

SEQ ID NO: 54932 - DNA, 20 bp, Artificial Sequence
  chemically synthesized
tttatccttatattacaaat

SEQ ID NO: 54933 - DNA, 20 bp, Artificial Sequence
  chemically synthesized
ccttatattacaaataggtc

SEQ ID NO: 54934 - DNA, 20 bp, Artificial Sequence
  chemically synthesized
ttatattacaaataggtcca

SEQ ID NO: 54935 - DNA, 20 bp, Artificial Sequence
  chemically synthesized
tatattacaaataggtccag

SEQ ID NO: 54936 - DNA, 20 bp, Artificial Sequence
  chemically synthesized
atattacaaataggtccaga

SEQ ID NO: 54937 - DNA, 20 bp, Artificial Sequence
  chemically synthesized
tattacaaataggtccagag

SEQ ID NO: 54938 - DNA, 20 bp, Artificial Sequence
  chemically synthesized
acaaataggtccagaggggt

SEQ ID NO: 54939 - DNA, 20 bp, Artificial Sequence
  chemically synthesized
gaggggttagtcatcttgtc

SEQ ID NO: 54940 - DNA, 20 bp, Artificial Sequence
  chemically synthesized
gttagtcatcttgtccagaa

SEQ ID NO: 54941 - DNA, 20 bp, Artificial Sequence
  chemically synthesized
agtcatcttgtccagaatgg

SEQ ID NO: 54942 - DNA, 20 bp, Artificial Sequence
  chemically synthesized
cttgtccagaatggtggaac

SEQ ID NO: 54943 - DNA, 20 bp, Artificial Sequence
  chemically synthesized
ttgtccagaatggtggaacc

SEQ ID NO: 54944 - DNA, 20 bp, Artificial Sequence
  chemically synthesized
cagaatggtggaaccaggtt

SEQ ID NO: 54945 - DNA, 20 bp, Artificial Sequence
  chemically synthesized
agaatggtggaaccaggtta

SEQ ID NO: 54946 - DNA, 20 bp, Artificial Sequence
  chemically synthesized
ggtggaaccaggttaaggat

SEQ ID NO: 54947 - DNA, 20 bp, Artificial Sequence
  chemically synthesized
gtggaaccaggttaaggatc

SEQ ID NO: 54948 - DNA, 20 bp, Artificial Sequence
  chemically synthesized
gaaccaggttaaggatcagg

SEQ ID NO: 54949 - DNA, 20 bp, Artificial Sequence
  chemically synthesized
aggttaaggatcaggcagtc

SEQ ID NO: 54950 - DNA, 20 bp, Artificial Sequence
  chemically synthesized
ggttaaggatcaggcagtct

SEQ ID NO: 54951 - DNA, 20 bp, Artificial Sequence
  chemically synthesized
aaggatcaggcagtctgggc

SEQ ID NO: 54952 - DNA, 20 bp, Artificial Sequence
  chemically synthesized
aggatcaggcagtctgggct

SEQ ID NO: 54953 - DNA, 20 bp, Artificial Sequence
  chemically synthesized
caggcagtctgggctgggca

SEQ ID NO: 54954 - DNA, 20 bp, Artificial Sequence
  chemically synthesized
gcagtctgggctgggcatgg

SEQ ID NO: 54955 - DNA, 20 bp, Artificial Sequence
  chemically synthesized
gtggctcacatctgtaatcc

SEQ ID NO: 54956 - DNA, 20 bp, Artificial Sequence
  chemically synthesized
catctgtaatcccagcactt

SEQ ID NO: 54957 - DNA, 20 bp, Artificial Sequence
  chemically synthesized
atctgtaatcccagcacttt

SEQ ID NO: 54958 - DNA, 20 bp, Artificial Sequence
  chemically synthesized
ctgtaatcccagcactttgg

SEQ ID NO: 54959 - DNA, 20 bp, Artificial Sequence
  chemically synthesized
tgtaatcccagcactttggg

SEQ ID NO: 54960 - DNA, 20 bp, Artificial Sequence
  chemically synthesized
tcccagcactttgggaggct

SEQ ID NO: 54961 - DNA, 20 bp, Artificial Sequence
  chemically synthesized
cccagcactttgggaggctg

SEQ ID NO: 54962 - DNA, 20 bp, Artificial Sequence
  chemically synthesized
agcactttgggaggctgagg

SEQ ID NO: 54963 - DNA, 20 bp, Artificial Sequence
  chemically synthesized
actttgggaggctgaggtgg

SEQ ID NO: 54964 - DNA, 20 bp, Artificial Sequence
  chemically synthesized
gctgaggtggcagattgcct

SEQ ID NO: 54965 - DNA, 20 bp, Artificial Sequence
  chemically synthesized
ggtggcagattgcctgagct

SEQ ID NO: 54966 - DNA, 20 bp, Artificial Sequence
  chemically synthesized
gtggcagattgcctgagctc

SEQ ID NO: 54967 - DNA, 20 bp, Artificial Sequence
  chemically synthesized
ggcagattgcctgagctcag

SEQ ID NO: 54968 - DNA, 20 bp, Artificial Sequence
  chemically synthesized
ttgcctgagctcaggagttc

SEQ ID NO: 54969 - DNA, 20 bp, Artificial Sequence
  chemically synthesized
tgagctcaggagttcgagac

SEQ ID NO: 54970 - DNA, 20 bp, Artificial Sequence
  chemically synthesized
tcaggagttcgagaccagcc

SEQ ID NO: 54971 - DNA, 20 bp, Artificial Sequence
  chemically synthesized
caggagttcgagaccagcct

SEQ ID NO: 54972 - DNA, 20 bp, Artificial Sequence
  chemically synthesized
cgagaccagcctgggcaaca

SEQ ID NO: 54973 - DNA, 20 bp, Artificial Sequence
  chemically synthesized
accagcctgggcaacatggt

SEQ ID NO: 54974 - DNA, 20 bp, Artificial Sequence
  chemically synthesized
ataccaaaaatacaaaacat

SEQ ID NO: 54975 - DNA, 20 bp, Artificial Sequence
  chemically synthesized
aaaaatacaaaacattagcc

SEQ ID NO: 54976 - DNA, 20 bp, Artificial Sequence
  chemically synthesized
tacaaaacattagccaagcg

SEQ ID NO: 54977 - DNA, 20 bp, Artificial Sequence
  chemically synthesized
aaaacattagccaagcgtgg

SEQ ID NO: 54978 - DNA, 20 bp, Artificial Sequence
  chemically synthesized
agcgtggtggtgcatgcctg

SEQ ID NO: 54979 - DNA, 20 bp, Artificial Sequence
  chemically synthesized
tgcctgtggtcctaactact

SEQ ID NO: 54980 - DNA, 20 bp, Artificial Sequence
  chemically synthesized
gcctgtggtcctaactactc

SEQ ID NO: 54981 - DNA, 20 bp, Artificial Sequence
  chemically synthesized
tgtggtcctaactactcagg

SEQ ID NO: 54982 - DNA, 20 bp, Artificial Sequence
  chemically synthesized
tcctaactactcaggtggct

SEQ ID NO: 54983 - DNA, 20 bp, Artificial Sequence
  chemically synthesized
cctaactactcaggtggctg

SEQ ID NO: 54984 - DNA, 20 bp, Artificial Sequence
  chemically synthesized
aactactcaggtggctgagg

SEQ ID NO: 54985 - DNA, 20 bp, Artificial Sequence
  chemically synthesized
actactcaggtggctgaggt

SEQ ID NO: 54986 - DNA, 20 bp, Artificial Sequence
  chemically synthesized
tactcaggtggctgaggtgg

SEQ ID NO: 54987 - DNA, 20 bp, Artificial Sequence
  chemically synthesized
ctgaggtgggagaatccctt

SEQ ID NO: 54988 - DNA, 20 bp, Artificial Sequence
  chemically synthesized
gtgggagaatcccttgagct

SEQ ID NO: 54989 - DNA, 20 bp, Artificial Sequence
  chemically synthesized
gggagaatcccttgagctca

SEQ ID NO: 54990 - DNA, 20 bp, Artificial Sequence
  chemically synthesized
ggagaatcccttgagctcag

SEQ ID NO: 54991 - DNA, 20 bp, Artificial Sequence
  chemically synthesized
tcccttgagctcagaggttg

SEQ ID NO: 54992 - DNA, 20 bp, Artificial Sequence
  chemically synthesized
ttgagctcagaggttgcagt

SEQ ID NO: 54993 - DNA, 20 bp, Artificial Sequence
  chemically synthesized
ctcagaggttgcagtgagcc

SEQ ID NO: 54994 - DNA, 20 bp, Artificial Sequence
  chemically synthesized
aagattatgccactgcactc

SEQ ID NO: 54995 - DNA, 20 bp, Artificial Sequence
  chemically synthesized
tatgccactgcactccagcc

SEQ ID NO: 54996 - DNA, 20 bp, Artificial Sequence
  chemically synthesized
atgccactgcactccagcct

SEQ ID NO: 54997 - DNA, 20 bp, Artificial Sequence
  chemically synthesized
ctgcactccagcctgggtga

SEQ ID NO: 54998 - DNA, 20 bp, Artificial Sequence
  chemically synthesized
gcactccagcctgggtgaca

SEQ ID NO: 54999 - DNA, 20 bp, Artificial Sequence
  chemically synthesized
tccagcctgggtgacagagt

SEQ ID NO: 55000 - DNA, 20 bp, Artificial Sequence
  chemically synthesized
gacagagtgagaccctgtct

SEQ ID NO: 55001 - DNA, 20 bp, Artificial Sequence
  chemically synthesized
tctcagaaaaaaaaaaaaaa

SEQ ID NO: 55002 - DNA, 20 bp, Artificial Sequence
  chemically synthesized
cagaaaaaaaaaaaaaaaag

SEQ ID NO: 55003 - DNA, 20 bp, Artificial Sequence
  chemically synthesized
aaaaaaaaaaaaaaagaagc

SEQ ID NO: 55004 - DNA, 20 bp, Artificial Sequence
  chemically synthesized
aaaaaaaaaaaagaagcaag

SEQ ID NO: 55005 - DNA, 20 bp, Artificial Sequence
  chemically synthesized
aaaaaaagaagcaagcagtc

SEQ ID NO: 55006 - DNA, 20 bp, Artificial Sequence
  chemically synthesized
aaaaaagaagcaagcagtct

SEQ ID NO: 55007 - DNA, 20 bp, Artificial Sequence
  chemically synthesized
aagaagcaagcagtctgggc

SEQ ID NO: 55008 - DNA, 20 bp, Artificial Sequence
  chemically synthesized
agaagcaagcagtctgggct

SEQ ID NO: 55009 - DNA, 20 bp, Artificial Sequence
  chemically synthesized
gcagtctgggctgggtgctg

SEQ ID NO: 55010 - DNA, 20 bp, Artificial Sequence
  chemically synthesized
gtggctcgcgcctgtaatcc

SEQ ID NO: 55011 - DNA, 20 bp, Artificial Sequence
  chemically synthesized
ttgtaatatatcctgcttat

SEQ ID NO: 55012 - DNA, 20 bp, Artificial Sequence
  chemically synthesized
aatatatcctgcttattaga

SEQ ID NO: 55013 - DNA, 20 bp, Artificial Sequence
  chemically synthesized
tgatcactcatctgttccct

SEQ ID NO: 55014 - DNA, 20 bp, Artificial Sequence
  chemically synthesized
ctcatctgttccctaagtta

SEQ ID NO: 55015 - DNA, 20 bp, Artificial Sequence
  chemically synthesized
ttatagatttacgtccactt

SEQ ID NO: 55016 - DNA, 20 bp, Artificial Sequence
  chemically synthesized
atttacgtccactttagaaa

SEQ ID NO: 55017 - DNA, 20 bp, Artificial Sequence
  chemically synthesized
ccactttagaaatggcttgt

SEQ ID NO: 55018 - DNA, 20 bp, Artificial Sequence
  chemically synthesized
cactttagaaatggcttgtg

SEQ ID NO: 55019 - DNA, 20 bp, Artificial Sequence
  chemically synthesized
ttagaaatggcttgtgaggc

SEQ ID NO: 55020 - DNA, 20 bp, Artificial Sequence
  chemically synthesized
atggcttgtgaggcaagttt

SEQ ID NO: 55021 - DNA, 20 bp, Artificial Sequence
  chemically synthesized
caagtttaagtgaccgatga

SEQ ID NO: 55022 - DNA, 20 bp, Artificial Sequence
  chemically synthesized
agtgaccgatgacagtttta

SEQ ID NO: 55023 - DNA, 20 bp, Artificial Sequence
  chemically synthesized
accgatgacagttttaaagc

SEQ ID NO: 55024 - DNA, 20 bp, Artificial Sequence
  chemically synthesized
ccgatgacagttttaaagca

SEQ ID NO: 55025 - DNA, 20 bp, Artificial Sequence
  chemically synthesized
gcaaggtccatgtcatgtta

SEQ ID NO: 55026 - DNA, 20 bp, Artificial Sequence
  chemically synthesized
tgtcatgttatggcataatt

SEQ ID NO: 55027 - DNA, 20 bp, Artificial Sequence
  chemically synthesized
catgttatggcataatttgg

SEQ ID NO: 55028 - DNA, 20 bp, Artificial Sequence
  chemically synthesized
cataatttggtagaatgttc

SEQ ID NO: 55029 - DNA, 20 bp, Artificial Sequence
  chemically synthesized
aatttggtagaatgttctag

SEQ ID NO: 55030 - DNA, 20 bp, Artificial Sequence
  chemically synthesized
agaatgttctagtagtgtat

SEQ ID NO: 55031 - DNA, 20 bp, Artificial Sequence
  chemically synthesized
tctagtagtgtatcagtttt

SEQ ID NO: 55032 - DNA, 20 bp, Artificial Sequence
  chemically synthesized
ctagtagtgtatcagttttc

SEQ ID NO: 55033 - DNA, 20 bp, Artificial Sequence
  chemically synthesized
gtagtgtatcagttttcagg

SEQ ID NO: 55034 - DNA, 20 bp, Artificial Sequence
  chemically synthesized
gtgtatcagttttcaggtgg

SEQ ID NO: 55035 - DNA, 20 bp, Artificial Sequence
  chemically synthesized
tgtatcagttttcaggtggt

SEQ ID NO: 55036 - DNA, 20 bp, Artificial Sequence
  chemically synthesized
agttttcaggtggtaggctt

SEQ ID NO: 55037 - DNA, 20 bp, Artificial Sequence
  chemically synthesized
gttttcaggtggtaggcttg

SEQ ID NO: 55038 - DNA, 20 bp, Artificial Sequence
  chemically synthesized
tgcaattctattattgccca

SEQ ID NO: 55039 - DNA, 20 bp, Artificial Sequence
  chemically synthesized
ctattattgcccaaagaaaa

SEQ ID NO: 55040 - DNA, 20 bp, Artificial Sequence
  chemically synthesized
ccaaagaaaatagacccatt

SEQ ID NO: 55041 - DNA, 20 bp, Artificial Sequence
  chemically synthesized
caaagaaaatagacccatta

SEQ ID NO: 55042 - DNA, 20 bp, Artificial Sequence
  chemically synthesized
agaaaatagacccattaagg

SEQ ID NO: 55043 - DNA, 20 bp, Artificial Sequence
  chemically synthesized
gaagtccaacttctgctgcg

SEQ ID NO: 55044 - DNA, 20 bp, Artificial Sequence
  chemically synthesized
ccaacttctgctgcgtggac

SEQ ID NO: 55045 - DNA, 20 bp, Artificial Sequence
  chemically synthesized
cagtgctgccacatcacaca

SEQ ID NO: 55046 - DNA, 20 bp, Artificial Sequence
  chemically synthesized
gccacatcacacatagacca

SEQ ID NO: 55047 - DNA, 20 bp, Artificial Sequence
  chemically synthesized
ccacatcacacatagaccaa

SEQ ID NO: 55048 - DNA, 20 bp, Artificial Sequence
  chemically synthesized
tcacacatagaccaaaggct

SEQ ID NO: 55049 - DNA, 20 bp, Artificial Sequence
  chemically synthesized
cacacatagaccaaaggctt

SEQ ID NO: 55050 - DNA, 20 bp, Artificial Sequence
  chemically synthesized
accaaaggcttaggtttttg

SEQ ID NO: 55051 - DNA, 20 bp, Artificial Sequence
  chemically synthesized
ggcttaggtttttgtggttt

SEQ ID NO: 55052 - DNA, 20 bp, Artificial Sequence
  chemically synthesized
tttattttattttattattt

SEQ ID NO: 55053 - DNA, 20 bp, Artificial Sequence
  chemically synthesized
ttttattttattatttgaga

SEQ ID NO: 55054 - DNA, 20 bp, Artificial Sequence
  chemically synthesized
ttattttattatttgagatg

SEQ ID NO: 55055 - DNA, 20 bp, Artificial Sequence
  chemically synthesized
tggagtctcactctgtcacc

SEQ ID NO: 55056 - DNA, 20 bp, Artificial Sequence
  chemically synthesized
ggagtctcactctgtcaccc

SEQ ID NO: 55057 - DNA, 20 bp, Artificial Sequence
  chemically synthesized
tctcactctgtcacccaggc

SEQ ID NO: 55058 - DNA, 20 bp, Artificial Sequence
  chemically synthesized
ctcactctgtcacccaggct

SEQ ID NO: 55059 - DNA, 20 bp, Artificial Sequence
  chemically synthesized
tcactctgtcacccaggctg

SEQ ID NO: 55060 - DNA, 20 bp, Artificial Sequence
  chemically synthesized
tcacccaggctggggtgcaa

SEQ ID NO: 55061 - DNA, 20 bp, Artificial Sequence
  chemically synthesized
ggggtgcaatggcgcaatct

SEQ ID NO: 55062 - DNA, 20 bp, Artificial Sequence
  chemically synthesized
tcactgcaacctccaactcc

SEQ ID NO: 55063 - DNA, 20 bp, Artificial Sequence
  chemically synthesized
cactgcaacctccaactcct

SEQ ID NO: 55064 - DNA, 20 bp, Artificial Sequence
  chemically synthesized
actgcaacctccaactcctg

SEQ ID NO: 55065 - DNA, 20 bp, Artificial Sequence
  chemically synthesized
ctggggctcaaatgatcctc

SEQ ID NO: 55066 - DNA, 20 bp, Artificial Sequence
  chemically synthesized
ctcaaatgatcctccagcct

SEQ ID NO: 55067 - DNA, 20 bp, Artificial Sequence
  chemically synthesized
tccagcctcagcctcccgaa

SEQ ID NO: 55068 - DNA, 20 bp, Artificial Sequence
  chemically synthesized
gcctcagcctcccgaatagc

SEQ ID NO: 55069 - DNA, 20 bp, Artificial Sequence
  chemically synthesized
cctcagcctcccgaatagct

SEQ ID NO: 55070 - DNA, 20 bp, Artificial Sequence
  chemically synthesized
ctcccgaatagctgggacta

SEQ ID NO: 55071 - DNA, 20 bp, Artificial Sequence
  chemically synthesized
cagatgcgtaccaccatgcc

SEQ ID NO: 55072 - DNA, 20 bp, Artificial Sequence
  chemically synthesized
gctaatttttttattttttg

SEQ ID NO: 55073 - DNA, 20 bp, Artificial Sequence
  chemically synthesized
taatttttttattttttgta

SEQ ID NO: 55074 - DNA, 20 bp, Artificial Sequence
  chemically synthesized
ttttttattttttgtagaga

SEQ ID NO: 55075 - DNA, 20 bp, Artificial Sequence
  chemically synthesized
tttttattttttgtagagac

SEQ ID NO: 55076 - DNA, 20 bp, Artificial Sequence
  chemically synthesized
ttttattttttgtagagaca

SEQ ID NO: 55077 - DNA, 20 bp, Artificial Sequence
  chemically synthesized
ttttgtagagacagggtctc

SEQ ID NO: 55078 - DNA, 20 bp, Artificial Sequence
  chemically synthesized
tctcaagcatcctcccgcct

SEQ ID NO: 55079 - DNA, 20 bp, Artificial Sequence
  chemically synthesized
cctcccgccttagcctccca

SEQ ID NO: 55080 - DNA, 20 bp, Artificial Sequence
  chemically synthesized
gccttagcctcccaaagtgc

SEQ ID NO: 55081 - DNA, 20 bp, Artificial Sequence
  chemically synthesized
ccttagcctcccaaagtgct

SEQ ID NO: 55082 - DNA, 20 bp, Artificial Sequence
  chemically synthesized
ctcccaaagtgctgggataa

SEQ ID NO: 55083 - DNA, 20 bp, Artificial Sequence
  chemically synthesized
tcccaaagtgctgggataac

SEQ ID NO: 55084 - DNA, 20 bp, Artificial Sequence
  chemically synthesized
agtgctgggataacaggcat

SEQ ID NO: 55085 - DNA, 20 bp, Artificial Sequence
  chemically synthesized
caggcatgagctgctgcact

SEQ ID NO: 55086 - DNA, 20 bp, Artificial Sequence
  chemically synthesized
ccttaaaaaaaatgtataac

SEQ ID NO: 55087 - DNA, 20 bp, Artificial Sequence
  chemically synthesized
cttaaaaaaaatgtataaca

SEQ ID NO: 55088 - DNA, 20 bp, Artificial Sequence
  chemically synthesized
aaaaaaatgtataacaaggc

SEQ ID NO: 55089 - DNA, 20 bp, Artificial Sequence
  chemically synthesized
aaaaaatgtataacaaggcc

SEQ ID NO: 55090 - DNA, 20 bp, Artificial Sequence
  chemically synthesized
atgtataacaaggccgggca

SEQ ID NO: 55091 - DNA, 20 bp, Artificial Sequence
  chemically synthesized
tataacaaggccgggcacgg

SEQ ID NO: 55092 - DNA, 20 bp, Artificial Sequence
  chemically synthesized
gtggctcatgcctgtaatcc

SEQ ID NO: 55093 - DNA, 20 bp, Artificial Sequence
  chemically synthesized
tgcctgtaatcccagcactt

SEQ ID NO: 55094 - DNA, 20 bp, Artificial Sequence
  chemically synthesized
gcctgtaatcccagcacttt

SEQ ID NO: 55095 - DNA, 20 bp, Artificial Sequence
  chemically synthesized
tgtaatcccagcactttggg

SEQ ID NO: 55096 - DNA, 20 bp, Artificial Sequence
  chemically synthesized
tcccagcactttgggaagcc

SEQ ID NO: 55097 - DNA, 20 bp, Artificial Sequence
  chemically synthesized
cccagcactttgggaagcca

SEQ ID NO: 55098 - DNA, 20 bp, Artificial Sequence
  chemically synthesized
agcactttgggaagccaagg

SEQ ID NO: 55099 - DNA, 20 bp, Artificial Sequence
  chemically synthesized
gcactttgggaagccaaggc

SEQ ID NO: 55100 - DNA, 20 bp, Artificial Sequence
  chemically synthesized
ctttgggaagccaaggcagg

SEQ ID NO: 55101 - DNA, 20 bp, Artificial Sequence
  chemically synthesized
ccaaggcaggcagatcacct

SEQ ID NO: 55102 - DNA, 20 bp, Artificial Sequence
  chemically synthesized
gcaggcagatcacctgagat

SEQ ID NO: 55103 - DNA, 20 bp, Artificial Sequence
  chemically synthesized
caggcagatcacctgagatc

SEQ ID NO: 55104 - DNA, 20 bp, Artificial Sequence
  chemically synthesized
ggcagatcacctgagatcag

SEQ ID NO: 55105 - DNA, 20 bp, Artificial Sequence
  chemically synthesized
ggagttcgacctgaccaaca

SEQ ID NO: 55106 - DNA, 20 bp, Artificial Sequence
  chemically synthesized
ctactaaaaatacaaaaaat

SEQ ID NO: 55107 - DNA, 20 bp, Artificial Sequence
  chemically synthesized
taaaaatacaaaaaattagc

SEQ ID NO: 55108 - DNA, 20 bp, Artificial Sequence
  chemically synthesized
tacaaaaaattagccagacg

SEQ ID NO: 55109 - DNA, 20 bp, Artificial Sequence
  chemically synthesized
aaaaaattagccagacgtgg

SEQ ID NO: 55110 - DNA, 20 bp, Artificial Sequence
  chemically synthesized
gtggcacatgcatgtaatcc

SEQ ID NO: 55111 - DNA, 20 bp, Artificial Sequence
  chemically synthesized
gcatgtaatcccagctactt

SEQ ID NO: 55112 - DNA, 20 bp, Artificial Sequence
  chemically synthesized
atgtaatcccagctacttga

SEQ ID NO: 55113 - DNA, 20 bp, Artificial Sequence
  chemically synthesized
tgtaatcccagctacttgag

SEQ ID NO: 55114 - DNA, 20 bp, Artificial Sequence
  chemically synthesized
tcccagctacttgagaggct

SEQ ID NO: 55115 - DNA, 20 bp, Artificial Sequence
  chemically synthesized
agctacttgagaggctgaga

SEQ ID NO: 55116 - DNA, 20 bp, Artificial Sequence
  chemically synthesized
gctacttgagaggctgagac

SEQ ID NO: 55117 - DNA, 20 bp, Artificial Sequence
  chemically synthesized
tacttgagaggctgagacag

SEQ ID NO: 55118 - DNA, 20 bp, Artificial Sequence
  chemically synthesized
gacaggagaactgcttgaac

SEQ ID NO: 55119 - DNA, 20 bp, Artificial Sequence
  chemically synthesized
acaggagaactgcttgaacc

SEQ ID NO: 55120 - DNA, 20 bp, Artificial Sequence
  chemically synthesized
caggagaactgcttgaaccg

SEQ ID NO: 55121 - DNA, 20 bp, Artificial Sequence
  chemically synthesized
ggagaactgcttgaaccggg

SEQ ID NO: 55122 - DNA, 20 bp, Artificial Sequence
  chemically synthesized
gagaactgcttgaaccgggg

SEQ ID NO: 55123 - DNA, 20 bp, Artificial Sequence
  chemically synthesized
aactgcttgaaccggggagg

SEQ ID NO: 55124 - DNA, 20 bp, Artificial Sequence
  chemically synthesized
ctgcttgaaccggggaggca

SEQ ID NO: 55125 - DNA, 20 bp, Artificial Sequence
  chemically synthesized
tgcttgaaccggggaggcag

SEQ ID NO: 55126 - DNA, 20 bp, Artificial Sequence
  chemically synthesized
aaccggggaggcagaggttg

SEQ ID NO: 55127 - DNA, 20 bp, Artificial Sequence
  chemically synthesized
ggggaggcagaggttgcagt

SEQ ID NO: 55128 - DNA, 20 bp, Artificial Sequence
  chemically synthesized
ggcagaggttgcagtgagcc

SEQ ID NO: 55129 - DNA, 20 bp, Artificial Sequence
  chemically synthesized
cacaccattgcactccaacc

SEQ ID NO: 55130 - DNA, 20 bp, Artificial Sequence
  chemically synthesized
acaccattgcactccaacct

SEQ ID NO: 55131 - DNA, 20 bp, Artificial Sequence
  chemically synthesized
tgcactccaacctgggcaac

SEQ ID NO: 55132 - DNA, 20 bp, Artificial Sequence
  chemically synthesized
cactccaacctgggcaacaa

SEQ ID NO: 55133 - DNA, 20 bp, Artificial Sequence
  chemically synthesized
ctccatctcaaaaaaaaaaa

SEQ ID NO: 55134 - DNA, 20 bp, Artificial Sequence
  chemically synthesized
aaaaaaaaaaagctgtataa

SEQ ID NO: 55135 - DNA, 20 bp, Artificial Sequence
  chemically synthesized
aaaaagctgtataacagctt

SEQ ID NO: 55136 - DNA, 20 bp, Artificial Sequence
  chemically synthesized
ccatacaattcactcattta

SEQ ID NO: 55137 - DNA, 20 bp, Artificial Sequence
  chemically synthesized
ctcatttaaagtgtacaatt

SEQ ID NO: 55138 - DNA, 20 bp, Artificial Sequence
  chemically synthesized
tcatttaaagtgtacaattc

SEQ ID NO: 55139 - DNA, 20 bp, Artificial Sequence
  chemically synthesized
catttaaagtgtacaattca

SEQ ID NO: 55140 - DNA, 20 bp, Artificial Sequence
  chemically synthesized
atttaaagtgtacaattcag

SEQ ID NO: 55141 - DNA, 20 bp, Artificial Sequence
  chemically synthesized
cattccactccaacccactc

SEQ ID NO: 55142 - DNA, 20 bp, Artificial Sequence
  chemically synthesized
cactccaacccactcaagcc

SEQ ID NO: 55143 - DNA, 20 bp, Artificial Sequence
  chemically synthesized
actccaacccactcaagcct

SEQ ID NO: 55144 - DNA, 20 bp, Artificial Sequence
  chemically synthesized
ctaatctactttctgtctca

SEQ ID NO: 55145 - DNA, 20 bp, Artificial Sequence
  chemically synthesized
gtctcatagatttgcctatt

SEQ ID NO: 55146 - DNA, 20 bp, Artificial Sequence
  chemically synthesized
tctcatagatttgcctattt

SEQ ID NO: 55147 - DNA, 20 bp, Artificial Sequence
  chemically synthesized
ctcatagatttgcctatttg

SEQ ID NO: 55148 - DNA, 20 bp, Artificial Sequence
  chemically synthesized
tttggggcatttcatataaa

SEQ ID NO: 55149 - DNA, 20 bp, Artificial Sequence
  chemically synthesized
aaatagactcctacaatatg

SEQ ID NO: 55150 - DNA, 20 bp, Artificial Sequence
  chemically synthesized
aatatgtggccttttgtgtc

SEQ ID NO: 55151 - DNA, 20 bp, Artificial Sequence
  chemically synthesized
tgtgtctggcctctttcact

SEQ ID NO: 55152 - DNA, 20 bp, Artificial Sequence
  chemically synthesized
tcacttagcatgatgttttc

SEQ ID NO: 55153 - DNA, 20 bp, Artificial Sequence
  chemically synthesized
cacttagcatgatgttttca

SEQ ID NO: 55154 - DNA, 20 bp, Artificial Sequence
  chemically synthesized
atctgtgttataacatatat

SEQ ID NO: 55155 - DNA, 20 bp, Artificial Sequence
  chemically synthesized
tggtacttcatttcttttta

SEQ ID NO: 55156 - DNA, 20 bp, Artificial Sequence
  chemically synthesized
cttcatttctttttatggac

SEQ ID NO: 55157 - DNA, 20 bp, Artificial Sequence
  chemically synthesized
cattttatttatctgtttat

SEQ ID NO: 55158 - DNA, 20 bp, Artificial Sequence
  chemically synthesized
attttatttatctgtttatc

SEQ ID NO: 55159 - DNA, 20 bp, Artificial Sequence
  chemically synthesized
tatttatctgtttatcaggc

SEQ ID NO: 55160 - DNA, 20 bp, Artificial Sequence
  chemically synthesized
atttatctgtttatcaggcc

SEQ ID NO: 55161 - DNA, 20 bp, Artificial Sequence
  chemically synthesized
tctgtttatcaggccaggca

SEQ ID NO: 55162 - DNA, 20 bp, Artificial Sequence
  chemically synthesized
gtttatcaggccaggcatgg

SEQ ID NO: 55163 - DNA, 20 bp, Artificial Sequence
  chemically synthesized
gtggctcacatctgtaatcc

SEQ ID NO: 55164 - DNA, 20 bp, Artificial Sequence
  chemically synthesized
catctgtaatcccagcactt

SEQ ID NO: 55165 - DNA, 20 bp, Artificial Sequence
  chemically synthesized
atctgtaatcccagcacttt

SEQ ID NO: 55166 - DNA, 20 bp, Artificial Sequence
  chemically synthesized
ctgtaatcccagcactttgg

SEQ ID NO: 55167 - DNA, 20 bp, Artificial Sequence
  chemically synthesized
tgtaatcccagcactttggg

SEQ ID NO: 55168 - DNA, 20 bp, Artificial Sequence
  chemically synthesized
tcccagcactttgggaggct

SEQ ID NO: 55169 - DNA, 20 bp, Artificial Sequence
  chemically synthesized
cccagcactttgggaggctg

SEQ ID NO: 55170 - DNA, 20 bp, Artificial Sequence
  chemically synthesized
agcactttgggaggctgagg

SEQ ID NO: 55171 - DNA, 20 bp, Artificial Sequence
  chemically synthesized
gcactttgggaggctgaggc

SEQ ID NO: 55172 - DNA, 20 bp, Artificial Sequence
  chemically synthesized
actttgggaggctgaggcag

SEQ ID NO: 55173 - DNA, 20 bp, Artificial Sequence
  chemically synthesized
ctttgggaggctgaggcagg

SEQ ID NO: 55174 - DNA, 20 bp, Artificial Sequence
  chemically synthesized
ctgaggcaggaggattactt

SEQ ID NO: 55175 - DNA, 20 bp, Artificial Sequence
  chemically synthesized
ctcaagtaatcctcctgcct

SEQ ID NO: 55176 - DNA, 20 bp, Artificial Sequence
  chemically synthesized
cctcctgcctcagcctccca

SEQ ID NO: 55177 - DNA, 20 bp, Artificial Sequence
  chemically synthesized
gcctcagcctcccaaagtgc

SEQ ID NO: 55178 - DNA, 20 bp, Artificial Sequence
  chemically synthesized
cctcagcctcccaaagtgct

SEQ ID NO: 55179 - DNA, 20 bp, Artificial Sequence
  chemically synthesized
ctcccaaagtgctgggatta

SEQ ID NO: 55180 - DNA, 20 bp, Artificial Sequence
  chemically synthesized
agtgctgggattacagatgt

SEQ ID NO: 55181 - DNA, 20 bp, Artificial Sequence
  chemically synthesized
cagatgtgagccaccatgcc

SEQ ID NO: 55182 - DNA, 20 bp, Artificial Sequence
  chemically synthesized
accatgcctggcctgataaa

SEQ ID NO: 55183 - DNA, 20 bp, Artificial Sequence
  chemically synthesized
ataaacagataaataaaatg

SEQ ID NO: 55184 - DNA, 20 bp, Artificial Sequence
  chemically synthesized
aatgttatatattcatacaa

SEQ ID NO: 55185 - DNA, 20 bp, Artificial Sequence
  chemically synthesized
gaatattacttgtccataaa

SEQ ID NO: 55186 - DNA, 20 bp, Artificial Sequence
  chemically synthesized
cttgtccataaaaagaaatg

SEQ ID NO: 55187 - DNA, 20 bp, Artificial Sequence
  chemically synthesized
taccaatatatgttataaca

SEQ ID NO: 55188 - DNA, 20 bp, Artificial Sequence
  chemically synthesized
aaccttgaaaacatcatgct

SEQ ID NO: 55189 - DNA, 20 bp, Artificial Sequence
  chemically synthesized
gaaaacatcatgctaagtga

SEQ ID NO: 55190 - DNA, 20 bp, Artificial Sequence
  chemically synthesized
aaacatcatgctaagtgaaa

SEQ ID NO: 55191 - DNA, 20 bp, Artificial Sequence
  chemically synthesized
aacatcatgctaagtgaaag

SEQ ID NO: 55192 - DNA, 20 bp, Artificial Sequence
  chemically synthesized
tcatgctaagtgaaagaggc

SEQ ID NO: 55193 - DNA, 20 bp, Artificial Sequence
  chemically synthesized
gtgaaagaggccagacacaa

SEQ ID NO: 55194 - DNA, 20 bp, Artificial Sequence
  chemically synthesized
tgaaagaggccagacacaaa

SEQ ID NO: 55195 - DNA, 20 bp, Artificial Sequence
  chemically synthesized
acacaaaaggccacatattg

SEQ ID NO: 55196 - DNA, 20 bp, Artificial Sequence
  chemically synthesized
cacaaaaggccacatattgt

SEQ ID NO: 55197 - DNA, 20 bp, Artificial Sequence
  chemically synthesized
caaaaggccacatattgtag

SEQ ID NO: 55198 - DNA, 20 bp, Artificial Sequence
  chemically synthesized
tttatatgaaatgccccaaa

SEQ ID NO: 55199 - DNA, 20 bp, Artificial Sequence
  chemically synthesized
ttatatgaaatgccccaaat

SEQ ID NO: 55200 - DNA, 20 bp, Artificial Sequence
  chemically synthesized
ccccaaataggcaaatctat

SEQ ID NO: 55201 - DNA, 20 bp, Artificial Sequence
  chemically synthesized
aaataggcaaatctatgaga

SEQ ID NO: 55202 - DNA, 20 bp, Artificial Sequence
  chemically synthesized
aggcaaatctatgagacaga

SEQ ID NO: 55203 - DNA, 20 bp, Artificial Sequence
  chemically synthesized
caaatctatgagacagaaag

SEQ ID NO: 55204 - DNA, 20 bp, Artificial Sequence
  chemically synthesized
ctatgagacagaaagtagat

SEQ ID NO: 55205 - DNA, 20 bp, Artificial Sequence
  chemically synthesized
tgagacagaaagtagattag

SEQ ID NO: 55206 - DNA, 20 bp, Artificial Sequence
  chemically synthesized
aaagtagattagtggttgcc

SEQ ID NO: 55207 - DNA, 20 bp, Artificial Sequence
  chemically synthesized
aagtagattagtggttgcct

SEQ ID NO: 55208 - DNA, 20 bp, Artificial Sequence
  chemically synthesized
attagtggttgcctaggctt

SEQ ID NO: 55209 - DNA, 20 bp, Artificial Sequence
  chemically synthesized
agtggttgcctaggcttgag

SEQ ID NO: 55210 - DNA, 20 bp, Artificial Sequence
  chemically synthesized
gtggttgcctaggcttgagt

SEQ ID NO: 55211 - DNA, 20 bp, Artificial Sequence
  chemically synthesized
ttgcctaggcttgagtgggt

SEQ ID NO: 55212 - DNA, 20 bp, Artificial Sequence
  chemically synthesized
gcctaggcttgagtgggttg

SEQ ID NO: 55213 - DNA, 20 bp, Artificial Sequence
  chemically synthesized
taggcttgagtgggttggag

SEQ ID NO: 55214 - DNA, 20 bp, Artificial Sequence
  chemically synthesized
ctgaattgtacactttaaat

SEQ ID NO: 55215 - DNA, 20 bp, Artificial Sequence
  chemically synthesized
ctttaaatgagtgaattgta

SEQ ID NO: 55216 - DNA, 20 bp, Artificial Sequence
  chemically synthesized
ggtattgtgaattatatctc

SEQ ID NO: 55217 - DNA, 20 bp, Artificial Sequence
  chemically synthesized
ttatatctcaagctgttata

SEQ ID NO: 55218 - DNA, 20 bp, Artificial Sequence
  chemically synthesized
atacagcttttttttttttt

SEQ ID NO: 55219 - DNA, 20 bp, Artificial Sequence
  chemically synthesized
agctttttttttttttgaga

SEQ ID NO: 55220 - DNA, 20 bp, Artificial Sequence
  chemically synthesized
ctttttttttttttgagatg

SEQ ID NO: 55221 - DNA, 20 bp, Artificial Sequence
  chemically synthesized
ggagtttcactcttgttgcc

SEQ ID NO: 55222 - DNA, 20 bp, Artificial Sequence
  chemically synthesized
gagtttcactcttgttgccc

SEQ ID NO: 55223 - DNA, 20 bp, Artificial Sequence
  chemically synthesized
ttcactcttgttgcccaggt

SEQ ID NO: 55224 - DNA, 20 bp, Artificial Sequence
  chemically synthesized
cactcttgttgcccaggttg

SEQ ID NO: 55225 - DNA, 20 bp, Artificial Sequence
  chemically synthesized
ttgcccaggttggagtgcaa

SEQ ID NO: 55226 - DNA, 20 bp, Artificial Sequence
  chemically synthesized
tggagtgcaatggtgtgatc

SEQ ID NO: 55227 - DNA, 20 bp, Artificial Sequence
  chemically synthesized
ggagtgcaatggtgtgatct

SEQ ID NO: 55228 - DNA, 20 bp, Artificial Sequence
  chemically synthesized
cactgcaacctctgcctccc

SEQ ID NO: 55229 - DNA, 20 bp, Artificial Sequence
  chemically synthesized
aacctctgcctccccggttc

SEQ ID NO: 55230 - DNA, 20 bp, Artificial Sequence
  chemically synthesized
ctctgcctccccggttcaag

SEQ ID NO: 55231 - DNA, 20 bp, Artificial Sequence
  chemically synthesized
ttcaagcagttctcctgtct

SEQ ID NO: 55232 - DNA, 20 bp, Artificial Sequence
  chemically synthesized
ttctcctgtctcagcctctc

SEQ ID NO: 55233 - DNA, 20 bp, Artificial Sequence
  chemically synthesized
tcctgtctcagcctctcaag

SEQ ID NO: 55234 - DNA, 20 bp, Artificial Sequence
  chemically synthesized
gtctcagcctctcaagtagc

SEQ ID NO: 55235 - DNA, 20 bp, Artificial Sequence
  chemically synthesized
tctcagcctctcaagtagct

SEQ ID NO: 55236 - DNA, 20 bp, Artificial Sequence
  chemically synthesized
catgcatgtgccaccacgtc

SEQ ID NO: 55237 - DNA, 20 bp, Artificial Sequence
  chemically synthesized
tggctaattttttgtatttt

SEQ ID NO: 55238 - DNA, 20 bp, Artificial Sequence
  chemically synthesized
ctaattttttgtatttttag

SEQ ID NO: 55239 - DNA, 20 bp, Artificial Sequence
  chemically synthesized
aattttttgtatttttagta

SEQ ID NO: 55240 - DNA, 20 bp, Artificial Sequence
  chemically synthesized
ttgtatttttagtagagacg

SEQ ID NO: 55241 - DNA, 20 bp, Artificial Sequence
  chemically synthesized
gagacgcggtttcaccatgt

SEQ ID NO: 55242 - DNA, 20 bp, Artificial Sequence
  chemically synthesized
cgcggtttcaccatgttggt

SEQ ID NO: 55243 - DNA, 20 bp, Artificial Sequence
  chemically synthesized
gcggtttcaccatgttggtc

SEQ ID NO: 55244 - DNA, 20 bp, Artificial Sequence
  chemically synthesized
tcaggtcgaactcctgatct

SEQ ID NO: 55245 - DNA, 20 bp, Artificial Sequence
  chemically synthesized
caggtcgaactcctgatctc

SEQ ID NO: 55246 - DNA, 20 bp, Artificial Sequence
  chemically synthesized
ctcaggtgatctgcctgcct

SEQ ID NO: 55247 - DNA, 20 bp, Artificial Sequence
  chemically synthesized
ctgcctgccttggcttccca

SEQ ID NO: 55248 - DNA, 20 bp, Artificial Sequence
  chemically synthesized
gccttggcttcccaaagtgc

SEQ ID NO: 55249 - DNA, 20 bp, Artificial Sequence
  chemically synthesized
ccttggcttcccaaagtgct

SEQ ID NO: 55250 - DNA, 20 bp, Artificial Sequence
  chemically synthesized
ttcccaaagtgctgggatta

SEQ ID NO: 55251 - DNA, 20 bp, Artificial Sequence
  chemically synthesized
tcccaaagtgctgggattac

SEQ ID NO: 55252 - DNA, 20 bp, Artificial Sequence
  chemically synthesized
agtgctgggattacaggcat

SEQ ID NO: 55253 - DNA, 20 bp, Artificial Sequence
  chemically synthesized
caggcatgagccaccgtgcc

SEQ ID NO: 55254 - DNA, 20 bp, Artificial Sequence
  chemically synthesized
ccttgttatacatttttttt

SEQ ID NO: 55255 - DNA, 20 bp, Artificial Sequence
  chemically synthesized
cttgttatacatttttttta

SEQ ID NO: 55256 - DNA, 20 bp, Artificial Sequence
  chemically synthesized
tttgttaaaaatcaaaaaca

SEQ ID NO: 55257 - DNA, 20 bp, Artificial Sequence
  chemically synthesized
taaaaatcaaaaacatggct

SEQ ID NO: 55258 - DNA, 20 bp, Artificial Sequence
  chemically synthesized
atcaaaaacatggctgagtg

SEQ ID NO: 55259 - DNA, 20 bp, Artificial Sequence
  chemically synthesized
aaaaacatggctgagtgcag

SEQ ID NO: 55260 - DNA, 20 bp, Artificial Sequence
  chemically synthesized
gcagctcatgcctgttatcc

SEQ ID NO: 55261 - DNA, 20 bp, Artificial Sequence
  chemically synthesized
tgcctgttatcccagcactt

SEQ ID NO: 55262 - DNA, 20 bp, Artificial Sequence
  chemically synthesized
gcctgttatcccagcacttt

SEQ ID NO: 55263 - DNA, 20 bp, Artificial Sequence
  chemically synthesized
ctgttatcccagcactttgg

SEQ ID NO: 55264 - DNA, 20 bp, Artificial Sequence
  chemically synthesized
tgttatcccagcactttggg

SEQ ID NO: 55265 - DNA, 20 bp, Artificial Sequence
  chemically synthesized
tcccagcactttgggaggct

SEQ ID NO: 55266 - DNA, 20 bp, Artificial Sequence
  chemically synthesized
cccagcactttgggaggcta

SEQ ID NO: 55267 - DNA, 20 bp, Artificial Sequence
  chemically synthesized
agcactttgggaggctaagg

SEQ ID NO: 55268 - DNA, 20 bp, Artificial Sequence
  chemically synthesized
gcactttgggaggctaaggc

SEQ ID NO: 55269 - DNA, 20 bp, Artificial Sequence
  chemically synthesized
actttgggaggctaaggcgg

SEQ ID NO: 55270 - DNA, 20 bp, Artificial Sequence
  chemically synthesized
ctttgggaggctaaggcggg

SEQ ID NO: 55271 - DNA, 20 bp, Artificial Sequence
  chemically synthesized
gctaaggcgggaggatgctt

SEQ ID NO: 55272 - DNA, 20 bp, Artificial Sequence
  chemically synthesized
tctacaaaaaataaaaaaat

SEQ ID NO: 55273 - DNA, 20 bp, Artificial Sequence
  chemically synthesized
caaaaaataaaaaaattagc

SEQ ID NO: 55274 - DNA, 20 bp, Artificial Sequence
  chemically synthesized
aaaaaataaaaaaattagcc

SEQ ID NO: 55275 - DNA, 20 bp, Artificial Sequence
  chemically synthesized
ataaaaaaattagccaggca

SEQ ID NO: 55276 - DNA, 20 bp, Artificial Sequence
  chemically synthesized
aaaaaattagccaggcatgg

SEQ ID NO: 55277 - DNA, 20 bp, Artificial Sequence
  chemically synthesized
ggcatggtggtacgcatctg

SEQ ID NO: 55278 - DNA, 20 bp, Artificial Sequence
  chemically synthesized
gtggtacgcatctgtagtcc

SEQ ID NO: 55279 - DNA, 20 bp, Artificial Sequence
  chemically synthesized
catctgtagtcccagctatt

SEQ ID NO: 55280 - DNA, 20 bp, Artificial Sequence
  chemically synthesized
atctgtagtcccagctattc

SEQ ID NO: 55281 - DNA, 20 bp, Artificial Sequence
  chemically synthesized
ctgtagtcccagctattcgg

SEQ ID NO: 55282 - DNA, 20 bp, Artificial Sequence
  chemically synthesized
tgtagtcccagctattcggg

SEQ ID NO: 55283 - DNA, 20 bp, Artificial Sequence
  chemically synthesized
tcccagctattcgggaggct

SEQ ID NO: 55284 - DNA, 20 bp, Artificial Sequence
  chemically synthesized
cccagctattcgggaggctg

SEQ ID NO: 55285 - DNA, 20 bp, Artificial Sequence
  chemically synthesized
gctattcgggaggctgaggc

SEQ ID NO: 55286 - DNA, 20 bp, Artificial Sequence
  chemically synthesized
tattcgggaggctgaggctg

SEQ ID NO: 55287 - DNA, 20 bp, Artificial Sequence
  chemically synthesized
attcgggaggctgaggctgg

SEQ ID NO: 55288 - DNA, 20 bp, Artificial Sequence
  chemically synthesized
ctgaggctggaggatcattt

SEQ ID NO: 55289 - DNA, 20 bp, Artificial Sequence
  chemically synthesized
ctggaggatcatttgagccc

SEQ ID NO: 55290 - DNA, 20 bp, Artificial Sequence
  chemically synthesized
tggaggatcatttgagcccc

SEQ ID NO: 55291 - DNA, 20 bp, Artificial Sequence
  chemically synthesized
gaggatcatttgagccccag

SEQ ID NO: 55292 - DNA, 20 bp, Artificial Sequence
  chemically synthesized
atcatttgagccccaggagt

SEQ ID NO: 55293 - DNA, 20 bp, Artificial Sequence
  chemically synthesized
catttgagccccaggagttg

SEQ ID NO: 55294 - DNA, 20 bp, Artificial Sequence
  chemically synthesized
atttgagccccaggagttgg

SEQ ID NO: 55295 - DNA, 20 bp, Artificial Sequence
  chemically synthesized
gccccaggagttggaggttg

SEQ ID NO: 55296 - DNA, 20 bp, Artificial Sequence
  chemically synthesized
caggagttggaggttgcagt

SEQ ID NO: 55297 - DNA, 20 bp, Artificial Sequence
  chemically synthesized
gttggaggttgcagtgagct

SEQ ID NO: 55298 - DNA, 20 bp, Artificial Sequence
  chemically synthesized
gagattgcgccattgcaccc

SEQ ID NO: 55299 - DNA, 20 bp, Artificial Sequence
  chemically synthesized
tgcgccattgcaccccagcc

SEQ ID NO: 55300 - DNA, 20 bp, Artificial Sequence
  chemically synthesized
gcgccattgcaccccagcct

SEQ ID NO: 55301 - DNA, 20 bp, Artificial Sequence
  chemically synthesized
ttgcaccccagcctgggtga

SEQ ID NO: 55302 - DNA, 20 bp, Artificial Sequence
  chemically synthesized
gcaccccagcctgggtgaca

SEQ ID NO: 55303 - DNA, 20 bp, Artificial Sequence
  chemically synthesized
cccagcctgggtgacagagt

SEQ ID NO: 55304 - DNA, 20 bp, Artificial Sequence
  chemically synthesized
aaaataaaataaaataaaat

SEQ ID NO: 55305 - DNA, 20 bp, Artificial Sequence
  chemically synthesized
ataagataaaataaaataaa

SEQ ID NO: 55306 - DNA, 20 bp, Artificial Sequence
  chemically synthesized
aaccaaaaccacaaaaacct

SEQ ID NO: 55307 - DNA, 20 bp, Artificial Sequence
  chemically synthesized
accacaaaaacctaagcctt

SEQ ID NO: 55308 - DNA, 20 bp, Artificial Sequence
  chemically synthesized
cctttggtctatgtgtgatg

SEQ ID NO: 55309 - DNA, 20 bp, Artificial Sequence
  chemically synthesized
ttggtctatgtgtgatgtgg

SEQ ID NO: 55310 - DNA, 20 bp, Artificial Sequence
  chemically synthesized
tatgtgtgatgtggcagcac

SEQ ID NO: 55311 - DNA, 20 bp, Artificial Sequence
  chemically synthesized
tgtggcagcactggtccacg

SEQ ID NO: 55312 - DNA, 20 bp, Artificial Sequence
  chemically synthesized
ggcagcactggtccacgcag

SEQ ID NO: 55313 - DNA, 20 bp, Artificial Sequence
  chemically synthesized
agcactggtccacgcagcag

SEQ ID NO: 55314 - DNA, 20 bp, Artificial Sequence
  chemically synthesized
ctggtccacgcagcagaagt

SEQ ID NO: 55315 - DNA, 20 bp, Artificial Sequence
  chemically synthesized
cagaagttggacttccttaa

SEQ ID NO: 55316 - DNA, 20 bp, Artificial Sequence
  chemically synthesized
agaagttggacttccttaat

SEQ ID NO: 55317 - DNA, 20 bp, Artificial Sequence
  chemically synthesized
cttaatgggtctattttctt

SEQ ID NO: 55318 - DNA, 20 bp, Artificial Sequence
  chemically synthesized
ttaatgggtctattttcttt

SEQ ID NO: 55319 - DNA, 20 bp, Artificial Sequence
  chemically synthesized
ctattttctttgggcaataa

SEQ ID NO: 55320 - DNA, 20 bp, Artificial Sequence
  chemically synthesized
tgtgtgtgtgtatcatcctc

SEQ ID NO: 55321 - DNA, 20 bp, Artificial Sequence
  chemically synthesized
cctgaaaactgatacactac

SEQ ID NO: 55322 - DNA, 20 bp, Artificial Sequence
  chemically synthesized
aattatgccataacatgaca

SEQ ID NO: 55323 - DNA, 20 bp, Artificial Sequence
  chemically synthesized
ccttgctttaaaactgtcat

SEQ ID NO: 55324 - DNA, 20 bp, Artificial Sequence
  chemically synthesized
gtcacttaaacttgcctcac

SEQ ID NO: 55325 - DNA, 20 bp, Artificial Sequence
  chemically synthesized
tgcctcacaagccatttcta

SEQ ID NO: 55326 - DNA, 20 bp, Artificial Sequence
  chemically synthesized
ctcacaagccatttctaaag

SEQ ID NO: 55327 - DNA, 20 bp, Artificial Sequence
  chemically synthesized
gtggacgtaaatctataact

SEQ ID NO: 55328 - DNA, 20 bp, Artificial Sequence
  chemically synthesized
tggacgtaaatctataactt

SEQ ID NO: 55329 - DNA, 20 bp, Artificial Sequence
  chemically synthesized
ggacgtaaatctataactta

SEQ ID NO: 55330 - DNA, 20 bp, Artificial Sequence
  chemically synthesized
taaatctataacttagggaa

SEQ ID NO: 55331 - DNA, 20 bp, Artificial Sequence
  chemically synthesized
ctataacttagggaacagat

SEQ ID NO: 55332 - DNA, 20 bp, Artificial Sequence
  chemically synthesized
atcaaaatgttctgtctaat

SEQ ID NO: 55333 - DNA, 20 bp, Artificial Sequence
  chemically synthesized
aaaatgttctgtctaataag

SEQ ID NO: 55334 - DNA, 20 bp, Artificial Sequence
  chemically synthesized
aaatgttctgtctaataagc

SEQ ID NO: 55335 - DNA, 20 bp, Artificial Sequence
  chemically synthesized
caaaatgattattttgtatc

SEQ ID NO: 55336 - DNA, 20 bp, Artificial Sequence
  chemically synthesized
aaaatgattattttgtatct

SEQ ID NO: 55337 - DNA, 20 bp, Artificial Sequence
  chemically synthesized
ttattttgtatctgggatta

SEQ ID NO: 55338 - DNA, 20 bp, Artificial Sequence
  chemically synthesized
tattttgtatctgggattac

SEQ ID NO: 55339 - DNA, 20 bp, Artificial Sequence
  chemically synthesized
gtatctgggattacaggcgc

SEQ ID NO: 55340 - DNA, 20 bp, Artificial Sequence
  chemically synthesized
gggattacaggcgcgagcca

SEQ ID NO: 55341 - DNA, 20 bp, Artificial Sequence
  chemically synthesized
caggcgcgagccacagcacc

SEQ ID NO: 55342 - DNA, 20 bp, Artificial Sequence
  chemically synthesized
gcgagccacagcacccagcc

SEQ ID NO: 55343 - DNA, 20 bp, Artificial Sequence
  chemically synthesized
tcttttttttttttttttct

SEQ ID NO: 55344 - DNA, 20 bp, Artificial Sequence
  chemically synthesized
ttttttttttttttctgaga

SEQ ID NO: 55345 - DNA, 20 bp, Artificial Sequence
  chemically synthesized
tttttttttttttctgagac

SEQ ID NO: 55346 - DNA, 20 bp, Artificial Sequence
  chemically synthesized
ttttttttttttctgagaca

SEQ ID NO: 55347 - DNA, 20 bp, Artificial Sequence
  chemically synthesized
cagggtctcactctgtcacc

SEQ ID NO: 55348 - DNA, 20 bp, Artificial Sequence
  chemically synthesized
agggtctcactctgtcaccc

SEQ ID NO: 55349 - DNA, 20 bp, Artificial Sequence
  chemically synthesized
tctcactctgtcacccaggc

SEQ ID NO: 55350 - DNA, 20 bp, Artificial Sequence
  chemically synthesized
tcactctgtcacccaggctg

SEQ ID NO: 55351 - DNA, 20 bp, Artificial Sequence
  chemically synthesized
ctgtcacccaggctggagtg

SEQ ID NO: 55352 - DNA, 20 bp, Artificial Sequence
  chemically synthesized
tcacccaggctggagtgcag

SEQ ID NO: 55353 - DNA, 20 bp, Artificial Sequence
  chemically synthesized
ggagtgcagtggcataatct

SEQ ID NO: 55354 - DNA, 20 bp, Artificial Sequence
  chemically synthesized
cttggctcactgcaacctct

SEQ ID NO: 55355 - DNA, 20 bp, Artificial Sequence
  chemically synthesized
tcactgcaacctctgagctc

SEQ ID NO: 55356 - DNA, 20 bp, Artificial Sequence
  chemically synthesized
cactgcaacctctgagctca

SEQ ID NO: 55357 - DNA, 20 bp, Artificial Sequence
  chemically synthesized
actgcaacctctgagctcaa

SEQ ID NO: 55358 - DNA, 20 bp, Artificial Sequence
  chemically synthesized
ctcaagggattctcccacct

SEQ ID NO: 55359 - DNA, 20 bp, Artificial Sequence
  chemically synthesized
ttctcccacctcagccacct

SEQ ID NO: 55360 - DNA, 20 bp, Artificial Sequence
  chemically synthesized
tcccacctcagccacctgag

SEQ ID NO: 55361 - DNA, 20 bp, Artificial Sequence
  chemically synthesized
acctcagccacctgagtagt

SEQ ID NO: 55362 - DNA, 20 bp, Artificial Sequence
  chemically synthesized
cctcagccacctgagtagtt

SEQ ID NO: 55363 - DNA, 20 bp, Artificial Sequence
  chemically synthesized
cacctgagtagttaggacca

SEQ ID NO: 55364 - DNA, 20 bp, Artificial Sequence
  chemically synthesized
acctgagtagttaggaccac

SEQ ID NO: 55365 - DNA, 20 bp, Artificial Sequence
  chemically synthesized
caggcatgcaccaccacgct

SEQ ID NO: 55366 - DNA, 20 bp, Artificial Sequence
  chemically synthesized
tggctaatgttttgtatttt

SEQ ID NO: 55367 - DNA, 20 bp, Artificial Sequence
  chemically synthesized
aatgttttgtatttttggta

SEQ ID NO: 55368 - DNA, 20 bp, Artificial Sequence
  chemically synthesized
ttttgtatttttggtataga

SEQ ID NO: 55369 - DNA, 20 bp, Artificial Sequence
  chemically synthesized
tttgtatttttggtatagac

SEQ ID NO: 55370 - DNA, 20 bp, Artificial Sequence
  chemically synthesized
ttgtatttttggtatagacg

SEQ ID NO: 55371 - DNA, 20 bp, Artificial Sequence
  chemically synthesized
tgtatttttggtatagacgg

SEQ ID NO: 55372 - DNA, 20 bp, Artificial Sequence
  chemically synthesized
gggggtctcaccatgttgcc

SEQ ID NO: 55373 - DNA, 20 bp, Artificial Sequence
  chemically synthesized
ggggtctcaccatgttgccc

SEQ ID NO: 55374 - DNA, 20 bp, Artificial Sequence
  chemically synthesized
tctcaccatgttgcccaggc

SEQ ID NO: 55375 - DNA, 20 bp, Artificial Sequence
  chemically synthesized
caggctggtctcgaactcct

SEQ ID NO: 55376 - DNA, 20 bp, Artificial Sequence
  chemically synthesized
tggtctcgaactcctgagct

SEQ ID NO: 55377 - DNA, 20 bp, Artificial Sequence
  chemically synthesized
ggtctcgaactcctgagctc

SEQ ID NO: 55378 - DNA, 20 bp, Artificial Sequence
  chemically synthesized
gctcaggcaatctgccacct

SEQ ID NO: 55379 - DNA, 20 bp, Artificial Sequence
  chemically synthesized
tctgccacctcagcctccca

SEQ ID NO: 55380 - DNA, 20 bp, Artificial Sequence
  chemically synthesized
acctcagcctcccaaagtgc

SEQ ID NO: 55381 - DNA, 20 bp, Artificial Sequence
  chemically synthesized
cctcagcctcccaaagtgct

SEQ ID NO: 55382 - DNA, 20 bp, Artificial Sequence
  chemically synthesized
ctcccaaagtgctgggatta

SEQ ID NO: 55383 - DNA, 20 bp, Artificial Sequence
  chemically synthesized
agtgctgggattacagatgt

SEQ ID NO: 55384 - DNA, 20 bp, Artificial Sequence
  chemically synthesized
cagatgtgagccaccatgcc

SEQ ID NO: 55385 - DNA, 20 bp, Artificial Sequence
  chemically synthesized
gtgagccaccatgcccagcc

SEQ ID NO: 55386 - DNA, 20 bp, Artificial Sequence
  chemically synthesized
agactgcctgatccttaacc

SEQ ID NO: 55387 - DNA, 20 bp, Artificial Sequence
  chemically synthesized
ttaacctggttccaccattc

SEQ ID NO: 55388 - DNA, 20 bp, Artificial Sequence
  chemically synthesized
ctggttccaccattctggac

SEQ ID NO: 55389 - DNA, 20 bp, Artificial Sequence
  chemically synthesized
gacaagatgactaacccctc

SEQ ID NO: 55390 - DNA, 20 bp, Artificial Sequence
  chemically synthesized
tctggacctatttgtaatat

SEQ ID NO: 55391 - DNA, 20 bp, Artificial Sequence
  chemically synthesized
ctggacctatttgtaatata

SEQ ID NO: 55392 - DNA, 20 bp, Artificial Sequence
  chemically synthesized
tgtaatataaggataaatga

SEQ ID NO: 55393 - DNA, 20 bp, Artificial Sequence
  chemically synthesized
aatataaggataaatgacag

SEQ ID NO: 55394 - DNA, 20 bp, Artificial Sequence
  chemically synthesized
aaatgacagtagccaactca

SEQ ID NO: 55395 - DNA, 20 bp, Artificial Sequence
  chemically synthesized
atgacagtagccaactcaca

SEQ ID NO: 55396 - DNA, 20 bp, Artificial Sequence
  chemically synthesized
tagccaactcacagagatgt

SEQ ID NO: 55397 - DNA, 20 bp, Artificial Sequence
  chemically synthesized
agccaactcacagagatgtt

SEQ ID NO: 55398 - DNA, 20 bp, Artificial Sequence
  chemically synthesized
ccaactcacagagatgttgg

SEQ ID NO: 55399 - DNA, 20 bp, Artificial Sequence
  chemically synthesized
acagagatgttgggagaact

SEQ ID NO: 55400 - DNA, 20 bp, Artificial Sequence
  chemically synthesized
agatgttgggagaactaagc

SEQ ID NO: 55401 - DNA, 20 bp, Artificial Sequence
  chemically synthesized
gcgagttaattgtataaata

SEQ ID NO: 55402 - DNA, 20 bp, Artificial Sequence
  chemically synthesized
aattgtataaataaagtaca

SEQ ID NO: 55403 - DNA, 20 bp, Artificial Sequence
  chemically synthesized
tataaataaagtacatagaa

SEQ ID NO: 55404 - DNA, 20 bp, Artificial Sequence
  chemically synthesized
aaagtacatagaacagaatc

SEQ ID NO: 55405 - DNA, 20 bp, Artificial Sequence
  chemically synthesized
atagaacagaatctggcata

SEQ ID NO: 55406 - DNA, 20 bp, Artificial Sequence
  chemically synthesized
aacagaatctggcataaagt

SEQ ID NO: 55407 - DNA, 20 bp, Artificial Sequence
  chemically synthesized
cttatcaacctcataaactt

SEQ ID NO: 55408 - DNA, 20 bp, Artificial Sequence
  chemically synthesized
ttatcaacctcataaacttc

SEQ ID NO: 55409 - DNA, 20 bp, Artificial Sequence
  chemically synthesized
tatcaacctcataaacttca

SEQ ID NO: 55410 - DNA, 20 bp, Artificial Sequence
  chemically synthesized
tcaacctcataaacttcagg

SEQ ID NO: 55411 - DNA, 20 bp, Artificial Sequence
  chemically synthesized
acctcataaacttcagggag

SEQ ID NO: 55412 - DNA, 20 bp, Artificial Sequence
  chemically synthesized
cctcataaacttcagggagt

SEQ ID NO: 55413 - DNA, 20 bp, Artificial Sequence
  chemically synthesized
ctcataaacttcagggagtg

SEQ ID NO: 55414 - DNA, 20 bp, Artificial Sequence
  chemically synthesized
tcataaacttcagggagtgg

SEQ ID NO: 55415 - DNA, 20 bp, Artificial Sequence
  chemically synthesized
taaacttcagggagtggggg

SEQ ID NO: 55416 - DNA, 20 bp, Artificial Sequence
  chemically synthesized
tgggggcagtatttactttc

SEQ ID NO: 55417 - DNA, 20 bp, Artificial Sequence
  chemically synthesized
gggcagtatttactttctgg

SEQ ID NO: 55418 - DNA, 20 bp, Artificial Sequence
  chemically synthesized
ttctggcagacctttcttgt

SEQ ID NO: 55419 - DNA, 20 bp, Artificial Sequence
  chemically synthesized
tctggcagacctttcttgta

SEQ ID NO: 55420 - DNA, 20 bp, Artificial Sequence
  chemically synthesized
gacctttcttgtaaggatct

SEQ ID NO: 55421 - DNA, 20 bp, Artificial Sequence
  chemically synthesized
tcttgtaaggatcttggact

SEQ ID NO: 55422 - DNA, 20 bp, Artificial Sequence
  chemically synthesized
aggatcttggacttggtcct

SEQ ID NO: 55423 - DNA, 20 bp, Artificial Sequence
  chemically synthesized
ggatcttggacttggtcctt

SEQ ID NO: 55424 - DNA, 20 bp, Artificial Sequence
  chemically synthesized
atcttggacttggtccttgg

SEQ ID NO: 55425 - DNA, 20 bp, Artificial Sequence
  chemically synthesized
acttggtccttgggagcaaa

SEQ ID NO: 55426 - DNA, 20 bp, Artificial Sequence
  chemically synthesized
ttgggagcaaatagattatc

SEQ ID NO: 55427 - DNA, 20 bp, Artificial Sequence
  chemically synthesized
tgggagcaaatagattatca

SEQ ID NO: 55428 - DNA, 20 bp, Artificial Sequence
  chemically synthesized
agcaaatagattatcaagga

SEQ ID NO: 55429 - DNA, 20 bp, Artificial Sequence
  chemically synthesized
gcaaatagattatcaaggat

SEQ ID NO: 55430 - DNA, 20 bp, Artificial Sequence
  chemically synthesized
caaatagattatcaaggatg

SEQ ID NO: 55431 - DNA, 20 bp, Artificial Sequence
  chemically synthesized
tcaaggatggggctatgcct

SEQ ID NO: 55432 - DNA, 20 bp, Artificial Sequence
  chemically synthesized
aggatggggctatgcctaag

SEQ ID NO: 55433 - DNA, 20 bp, Artificial Sequence
  chemically synthesized
atggggctatgcctaagcag

SEQ ID NO: 55434 - DNA, 20 bp, Artificial Sequence
  chemically synthesized
tggggctatgcctaagcagt

SEQ ID NO: 55435 - DNA, 20 bp, Artificial Sequence
  chemically synthesized
ggggctatgcctaagcagta

SEQ ID NO: 55436 - DNA, 20 bp, Artificial Sequence
  chemically synthesized
tatgcctaagcagtagggtt

SEQ ID NO: 55437 - DNA, 20 bp, Artificial Sequence
  chemically synthesized
ctaagcagtagggttcagtt

SEQ ID NO: 55438 - DNA, 20 bp, Artificial Sequence
  chemically synthesized
gcagtagggttcagttcaga

SEQ ID NO: 55439 - DNA, 20 bp, Artificial Sequence
  chemically synthesized
agacagatcaaaaccatttc

SEQ ID NO: 55440 - DNA, 20 bp, Artificial Sequence
  chemically synthesized
gatcaaaaccatttctggcc

SEQ ID NO: 55441 - DNA, 20 bp, Artificial Sequence
  chemically synthesized
aaaccatttctggccaagcg

SEQ ID NO: 55442 - DNA, 20 bp, Artificial Sequence
  chemically synthesized
ccatttctggccaagcgcag

SEQ ID NO: 55443 - DNA, 20 bp, Artificial Sequence
  chemically synthesized
agtggctcacactgtaatcc

SEQ ID NO: 55444 - DNA, 20 bp, Artificial Sequence
  chemically synthesized
acactgtaatcccagcactt

SEQ ID NO: 55445 - DNA, 20 bp, Artificial Sequence
  chemically synthesized
cactgtaatcccagcacttt

SEQ ID NO: 55446 - DNA, 20 bp, Artificial Sequence
  chemically synthesized
ctgtaatcccagcactttgg

SEQ ID NO: 55447 - DNA, 20 bp, Artificial Sequence
  chemically synthesized
tgtaatcccagcactttggg

SEQ ID NO: 55448 - DNA, 20 bp, Artificial Sequence
  chemically synthesized
tcccagcactttgggaggct

SEQ ID NO: 55449 - DNA, 20 bp, Artificial Sequence
  chemically synthesized
cccagcactttgggaggctg

SEQ ID NO: 55450 - DNA, 20 bp, Artificial Sequence
  chemically synthesized
agcactttgggaggctgagg

SEQ ID NO: 55451 - DNA, 20 bp, Artificial Sequence
  chemically synthesized
gcactttgggaggctgaggc

SEQ ID NO: 55452 - DNA, 20 bp, Artificial Sequence
  chemically synthesized
actttgggaggctgaggcag

SEQ ID NO: 55453 - DNA, 20 bp, Artificial Sequence
  chemically synthesized
ctttgggaggctgaggcagg

SEQ ID NO: 55454 - DNA, 20 bp, Artificial Sequence
  chemically synthesized
gcaggaggatcacttgaacc

SEQ ID NO: 55455 - DNA, 20 bp, Artificial Sequence
  chemically synthesized
caggaggatcacttgaaccc

SEQ ID NO: 55456 - DNA, 20 bp, Artificial Sequence
  chemically synthesized
ggaggatcacttgaacccag

SEQ ID NO: 55457 - DNA, 20 bp, Artificial Sequence
  chemically synthesized
tcacttgaacccaggagttc

SEQ ID NO: 55458 - DNA, 20 bp, Artificial Sequence
  chemically synthesized
tgaacccaggagttcaagac

SEQ ID NO: 55459 - DNA, 20 bp, Artificial Sequence
  chemically synthesized
ccaggagttcaagaccagcc

SEQ ID NO: 55460 - DNA, 20 bp, Artificial Sequence
  chemically synthesized
caggagttcaagaccagcct

SEQ ID NO: 55461 - DNA, 20 bp, Artificial Sequence
  chemically synthesized
gagttcaagaccagcctggg

SEQ ID NO: 55462 - DNA, 20 bp, Artificial Sequence
  chemically synthesized
caagaccagcctgggcagca

SEQ ID NO: 55463 - DNA, 20 bp, Artificial Sequence
  chemically synthesized
accagcctgggcagcatagt

SEQ ID NO: 55464 - DNA, 20 bp, Artificial Sequence
  chemically synthesized
tctctattaaaaaaaaaaaa

SEQ ID NO: 55465 - DNA, 20 bp, Artificial Sequence
  chemically synthesized
aagactattttctttctccc

SEQ ID NO: 55466 - DNA, 20 bp, Artificial Sequence
  chemically synthesized
ctattttctttctccctggt

SEQ ID NO: 55467 - DNA, 20 bp, Artificial Sequence
  chemically synthesized
tattttctttctccctggtt

SEQ ID NO: 55468 - DNA, 20 bp, Artificial Sequence
  chemically synthesized
ttgggaccatttgattctgt

SEQ ID NO: 55469 - DNA, 20 bp, Artificial Sequence
  chemically synthesized
tgggaccatttgattctgtg

SEQ ID NO: 55470 - DNA, 20 bp, Artificial Sequence
  chemically synthesized
gggaccatttgattctgtga

SEQ ID NO: 55471 - DNA, 20 bp, Artificial Sequence
  chemically synthesized
ggaccatttgattctgtgag

SEQ ID NO: 55472 - DNA, 20 bp, Artificial Sequence
  chemically synthesized
atttgattctgtgaggggcc

SEQ ID NO: 55473 - DNA, 20 bp, Artificial Sequence
  chemically synthesized
tggttcccacaacgccctct

SEQ ID NO: 55474 - DNA, 20 bp, Artificial Sequence
  chemically synthesized
gttcccacaacgccctctga

SEQ ID NO: 55475 - DNA, 20 bp, Artificial Sequence
  chemically synthesized
gccctctgagagcccaaatc

SEQ ID NO: 55476 - DNA, 20 bp, Artificial Sequence
  chemically synthesized
ctctgagagcccaaatccag

SEQ ID NO: 55477 - DNA, 20 bp, Artificial Sequence
  chemically synthesized
tctgagagcccaaatccagt

SEQ ID NO: 55478 - DNA, 20 bp, Artificial Sequence
  chemically synthesized
tgagagcccaaatccagtag

SEQ ID NO: 55479 - DNA, 20 bp, Artificial Sequence
  chemically synthesized
tgcaatcttccctgaatata

SEQ ID NO: 55480 - DNA, 20 bp, Artificial Sequence
  chemically synthesized
ttccctgaatatacagactc

SEQ ID NO: 55481 - DNA, 20 bp, Artificial Sequence
  chemically synthesized
ccctgaatatacagactccg

SEQ ID NO: 55482 - DNA, 20 bp, Artificial Sequence
  chemically synthesized
aatatacagactccggagtt

SEQ ID NO: 55483 - DNA, 20 bp, Artificial Sequence
  chemically synthesized
atatacagactccggagttc

SEQ ID NO: 55484 - DNA, 20 bp, Artificial Sequence
  chemically synthesized
tccggagttcaggtgtgaaa

SEQ ID NO: 55485 - DNA, 20 bp, Artificial Sequence
  chemically synthesized
ggagttcaggtgtgaaatag

SEQ ID NO: 55486 - DNA, 20 bp, Artificial Sequence
  chemically synthesized
agttcaggtgtgaaatagcg

SEQ ID NO: 55487 - DNA, 20 bp, Artificial Sequence
  chemically synthesized
gaaatagcggagcttaccct

SEQ ID NO: 55488 - DNA, 20 bp, Artificial Sequence
  chemically synthesized
aaatagcggagcttaccctc

SEQ ID NO: 55489 - DNA, 20 bp, Artificial Sequence
  chemically synthesized
cctcaggaaatccattgata

SEQ ID NO: 55490 - DNA, 20 bp, Artificial Sequence
  chemically synthesized
cattgatacggtgatgattt

SEQ ID NO: 55491 - DNA, 20 bp, Artificial Sequence
  chemically synthesized
attgatacggtgatgatttg

SEQ ID NO: 55492 - DNA, 20 bp, Artificial Sequence
  chemically synthesized
cggtgatgatttgaggcctt

SEQ ID NO: 55493 - DNA, 20 bp, Artificial Sequence
  chemically synthesized
gtgatgatttgaggcctttg

SEQ ID NO: 55494 - DNA, 20 bp, Artificial Sequence
  chemically synthesized
tgatgatttgaggcctttgg

SEQ ID NO: 55495 - DNA, 20 bp, Artificial Sequence
  chemically synthesized
tggaggtcgaaccctgcacc

SEQ ID NO: 55496 - DNA, 20 bp, Artificial Sequence
  chemically synthesized
ggaggtcgaaccctgcaccc

SEQ ID NO: 55497 - DNA, 20 bp, Artificial Sequence
  chemically synthesized
ccaggatgaaataaatctct

SEQ ID NO: 55498 - DNA, 20 bp, Artificial Sequence
  chemically synthesized
ggatgaaataaatctcttag

SEQ ID NO: 55499 - DNA, 20 bp, Artificial Sequence
  chemically synthesized
atgaaataaatctcttagca

SEQ ID NO: 55500 - DNA, 20 bp, Artificial Sequence
  chemically synthesized
cttagcagagaaacctgcaa

SEQ ID NO: 55501 - DNA, 20 bp, Artificial Sequence
  chemically synthesized
aaacctgcaatagctccctt

SEQ ID NO: 55502 - DNA, 20 bp, Artificial Sequence
  chemically synthesized
tagctcccttgagcattcct

SEQ ID NO: 55503 - DNA, 20 bp, Artificial Sequence
  chemically synthesized
gcattccttggtgctgtgac

SEQ ID NO: 55504 - DNA, 20 bp, Artificial Sequence
  chemically synthesized
gtgctgtgactggctctgtt

SEQ ID NO: 55505 - DNA, 20 bp, Artificial Sequence
  chemically synthesized
cccaaaaccttgctgacact

SEQ ID NO: 55506 - DNA, 20 bp, Artificial Sequence
  chemically synthesized
ccttgctgacactgagttac

SEQ ID NO: 55507 - DNA, 20 bp, Artificial Sequence
  chemically synthesized
gacactgagttactggattc

SEQ ID NO: 55508 - DNA, 20 bp, Artificial Sequence
  chemically synthesized
cactgagttactggattcca

SEQ ID NO: 55509 - DNA, 20 bp, Artificial Sequence
  chemically synthesized
gagttactggattccagagc

SEQ ID NO: 55510 - DNA, 20 bp, Artificial Sequence
  chemically synthesized
actggattccagagctggcc

SEQ ID NO: 55511 - DNA, 20 bp, Artificial Sequence
  chemically synthesized
gccctgattgcttaatttga

SEQ ID NO: 55512 - DNA, 20 bp, Artificial Sequence
  chemically synthesized
gaccctgcccatctactctc

SEQ ID NO: 55513 - DNA, 20 bp, Artificial Sequence
  chemically synthesized
caagttgcaatttgatgcca

SEQ ID NO: 55514 - DNA, 20 bp, Artificial Sequence
  chemically synthesized
agttgcaatttgatgccata

SEQ ID NO: 55515 - DNA, 20 bp, Artificial Sequence
  chemically synthesized
gagcaactcatgctgacttg

SEQ ID NO: 55516 - DNA, 20 bp, Artificial Sequence
  chemically synthesized
actcatgctgacttgtggtc

SEQ ID NO: 55517 - DNA, 20 bp, Artificial Sequence
  chemically synthesized
catgctgacttgtggtctgg

SEQ ID NO: 55518 - DNA, 20 bp, Artificial Sequence
  chemically synthesized
tggtagccaatgttcattct

SEQ ID NO: 55519 - DNA, 20 bp, Artificial Sequence
  chemically synthesized
tggccaactctgaatctttc

SEQ ID NO: 55520 - DNA, 20 bp, Artificial Sequence
  chemically synthesized
ttctggttctatgctgattt

SEQ ID NO: 55521 - DNA, 20 bp, Artificial Sequence
  chemically synthesized
tctggttctatgctgatttt

SEQ ID NO: 55522 - DNA, 20 bp, Artificial Sequence
  chemically synthesized
caactctgcctgtgcccctg

SEQ ID NO: 55523 - DNA, 20 bp, Artificial Sequence
  chemically synthesized
gtgcccctgtggatgcattt

SEQ ID NO: 55524 - DNA, 20 bp, Artificial Sequence
  chemically synthesized
ttaagtctccctatccctaa

SEQ ID NO: 55525 - DNA, 20 bp, Artificial Sequence
  chemically synthesized
taagtctccctatccctaat

SEQ ID NO: 55526 - DNA, 20 bp, Artificial Sequence
  chemically synthesized
cctatccctaatgggactct

SEQ ID NO: 55527 - DNA, 20 bp, Artificial Sequence
  chemically synthesized
atgggactctcggtcaactc

SEQ ID NO: 55528 - DNA, 20 bp, Artificial Sequence
  chemically synthesized
gggactctcggtcaactcaa

SEQ ID NO: 55529 - DNA, 20 bp, Artificial Sequence
  chemically synthesized
gactctcggtcaactcaaga

SEQ ID NO: 55530 - DNA, 20 bp, Artificial Sequence
  chemically synthesized
ctctcggtcaactcaagaga

SEQ ID NO: 55531 - DNA, 20 bp, Artificial Sequence
  chemically synthesized
gagagcacttttcttctcca

SEQ ID NO: 55532 - DNA, 20 bp, Artificial Sequence
  chemically synthesized
agagcacttttcttctccaa

SEQ ID NO: 55533 - DNA, 20 bp, Artificial Sequence
  chemically synthesized
gagcacttttcttctccaaa

SEQ ID NO: 55534 - DNA, 20 bp, Artificial Sequence
  chemically synthesized
tcttctccaaagggaaaatg

SEQ ID NO: 55535 - DNA, 20 bp, Artificial Sequence
  chemically synthesized
cttctccaaagggaaaatgc

SEQ ID NO: 55536 - DNA, 20 bp, Artificial Sequence
  chemically synthesized
ccaaagggaaaatgcaggca

SEQ ID NO: 55537 - DNA, 20 bp, Artificial Sequence
  chemically synthesized
aaagggaaaatgcaggcaca

SEQ ID NO: 55538 - DNA, 20 bp, Artificial Sequence
  chemically synthesized
gagaaaccaaattatttgtt

SEQ ID NO: 55539 - DNA, 20 bp, Artificial Sequence
  chemically synthesized
agaaaccaaattatttgttt

SEQ ID NO: 55540 - DNA, 20 bp, Artificial Sequence
  chemically synthesized
gaaaccaaattatttgttta

SEQ ID NO: 55541 - DNA, 20 bp, Artificial Sequence
  chemically synthesized
aaattatttgtttagggaaa

SEQ ID NO: 55542 - DNA, 20 bp, Artificial Sequence
  chemically synthesized
attatttgtttagggaaaca

SEQ ID NO: 55543 - DNA, 20 bp, Artificial Sequence
  chemically synthesized
tttgtttagggaaacagagc

SEQ ID NO: 55544 - DNA, 20 bp, Artificial Sequence
  chemically synthesized
gggaaacagagctagaaatt

SEQ ID NO: 55545 - DNA, 20 bp, Artificial Sequence
  chemically synthesized
aacagagctagaaatttagt

SEQ ID NO: 55546 - DNA, 20 bp, Artificial Sequence
  chemically synthesized
acagagctagaaatttagtt

SEQ ID NO: 55547 - DNA, 20 bp, Artificial Sequence
  chemically synthesized
agctagaaatttagttgggc

SEQ ID NO: 55548 - DNA, 20 bp, Artificial Sequence
  chemically synthesized
aaatttagttgggccagaat

SEQ ID NO: 55549 - DNA, 20 bp, Artificial Sequence
  chemically synthesized
tgggccagaattagaaactt

SEQ ID NO: 55550 - DNA, 20 bp, Artificial Sequence
  chemically synthesized
atcacattgcatctaaaata

SEQ ID NO: 55551 - DNA, 20 bp, Artificial Sequence
  chemically synthesized
tctaaaatatagtaattaac

SEQ ID NO: 55552 - DNA, 20 bp, Artificial Sequence
  chemically synthesized
catatatatttttcttttca

SEQ ID NO: 55553 - DNA, 20 bp, Artificial Sequence
  chemically synthesized
tttcttttcaaagatgttat

SEQ ID NO: 55554 - DNA, 20 bp, Artificial Sequence
  chemically synthesized
cttttcaaagatgttatgag

SEQ ID NO: 55555 - DNA, 20 bp, Artificial Sequence
  chemically synthesized
ttttcaaagatgttatgagc

SEQ ID NO: 55556 - DNA, 20 bp, Artificial Sequence
  chemically synthesized
caaagatgttatgagcagga

SEQ ID NO: 55557 - DNA, 20 bp, Artificial Sequence
  chemically synthesized
ttgttttgaatgataatgta

SEQ ID NO: 55558 - DNA, 20 bp, Artificial Sequence
  chemically synthesized
tgtatggtatactatataat

SEQ ID NO: 55559 - DNA, 20 bp, Artificial Sequence
  chemically synthesized
atggtatactatataattag

SEQ ID NO: 55560 - DNA, 20 bp, Artificial Sequence
  chemically synthesized
atataattagtagcaaaaac

SEQ ID NO: 55561 - DNA, 20 bp, Artificial Sequence
  chemically synthesized
tataattagtagcaaaaaca

SEQ ID NO: 55562 - DNA, 20 bp, Artificial Sequence
  chemically synthesized
aacaaggactttcaaataaa

SEQ ID NO: 55563 - DNA, 20 bp, Artificial Sequence
  chemically synthesized
acaaggactttcaaataaat

SEQ ID NO: 55564 - DNA, 20 bp, Artificial Sequence
  chemically synthesized
actttcaaataaataggctt

SEQ ID NO: 55565 - DNA, 20 bp, Artificial Sequence
  chemically synthesized
aaataggcttcagctttttt

SEQ ID NO: 55566 - DNA, 20 bp, Artificial Sequence
  chemically synthesized
aataggcttcagcttttttt

SEQ ID NO: 55567 - DNA, 20 bp, Artificial Sequence
  chemically synthesized
ataggcttcagctttttttg

SEQ ID NO: 55568 - DNA, 20 bp, Artificial Sequence
  chemically synthesized
taggcttcagctttttttgg

SEQ ID NO: 55569 - DNA, 20 bp, Artificial Sequence
  chemically synthesized
aggcttcagctttttttggg

SEQ ID NO: 55570 - DNA, 20 bp, Artificial Sequence
  chemically synthesized
cttcagctttttttgggggg

SEQ ID NO: 55571 - DNA, 20 bp, Artificial Sequence
  chemically synthesized
ttcagctttttttggggggt

SEQ ID NO: 55572 - DNA, 20 bp, Artificial Sequence
  chemically synthesized
agctttttttggggggtagg

SEQ ID NO: 55573 - DNA, 20 bp, Artificial Sequence
  chemically synthesized
gctttttttggggggtaggt

SEQ ID NO: 55574 - DNA, 20 bp, Artificial Sequence
  chemically synthesized
ttttttggggggtaggtggg

SEQ ID NO: 55575 - DNA, 20 bp, Artificial Sequence
  chemically synthesized
tttttggggggtaggtgggt

SEQ ID NO: 55576 - DNA, 20 bp, Artificial Sequence
  chemically synthesized
ttttggggggtaggtgggtg

SEQ ID NO: 55577 - DNA, 20 bp, Artificial Sequence
  chemically synthesized
tggggggtaggtgggtgggg

SEQ ID NO: 55578 - DNA, 20 bp, Artificial Sequence
  chemically synthesized
ggcagaaatactctgcatat

SEQ ID NO: 55579 - DNA, 20 bp, Artificial Sequence
  chemically synthesized
aaatactctgcatatcagat

SEQ ID NO: 55580 - DNA, 20 bp, Artificial Sequence
  chemically synthesized
tatcagatgagattgaaaaa

SEQ ID NO: 55581 - DNA, 20 bp, Artificial Sequence
  chemically synthesized
atcagatgagattgaaaaac

SEQ ID NO: 55582 - DNA, 20 bp, Artificial Sequence
  chemically synthesized
gatgagattgaaaaacaggc

SEQ ID NO: 55583 - DNA, 20 bp, Artificial Sequence
  chemically synthesized
atgagattgaaaaacaggca

SEQ ID NO: 55584 - DNA, 20 bp, Artificial Sequence
  chemically synthesized
gagattgaaaaacaggcaag

SEQ ID NO: 55585 - DNA, 20 bp, Artificial Sequence
  chemically synthesized
agattgaaaaacaggcaagg

SEQ ID NO: 55586 - DNA, 20 bp, Artificial Sequence
  chemically synthesized
gattgaaaaacaggcaagga

SEQ ID NO: 55587 - DNA, 20 bp, Artificial Sequence
  chemically synthesized
aaaaacaggcaaggagggcc

SEQ ID NO: 55588 - DNA, 20 bp, Artificial Sequence
  chemically synthesized
caggcaaggagggcccggtg

SEQ ID NO: 55589 - DNA, 20 bp, Artificial Sequence
  chemically synthesized
gcaaggagggcccggtgcgg

SEQ ID NO: 55590 - DNA, 20 bp, Artificial Sequence
  chemically synthesized
gtggctcatgcctgtaatcc

SEQ ID NO: 55591 - DNA, 20 bp, Artificial Sequence
  chemically synthesized
tgcctgtaatcctagcacct

SEQ ID NO: 55592 - DNA, 20 bp, Artificial Sequence
  chemically synthesized
gcctgtaatcctagcacctt

SEQ ID NO: 55593 - DNA, 20 bp, Artificial Sequence
  chemically synthesized
ctgtaatcctagcaccttgg

SEQ ID NO: 55594 - DNA, 20 bp, Artificial Sequence
  chemically synthesized
tgtaatcctagcaccttggg

SEQ ID NO: 55595 - DNA, 20 bp, Artificial Sequence
  chemically synthesized
tcctagcaccttgggaggcc

SEQ ID NO: 55596 - DNA, 20 bp, Artificial Sequence
  chemically synthesized
cctagcaccttgggaggcca

SEQ ID NO: 55597 - DNA, 20 bp, Artificial Sequence
  chemically synthesized
agcaccttgggaggccaagg

SEQ ID NO: 55598 - DNA, 20 bp, Artificial Sequence
  chemically synthesized
gcaccttgggaggccaaggc

SEQ ID NO: 55599 - DNA, 20 bp, Artificial Sequence
  chemically synthesized
ccttgggaggccaaggcagg

SEQ ID NO: 55600 - DNA, 20 bp, Artificial Sequence
  chemically synthesized
ccaaggcaggtggatcactt

SEQ ID NO: 55601 - DNA, 20 bp, Artificial Sequence
  chemically synthesized
caaggcaggtggatcacttg

SEQ ID NO: 55602 - DNA, 20 bp, Artificial Sequence
  chemically synthesized
gcaggtggatcacttgaggt

SEQ ID NO: 55603 - DNA, 20 bp, Artificial Sequence
  chemically synthesized
caggtggatcacttgaggtc

SEQ ID NO: 55604 - DNA, 20 bp, Artificial Sequence
  chemically synthesized
ggtggatcacttgaggtcag

SEQ ID NO: 55605 - DNA, 20 bp, Artificial Sequence
  chemically synthesized
tcacttgaggtcaggagttc

SEQ ID NO: 55606 - DNA, 20 bp, Artificial Sequence
  chemically synthesized
tgaggtcaggagttcgagac

SEQ ID NO: 55607 - DNA, 20 bp, Artificial Sequence
  chemically synthesized
tcaggagttcgagaccagcc

SEQ ID NO: 55608 - DNA, 20 bp, Artificial Sequence
  chemically synthesized
aattctaaaaatataaaaat

SEQ ID NO: 55609 - DNA, 20 bp, Artificial Sequence
  chemically synthesized
taaaaatataaaaattagcc

SEQ ID NO: 55610 - DNA, 20 bp, Artificial Sequence
  chemically synthesized
atataaaaattagcctggca

SEQ ID NO: 55611 - DNA, 20 bp, Artificial Sequence
  chemically synthesized
taaaaattagcctggcatgg

SEQ ID NO: 55612 - DNA, 20 bp, Artificial Sequence
  chemically synthesized
cctggcatggtggtgcacgc

SEQ ID NO: 55613 - DNA, 20 bp, Artificial Sequence
  chemically synthesized
ggcatggtggtgcacgccgg

SEQ ID NO: 55614 - DNA, 20 bp, Artificial Sequence
  chemically synthesized
gtggtgcacgccggtagtcc

SEQ ID NO: 55615 - DNA, 20 bp, Artificial Sequence
  chemically synthesized
cgccggtagtcctagctact

SEQ ID NO: 55616 - DNA, 20 bp, Artificial Sequence
  chemically synthesized
gccggtagtcctagctactg

SEQ ID NO: 55617 - DNA, 20 bp, Artificial Sequence
  chemically synthesized
cggtagtcctagctactgag

SEQ ID NO: 55618 - DNA, 20 bp, Artificial Sequence
  chemically synthesized
ggtagtcctagctactgagg

SEQ ID NO: 55619 - DNA, 20 bp, Artificial Sequence
  chemically synthesized
tcctagctactgaggaggct

SEQ ID NO: 55620 - DNA, 20 bp, Artificial Sequence
  chemically synthesized
tactgaggaggctgagacat

SEQ ID NO: 55621 - DNA, 20 bp, Artificial Sequence
  chemically synthesized
gacatgagaatcgcttgaac

SEQ ID NO: 55622 - DNA, 20 bp, Artificial Sequence
  chemically synthesized
acatgagaatcgcttgaacc

SEQ ID NO: 55623 - DNA, 20 bp, Artificial Sequence
  chemically synthesized
atgagaatcgcttgaaccag

SEQ ID NO: 55624 - DNA, 20 bp, Artificial Sequence
  chemically synthesized
tgagaatcgcttgaaccagg

SEQ ID NO: 55625 - DNA, 20 bp, Artificial Sequence
  chemically synthesized
gaatcgcttgaaccaggagg

SEQ ID NO: 55626 - DNA, 20 bp, Artificial Sequence
  chemically synthesized
atcgcttgaaccaggaggaa

SEQ ID NO: 55627 - DNA, 20 bp, Artificial Sequence
  chemically synthesized
tcgcttgaaccaggaggaag

SEQ ID NO: 55628 - DNA, 20 bp, Artificial Sequence
  chemically synthesized
gaaccaggaggaagaggttg

SEQ ID NO: 55629 - DNA, 20 bp, Artificial Sequence
  chemically synthesized
caggaggaagaggttgcagt

SEQ ID NO: 55630 - DNA, 20 bp, Artificial Sequence
  chemically synthesized
ggaagaggttgcagtgagcc

SEQ ID NO: 55631 - DNA, 20 bp, Artificial Sequence
  chemically synthesized
aagatcgtgccactccactc

SEQ ID NO: 55632 - DNA, 20 bp, Artificial Sequence
  chemically synthesized
cgtgccactccactccagcc

SEQ ID NO: 55633 - DNA, 20 bp, Artificial Sequence
  chemically synthesized
gtgccactccactccagcct

SEQ ID NO: 55634 - DNA, 20 bp, Artificial Sequence
  chemically synthesized
ctccactccagcctgggtga

SEQ ID NO: 55635 - DNA, 20 bp, Artificial Sequence
  chemically synthesized
tccactccagcctgggtgat

SEQ ID NO: 55636 - DNA, 20 bp, Artificial Sequence
  chemically synthesized
taggtgcgccgtctcaaaaa

SEQ ID NO: 55637 - DNA, 20 bp, Artificial Sequence
  chemically synthesized
gtctcaaaaaaagaaaaaaa

SEQ ID NO: 55638 - DNA, 20 bp, Artificial Sequence
  chemically synthesized
aaaaaaagaaaaaaaaagaa

SEQ ID NO: 55639 - DNA, 20 bp, Artificial Sequence
  chemically synthesized
aaaagaaaaaaaaagaaaag

SEQ ID NO: 55640 - DNA, 20 bp, Artificial Sequence
  chemically synthesized
aaagaaaaaaaaagaaaagc

SEQ ID NO: 55641 - DNA, 20 bp, Artificial Sequence
  chemically synthesized
aaaaaaaaagaaaagcaggc

SEQ ID NO: 55642 - DNA, 20 bp, Artificial Sequence
  chemically synthesized
aaaaaaaagaaaagcaggca

SEQ ID NO: 55643 - DNA, 20 bp, Artificial Sequence
  chemically synthesized
aaaaaagaaaagcaggcaag

SEQ ID NO: 55644 - DNA, 20 bp, Artificial Sequence
  chemically synthesized
aaaaagaaaagcaggcaagg

SEQ ID NO: 55645 - DNA, 20 bp, Artificial Sequence
  chemically synthesized
aaagaaaagcaggcaaggag

SEQ ID NO: 55646 - DNA, 20 bp, Artificial Sequence
  chemically synthesized
aaaagcaggcaaggaggagt

SEQ ID NO: 55647 - DNA, 20 bp, Artificial Sequence
  chemically synthesized
gcaggcaaggaggagttggc

SEQ ID NO: 55648 - DNA, 20 bp, Artificial Sequence
  chemically synthesized
gcaaggaggagttggctagc

SEQ ID NO: 55649 - DNA, 20 bp, Artificial Sequence
  chemically synthesized
aggagttggctagctggaca

SEQ ID NO: 55650 - DNA, 20 bp, Artificial Sequence
  chemically synthesized
agttggctagctggacatag

SEQ ID NO: 55651 - DNA, 20 bp, Artificial Sequence
  chemically synthesized
gacatagtggcttgcacctg

SEQ ID NO: 55652 - DNA, 20 bp, Artificial Sequence
  chemically synthesized
gtggcttgcacctgtagtcc

SEQ ID NO: 55653 - DNA, 20 bp, Artificial Sequence
  chemically synthesized
cacctgtagtcccagctacg

SEQ ID NO: 55654 - DNA, 20 bp, Artificial Sequence
  chemically synthesized
acctgtagtcccagctacgc

SEQ ID NO: 55655 - DNA, 20 bp, Artificial Sequence
  chemically synthesized
cccagctacgcgggacgctg

SEQ ID NO: 55656 - DNA, 20 bp, Artificial Sequence
  chemically synthesized
agctacgcgggacgctgtgg

SEQ ID NO: 55657 - DNA, 20 bp, Artificial Sequence
  chemically synthesized
gctacgcgggacgctgtggt

SEQ ID NO: 55658 - DNA, 20 bp, Artificial Sequence
  chemically synthesized
ctacgcgggacgctgtggta

SEQ ID NO: 55659 - DNA, 20 bp, Artificial Sequence
  chemically synthesized
cgcgggacgctgtggtaggg

SEQ ID NO: 55660 - DNA, 20 bp, Artificial Sequence
  chemically synthesized
gcgggacgctgtggtagggt

SEQ ID NO: 55661 - DNA, 20 bp, Artificial Sequence
  chemically synthesized
gggacgctgtggtagggtgg

SEQ ID NO: 55662 - DNA, 20 bp, Artificial Sequence
  chemically synthesized
ggacgctgtggtagggtggg

SEQ ID NO: 55663 - DNA, 20 bp, Artificial Sequence
  chemically synthesized
gtagggtgggaggactgctt

SEQ ID NO: 55664 - DNA, 20 bp, Artificial Sequence
  chemically synthesized
gtgggaggactgcttgagcc

SEQ ID NO: 55665 - DNA, 20 bp, Artificial Sequence
  chemically synthesized
tgggaggactgcttgagccc

SEQ ID NO: 55666 - DNA, 20 bp, Artificial Sequence
  chemically synthesized
ctgcttgagcccaggaattc

SEQ ID NO: 55667 - DNA, 20 bp, Artificial Sequence
  chemically synthesized
gcttgagcccaggaattcaa

SEQ ID NO: 55668 - DNA, 20 bp, Artificial Sequence
  chemically synthesized
tgagcccaggaattcaagag

SEQ ID NO: 55669 - DNA, 20 bp, Artificial Sequence
  chemically synthesized
ccaggaattcaagagcagcc

SEQ ID NO: 55670 - DNA, 20 bp, Artificial Sequence
  chemically synthesized
caggaattcaagagcagcct

SEQ ID NO: 55671 - DNA, 20 bp, Artificial Sequence
  chemically synthesized
caagagcagcctgggcaaca

SEQ ID NO: 55672 - DNA, 20 bp, Artificial Sequence
  chemically synthesized
agcagcctgggcaacatagt

SEQ ID NO: 55673 - DNA, 20 bp, Artificial Sequence
  chemically synthesized
ctgtctcaaaaaaaaaaaaa

SEQ ID NO: 55674 - DNA, 20 bp, Artificial Sequence
  chemically synthesized
gtctcaaaaaaaaaaaaaaa

SEQ ID NO: 55675 - DNA, 20 bp, Artificial Sequence
  chemically synthesized
ctcaaaaaaaaaaaaaaaga

SEQ ID NO: 55676 - DNA, 20 bp, Artificial Sequence
  chemically synthesized
aaaaaaaaaaaaaaagagag

SEQ ID NO: 55677 - DNA, 20 bp, Artificial Sequence
  chemically synthesized
aagatgttgacttttccttt

SEQ ID NO: 55678 - DNA, 20 bp, Artificial Sequence
  chemically synthesized
ttcctttaagaatgtgctct

SEQ ID NO: 55679 - DNA, 20 bp, Artificial Sequence
  chemically synthesized
tttaagaatgtgctcttggt

SEQ ID NO: 55680 - DNA, 20 bp, Artificial Sequence
  chemically synthesized
gaatgtgctcttggttggct

SEQ ID NO: 55681 - DNA, 20 bp, Artificial Sequence
  chemically synthesized
aatgtgctcttggttggctt

SEQ ID NO: 55682 - DNA, 20 bp, Artificial Sequence
  chemically synthesized
tgctcttggttggcttggga

SEQ ID NO: 55683 - DNA, 20 bp, Artificial Sequence
  chemically synthesized
ctcttggttggcttgggata

SEQ ID NO: 55684 - DNA, 20 bp, Artificial Sequence
  chemically synthesized
tggttggcttgggatagaga

SEQ ID NO: 55685 - DNA, 20 bp, Artificial Sequence
  chemically synthesized
ggttggcttgggatagagaa

SEQ ID NO: 55686 - DNA, 20 bp, Artificial Sequence
  chemically synthesized
ttggcttgggatagagaaag

SEQ ID NO: 55687 - DNA, 20 bp, Artificial Sequence
  chemically synthesized
aaggagtcatatttaccctc

SEQ ID NO: 55688 - DNA, 20 bp, Artificial Sequence
  chemically synthesized
aggagtcatatttaccctct

SEQ ID NO: 55689 - DNA, 20 bp, Artificial Sequence
  chemically synthesized
atttaccctctaggaattaa

SEQ ID NO: 55690 - DNA, 20 bp, Artificial Sequence
  chemically synthesized
ctaggaattaaaagtaacac

SEQ ID NO: 55691 - DNA, 20 bp, Artificial Sequence
  chemically synthesized
aggaattaaaagtaacactg

SEQ ID NO: 55692 - DNA, 20 bp, Artificial Sequence
  chemically synthesized
aagtaacactggagtgacct

SEQ ID NO: 55693 - DNA, 20 bp, Artificial Sequence
  chemically synthesized
gtaacactggagtgacctga

SEQ ID NO: 55694 - DNA, 20 bp, Artificial Sequence
  chemically synthesized
aacactggagtgacctgaga

SEQ ID NO: 55695 - DNA, 20 bp, Artificial Sequence
  chemically synthesized
acactggagtgacctgagag

SEQ ID NO: 55696 - DNA, 20 bp, Artificial Sequence
  chemically synthesized
gtgacctgagagaggaatcc

SEQ ID NO: 55697 - DNA, 20 bp, Artificial Sequence
  chemically synthesized
ctccccttgtcattttgccc

SEQ ID NO: 55698 - DNA, 20 bp, Artificial Sequence
  chemically synthesized
tgtcattttgcccaagattt

SEQ ID NO: 55699 - DNA, 20 bp, Artificial Sequence
  chemically synthesized
tcattttgcccaagatttca

SEQ ID NO: 55700 - DNA, 20 bp, Artificial Sequence
  chemically synthesized
agcctaattgaaacatacaa

SEQ ID NO: 55701 - DNA, 20 bp, Artificial Sequence
  chemically synthesized
gaaacatacaaaagcaccac

SEQ ID NO: 55702 - DNA, 20 bp, Artificial Sequence
  chemically synthesized
aacatacaaaagcaccacca

SEQ ID NO: 55703 - DNA, 20 bp, Artificial Sequence
  chemically synthesized
gcaccaccagagtcgccctc

SEQ ID NO: 55704 - DNA, 20 bp, Artificial Sequence
  chemically synthesized
agtcgccctctagccttctg

SEQ ID NO: 55705 - DNA, 20 bp, Artificial Sequence
  chemically synthesized
cctctagccttctgaagatc

SEQ ID NO: 55706 - DNA, 20 bp, Artificial Sequence
  chemically synthesized
ctagccttctgaagatccag

SEQ ID NO: 55707 - DNA, 20 bp, Artificial Sequence
  chemically synthesized
tagccttctgaagatccagt

SEQ ID NO: 55708 - DNA, 20 bp, Artificial Sequence
  chemically synthesized
agccttctgaagatccagtg

SEQ ID NO: 55709 - DNA, 20 bp, Artificial Sequence
  chemically synthesized
cttctgaagatccagtgggg

SEQ ID NO: 55710 - DNA, 20 bp, Artificial Sequence
  chemically synthesized
aagatccagtggggtggatg

SEQ ID NO: 55711 - DNA, 20 bp, Artificial Sequence
  chemically synthesized
gatccagtggggtggatgtg

SEQ ID NO: 55712 - DNA, 20 bp, Artificial Sequence
  chemically synthesized
cagtggggtggatgtggagc

SEQ ID NO: 55713 - DNA, 20 bp, Artificial Sequence
  chemically synthesized
tggggtggatgtggagccag

SEQ ID NO: 55714 - DNA, 20 bp, Artificial Sequence
  chemically synthesized
ggtggatgtggagccagtgg

SEQ ID NO: 55715 - DNA, 20 bp, Artificial Sequence
  chemically synthesized
gtggagccagtggaagaatc

SEQ ID NO: 55716 - DNA, 20 bp, Artificial Sequence
  chemically synthesized
ccagtggaagaatctggaaa

SEQ ID NO: 55717 - DNA, 20 bp, Artificial Sequence
  chemically synthesized
gtggaagaatctggaaaaag

SEQ ID NO: 55718 - DNA, 20 bp, Artificial Sequence
  chemically synthesized
ggaagaatctggaaaaagca

SEQ ID NO: 55719 - DNA, 20 bp, Artificial Sequence
  chemically synthesized
gaatctggaaaaagcagagc

SEQ ID NO: 55720 - DNA, 20 bp, Artificial Sequence
  chemically synthesized
aatctggaaaaagcagagct

SEQ ID NO: 55721 - DNA, 20 bp, Artificial Sequence
  chemically synthesized
aaaagcagagctgggcttat

SEQ ID NO: 55722 - DNA, 20 bp, Artificial Sequence
  chemically synthesized
aaagcagagctgggcttata

SEQ ID NO: 55723 - DNA, 20 bp, Artificial Sequence
  chemically synthesized
agcagagctgggcttataag

SEQ ID NO: 55724 - DNA, 20 bp, Artificial Sequence
  chemically synthesized
gcagagctgggcttataagg

SEQ ID NO: 55725 - DNA, 20 bp, Artificial Sequence
  chemically synthesized
aggaggatgatgtaatgtga

SEQ ID NO: 55726 - DNA, 20 bp, Artificial Sequence
  chemically synthesized
gaggatgatgtaatgtgata

SEQ ID NO: 55727 - DNA, 20 bp, Artificial Sequence
  chemically synthesized
aggatgatgtaatgtgatag

SEQ ID NO: 55728 - DNA, 20 bp, Artificial Sequence
  chemically synthesized
gatgatgtaatgtgatagag

SEQ ID NO: 55729 - DNA, 20 bp, Artificial Sequence
  chemically synthesized
taatgtgatagaggagatgt

SEQ ID NO: 55730 - DNA, 20 bp, Artificial Sequence
  chemically synthesized
tatacctgaatgttttgacc

SEQ ID NO: 55731 - DNA, 20 bp, Artificial Sequence
  chemically synthesized
ttttgacctagtgcaatatc

SEQ ID NO: 55732 - DNA, 20 bp, Artificial Sequence
  chemically synthesized
tttgacctagtgcaatatct

SEQ ID NO: 55733 - DNA, 20 bp, Artificial Sequence
  chemically synthesized
gtgcaatatctgggtcactg

SEQ ID NO: 55734 - DNA, 20 bp, Artificial Sequence
  chemically synthesized
tctgggtcactgcagccatt

SEQ ID NO: 55735 - DNA, 20 bp, Artificial Sequence
  chemically synthesized
ctgcagccattcagaaatcc

SEQ ID NO: 55736 - DNA, 20 bp, Artificial Sequence
  chemically synthesized
tgcagccattcagaaatcca

SEQ ID NO: 55737 - DNA, 20 bp, Artificial Sequence
  chemically synthesized
atacgatgaacatgtatgca

SEQ ID NO: 55738 - DNA, 20 bp, Artificial Sequence
  chemically synthesized
atgcacagtaaaaaaaatac

SEQ ID NO: 55739 - DNA, 20 bp, Artificial Sequence
  chemically synthesized
cacagtaaaaaaaatactag

SEQ ID NO: 55740 - DNA, 20 bp, Artificial Sequence
  chemically synthesized
agtaaaaaaaatactagaag

SEQ ID NO: 55741 - DNA, 20 bp, Artificial Sequence
  chemically synthesized
accatctattaattatactt

SEQ ID NO: 55742 - DNA, 20 bp, Artificial Sequence
  chemically synthesized
tctattaattatacttaagc

SEQ ID NO: 55743 - DNA, 20 bp, Artificial Sequence
  chemically synthesized
taagctggtcccccattact

SEQ ID NO: 55744 - DNA, 20 bp, Artificial Sequence
  chemically synthesized
agctggtcccccattactga

SEQ ID NO: 55745 - DNA, 20 bp, Artificial Sequence
  chemically synthesized
agtgcattactatataatta

SEQ ID NO: 55746 - DNA, 20 bp, Artificial Sequence
  chemically synthesized
actatataattaaagccatt

SEQ ID NO: 55747 - DNA, 20 bp, Artificial Sequence
  chemically synthesized
taattaaagccatttagaca

SEQ ID NO: 55748 - DNA, 20 bp, Artificial Sequence
  chemically synthesized
aaagccatttagacatggct

SEQ ID NO: 55749 - DNA, 20 bp, Artificial Sequence
  chemically synthesized
catttagacatggcttggca

SEQ ID NO: 55750 - DNA, 20 bp, Artificial Sequence
  chemically synthesized
acatactaaaaactcctcct

SEQ ID NO: 55751 - DNA, 20 bp, Artificial Sequence
  chemically synthesized
catactaaaaactcctcctt

SEQ ID NO: 55752 - DNA, 20 bp, Artificial Sequence
  chemically synthesized
actaaaaactcctccttagg

SEQ ID NO: 55753 - DNA, 20 bp, Artificial Sequence
  chemically synthesized
aggcagccttcttttcctat

SEQ ID NO: 55754 - DNA, 20 bp, Artificial Sequence
  chemically synthesized
ccttcttttcctatcagatt

SEQ ID NO: 55755 - DNA, 20 bp, Artificial Sequence
  chemically synthesized
ttcttttcctatcagattca

SEQ ID NO: 55756 - DNA, 20 bp, Artificial Sequence
  chemically synthesized
gagctcctttctccttttct

SEQ ID NO: 55757 - DNA, 20 bp, Artificial Sequence
  chemically synthesized
tcctttctccttttctcggt

SEQ ID NO: 55758 - DNA, 20 bp, Artificial Sequence
  chemically synthesized
tttctcggtaagaatgaaca

SEQ ID NO: 55759 - DNA, 20 bp, Artificial Sequence
  chemically synthesized
ttctcggtaagaatgaacac

SEQ ID NO: 55760 - DNA, 20 bp, Artificial Sequence
  chemically synthesized
tcggtaagaatgaacacagg

SEQ ID NO: 55761 - DNA, 20 bp, Artificial Sequence
  chemically synthesized
gaacacaggtagaaaattct

SEQ ID NO: 55762 - DNA, 20 bp, Artificial Sequence
  chemically synthesized
acaggtagaaaattctcagt

SEQ ID NO: 55763 - DNA, 20 bp, Artificial Sequence
  chemically synthesized
caggtagaaaattctcagtt

SEQ ID NO: 55764 - DNA, 20 bp, Artificial Sequence
  chemically synthesized
aaattctcagttaggatctc

SEQ ID NO: 55765 - DNA, 20 bp, Artificial Sequence
  chemically synthesized
ctcagttaggatctccagcc

SEQ ID NO: 55766 - DNA, 20 bp, Artificial Sequence
  chemically synthesized
tcagttaggatctccagcct

SEQ ID NO: 55767 - DNA, 20 bp, Artificial Sequence
  chemically synthesized
gatctccagcctgggcttgt

SEQ ID NO: 55768 - DNA, 20 bp, Artificial Sequence
  chemically synthesized
tccagcctgggcttgtgagc

SEQ ID NO: 55769 - DNA, 20 bp, Artificial Sequence
  chemically synthesized
gcttgtgagctggccctacc

SEQ ID NO: 55770 - DNA, 20 bp, Artificial Sequence
  chemically synthesized
tgtgagctggccctacctgg

SEQ ID NO: 55771 - DNA, 20 bp, Artificial Sequence
  chemically synthesized
tcttgcttttgtatatgtga

SEQ ID NO: 55772 - DNA, 20 bp, Artificial Sequence
  chemically synthesized
tgcttttgtatatgtgacgg

SEQ ID NO: 55773 - DNA, 20 bp, Artificial Sequence
  chemically synthesized
tgtatatgtgacggaagaat

SEQ ID NO: 55774 - DNA, 20 bp, Artificial Sequence
  chemically synthesized
tatgtgacggaagaataagt

SEQ ID NO: 55775 - DNA, 20 bp, Artificial Sequence
  chemically synthesized
cggaagaataagtaagtctt

SEQ ID NO: 55776 - DNA, 20 bp, Artificial Sequence
  chemically synthesized
ggaagaataagtaagtcttc

SEQ ID NO: 55777 - DNA, 20 bp, Artificial Sequence
  chemically synthesized
gaagaataagtaagtcttca

SEQ ID NO: 55778 - DNA, 20 bp, Artificial Sequence
  chemically synthesized
aagaataagtaagtcttcag

SEQ ID NO: 55779 - DNA, 20 bp, Artificial Sequence
  chemically synthesized
taagtcttcaggggaaaatc

SEQ ID NO: 55780 - DNA, 20 bp, Artificial Sequence
  chemically synthesized
atccagaacaacccaacttc

SEQ ID NO: 55781 - DNA, 20 bp, Artificial Sequence
  chemically synthesized
aacaacccaacttctagcaa

SEQ ID NO: 55782 - DNA, 20 bp, Artificial Sequence
  chemically synthesized
acaacccaacttctagcaac

SEQ ID NO: 55783 - DNA, 20 bp, Artificial Sequence
  chemically synthesized
tagcaacaggtctttctcaa

SEQ ID NO: 55784 - DNA, 20 bp, Artificial Sequence
  chemically synthesized
gtctttctcaatagcttcat

SEQ ID NO: 55785 - DNA, 20 bp, Artificial Sequence
  chemically synthesized
aaaacattacccaatatgat

SEQ ID NO: 55786 - DNA, 20 bp, Artificial Sequence
  chemically synthesized
aaacattacccaatatgatt

SEQ ID NO: 55787 - DNA, 20 bp, Artificial Sequence
  chemically synthesized
caatatgattaggattgtaa

SEQ ID NO: 55788 - DNA, 20 bp, Artificial Sequence
  chemically synthesized
atatgattaggattgtaaaa

SEQ ID NO: 55789 - DNA, 20 bp, Artificial Sequence
  chemically synthesized
tatgattaggattgtaaaag

SEQ ID NO: 55790 - DNA, 20 bp, Artificial Sequence
  chemically synthesized
attgtaaaagaggaccacct

SEQ ID NO: 55791 - DNA, 20 bp, Artificial Sequence
  chemically synthesized
aagaggaccacctgagctga

SEQ ID NO: 55792 - DNA, 20 bp, Artificial Sequence
  chemically synthesized
acctgagctgacagcacctc

SEQ ID NO: 55793 - DNA, 20 bp, Artificial Sequence
  chemically synthesized
cagcacctctggcctcaaaa

SEQ ID NO: 55794 - DNA, 20 bp, Artificial Sequence
  chemically synthesized
agcacctctggcctcaaaat

SEQ ID NO: 55795 - DNA, 20 bp, Artificial Sequence
  chemically synthesized
cctctggcctcaaaatgggc

SEQ ID NO: 55796 - DNA, 20 bp, Artificial Sequence
  chemically synthesized
ctggcctcaaaatgggctgg

SEQ ID NO: 55797 - DNA, 20 bp, Artificial Sequence
  chemically synthesized
gcctcaaaatgggctggcag

SEQ ID NO: 55798 - DNA, 20 bp, Artificial Sequence
  chemically synthesized
ggctggcagaagaccattca

SEQ ID NO: 55799 - DNA, 20 bp, Artificial Sequence
  chemically synthesized
aagaccattcaaagataaaa

SEQ ID NO: 55800 - DNA, 20 bp, Artificial Sequence
  chemically synthesized
agaccattcaaagataaaat

SEQ ID NO: 55801 - DNA, 20 bp, Artificial Sequence
  chemically synthesized
aaagataaaatgggctgttc

SEQ ID NO: 55802 - DNA, 20 bp, Artificial Sequence
  chemically synthesized
gataaaatgggctgttccag

SEQ ID NO: 55803 - DNA, 20 bp, Artificial Sequence
  chemically synthesized
ataaaatgggctgttccagt

SEQ ID NO: 55804 - DNA, 20 bp, Artificial Sequence
  chemically synthesized
aaaatgggctgttccagtgg

SEQ ID NO: 55805 - DNA, 20 bp, Artificial Sequence
  chemically synthesized
tgggctgttccagtgggagt

SEQ ID NO: 55806 - DNA, 20 bp, Artificial Sequence
  chemically synthesized
ggagtgagctccctacttgt

SEQ ID NO: 55807 - DNA, 20 bp, Artificial Sequence
  chemically synthesized
agtgagctccctacttgtga

SEQ ID NO: 55808 - DNA, 20 bp, Artificial Sequence
  chemically synthesized
ccctacttgtgagagtattc

SEQ ID NO: 55809 - DNA, 20 bp, Artificial Sequence
  chemically synthesized
tacttgtgagagtattcaag

SEQ ID NO: 55810 - DNA, 20 bp, Artificial Sequence
  chemically synthesized
cttgtgagagtattcaagta

SEQ ID NO: 55811 - DNA, 20 bp, Artificial Sequence
  chemically synthesized
tgtgagagtattcaagtaga

SEQ ID NO: 55812 - DNA, 20 bp, Artificial Sequence
  chemically synthesized
tgagagtattcaagtagaga

SEQ ID NO: 55813 - DNA, 20 bp, Artificial Sequence
  chemically synthesized
gagagtattcaagtagagag

SEQ ID NO: 55814 - DNA, 20 bp, Artificial Sequence
  chemically synthesized
gagtattcaagtagagagag

SEQ ID NO: 55815 - DNA, 20 bp, Artificial Sequence
  chemically synthesized
agtattcaagtagagagagg

SEQ ID NO: 55816 - DNA, 20 bp, Artificial Sequence
  chemically synthesized
gtagagagaggaggacctcc

SEQ ID NO: 55817 - DNA, 20 bp, Artificial Sequence
  chemically synthesized
gagagaggaggacctcctgg

SEQ ID NO: 55818 - DNA, 20 bp, Artificial Sequence
  chemically synthesized
agagaggaggacctcctggc

SEQ ID NO: 55819 - DNA, 20 bp, Artificial Sequence
  chemically synthesized
cctggcgggaaacttgcata

SEQ ID NO: 55820 - DNA, 20 bp, Artificial Sequence
  chemically synthesized
tgcatatggtgtacgtgata

SEQ ID NO: 55821 - DNA, 20 bp, Artificial Sequence
  chemically synthesized
gatatggcacctccatctga

SEQ ID NO: 55822 - DNA, 20 bp, Artificial Sequence
  chemically synthesized
tatggcacctccatctgaaa

SEQ ID NO: 55823 - DNA, 20 bp, Artificial Sequence
  chemically synthesized
catctgaaagagtctgtgct

SEQ ID NO: 55824 - DNA, 20 bp, Artificial Sequence
  chemically synthesized
atctgaaagagtctgtgctg

SEQ ID NO: 55825 - DNA, 20 bp, Artificial Sequence
  chemically synthesized
tctgaaagagtctgtgctga

SEQ ID NO: 55826 - DNA, 20 bp, Artificial Sequence
  chemically synthesized
gaaagagtctgtgctgaggg

SEQ ID NO: 55827 - DNA, 20 bp, Artificial Sequence
  chemically synthesized
aaagagtctgtgctgagggc

SEQ ID NO: 55828 - DNA, 20 bp, Artificial Sequence
  chemically synthesized
agtctgtgctgagggcaggc

SEQ ID NO: 55829 - DNA, 20 bp, Artificial Sequence
  chemically synthesized
tctgtgctgagggcaggctg

SEQ ID NO: 55830 - DNA, 20 bp, Artificial Sequence
  chemically synthesized
gggcaggctggagtcacaca

SEQ ID NO: 55831 - DNA, 20 bp, Artificial Sequence
  chemically synthesized
ggcaggctggagtcacacat

SEQ ID NO: 55832 - DNA, 20 bp, Artificial Sequence
  chemically synthesized
ctggagtcacacatgggaat

SEQ ID NO: 55833 - DNA, 20 bp, Artificial Sequence
  chemically synthesized
agtcacacatgggaataagc

SEQ ID NO: 55834 - DNA, 20 bp, Artificial Sequence
  chemically synthesized
gtcacacatgggaataagcc

SEQ ID NO: 55835 - DNA, 20 bp, Artificial Sequence
  chemically synthesized
tccgtgatttaattccacga

SEQ ID NO: 55836 - DNA, 20 bp, Artificial Sequence
  chemically synthesized
gtgatttaattccacgacgg

SEQ ID NO: 55837 - DNA, 20 bp, Artificial Sequence
  chemically synthesized
ttaattccacgacggcagaa

SEQ ID NO: 55838 - DNA, 20 bp, Artificial Sequence
  chemically synthesized
ttccacgacggcagaatgga

SEQ ID NO: 55839 - DNA, 20 bp, Artificial Sequence
  chemically synthesized
atgtcacttgctccaaatac

SEQ ID NO: 55840 - DNA, 20 bp, Artificial Sequence
  chemically synthesized
ccagtgcccattgcttcaaa

SEQ ID NO: 55841 - DNA, 20 bp, Artificial Sequence
  chemically synthesized
gtgcccattgcttcaaatag

SEQ ID NO: 55842 - DNA, 20 bp, Artificial Sequence
  chemically synthesized
tagtagtcctcctcaatccc

SEQ ID NO: 55843 - DNA, 20 bp, Artificial Sequence
  chemically synthesized
gtcctcctcaatccctggca

SEQ ID NO: 55844 - DNA, 20 bp, Artificial Sequence
  chemically synthesized
gttgttgactttaaacaccg

SEQ ID NO: 55845 - DNA, 20 bp, Artificial Sequence
  chemically synthesized
tcttacaacgacttcttgtg

SEQ ID NO: 55846 - DNA, 20 bp, Artificial Sequence
  chemically synthesized
acaacgacttcttgtgcggc

SEQ ID NO: 55847 - DNA, 20 bp, Artificial Sequence
  chemically synthesized
gacttcttgtgcggctggcc

SEQ ID NO: 55848 - DNA, 20 bp, Artificial Sequence
  chemically synthesized
acttcttgtgcggctggccc

SEQ ID NO: 55849 - DNA, 20 bp, Artificial Sequence
  chemically synthesized
tgtgcggctggcccaggacc

SEQ ID NO: 55850 - DNA, 20 bp, Artificial Sequence
  chemically synthesized
gtgcggctggcccaggacct

SEQ ID NO: 55851 - DNA, 20 bp, Artificial Sequence
  chemically synthesized
ggctggcccaggacctgggc

SEQ ID NO: 55852 - DNA, 20 bp, Artificial Sequence
  chemically synthesized
gctggcccaggacctgggcg

SEQ ID NO: 55853 - DNA, 20 bp, Artificial Sequence
  chemically synthesized
ggcccaggacctgggcgagg

SEQ ID NO: 55854 - DNA, 20 bp, Artificial Sequence
  chemically synthesized
ccaggacctgggcgaggcag

SEQ ID NO: 55855 - DNA, 20 bp, Artificial Sequence
  chemically synthesized
caggacctgggcgaggcagt

SEQ ID NO: 55856 - DNA, 20 bp, Artificial Sequence
  chemically synthesized
aggacctgggcgaggcagta

SEQ ID NO: 55857 - DNA, 20 bp, Artificial Sequence
  chemically synthesized
ggacctgggcgaggcagtag

SEQ ID NO: 55858 - DNA, 20 bp, Artificial Sequence
  chemically synthesized
gcagtaggggatgacactga

SEQ ID NO: 55859 - DNA, 20 bp, Artificial Sequence
  chemically synthesized
gggatgacactgacggatgc

SEQ ID NO: 55860 - DNA, 20 bp, Artificial Sequence
  chemically synthesized
ggatgacactgacggatgcc

SEQ ID NO: 55861 - DNA, 20 bp, Artificial Sequence
  chemically synthesized
gatgacactgacggatgcca

SEQ ID NO: 55862 - DNA, 20 bp, Artificial Sequence
  chemically synthesized
atgacactgacggatgccag

SEQ ID NO: 55863 - DNA, 20 bp, Artificial Sequence
  chemically synthesized
ggggcactaccgcactcttg

SEQ ID NO: 55864 - DNA, 20 bp, Artificial Sequence
  chemically synthesized
gcactaccgcactcttgcag

SEQ ID NO: 55865 - DNA, 20 bp, Artificial Sequence
  chemically synthesized
cactaccgcactcttgcaga

SEQ ID NO: 55866 - DNA, 20 bp, Artificial Sequence
  chemically synthesized
ccgcactcttgcagaaggac

SEQ ID NO: 55867 - DNA, 20 bp, Artificial Sequence
  chemically synthesized
tcttgcagaaggacaagacg

SEQ ID NO: 55868 - DNA, 20 bp, Artificial Sequence
  chemically synthesized
tgcagaaggacaagacgtag

SEQ ID NO: 55869 - DNA, 20 bp, Artificial Sequence
  chemically synthesized
aaggacaagacgtagaagac

SEQ ID NO: 55870 - DNA, 20 bp, Artificial Sequence
  chemically synthesized
cgtagaagaccagctcgact

SEQ ID NO: 55871 - DNA, 20 bp, Artificial Sequence
  chemically synthesized
gtagaagaccagctcgactt

SEQ ID NO: 55872 - DNA, 20 bp, Artificial Sequence
  chemically synthesized
aagaccagctcgacttggga

SEQ ID NO: 55873 - DNA, 20 bp, Artificial Sequence
  chemically synthesized
agaccagctcgacttgggat

SEQ ID NO: 55874 - DNA, 20 bp, Artificial Sequence
  chemically synthesized
gaccagctcgacttgggatg

SEQ ID NO: 55875 - DNA, 20 bp, Artificial Sequence
  chemically synthesized
accagctcgacttgggatgg

SEQ ID NO: 55876 - DNA, 20 bp, Artificial Sequence
  chemically synthesized
cgacttgggatgggggtttc

SEQ ID NO: 55877 - DNA, 20 bp, Artificial Sequence
  chemically synthesized
gacttgggatgggggtttca

SEQ ID NO: 55878 - DNA, 20 bp, Artificial Sequence
  chemically synthesized
cttgggatgggggtttcaag

SEQ ID NO: 55879 - DNA, 20 bp, Artificial Sequence
  chemically synthesized
atgggggtttcaaggagtca

SEQ ID NO: 55880 - DNA, 20 bp, Artificial Sequence
  chemically synthesized
ttcaaggagtcaaagacgtg

SEQ ID NO: 55881 - DNA, 20 bp, Artificial Sequence
  chemically synthesized
tcaaggagtcaaagacgtgc

SEQ ID NO: 55882 - DNA, 20 bp, Artificial Sequence
  chemically synthesized
aaggagtcaaagacgtgcag

SEQ ID NO: 55883 - DNA, 20 bp, Artificial Sequence
  chemically synthesized
aggagtcaaagacgtgcagg

SEQ ID NO: 55884 - DNA, 20 bp, Artificial Sequence
  chemically synthesized
tcaaagacgtgcaggaggac

SEQ ID NO: 55885 - DNA, 20 bp, Artificial Sequence
  chemically synthesized
caaagacgtgcaggaggacg

SEQ ID NO: 55886 - DNA, 20 bp, Artificial Sequence
  chemically synthesized
aaagacgtgcaggaggacga

SEQ ID NO: 55887 - DNA, 20 bp, Artificial Sequence
  chemically synthesized
agacgtgcaggaggacgagg

SEQ ID NO: 55888 - DNA, 20 bp, Artificial Sequence
  chemically synthesized
gacgtgcaggaggacgaggg

SEQ ID NO: 55889 - DNA, 20 bp, Artificial Sequence
  chemically synthesized
gaggacgagggaggctacaa

SEQ ID NO: 55890 - DNA, 20 bp, Artificial Sequence
  chemically synthesized
ggacgagggaggctacaata

SEQ ID NO: 55891 - DNA, 20 bp, Artificial Sequence
  chemically synthesized
agggaggctacaatagagct

SEQ ID NO: 55892 - DNA, 20 bp, Artificial Sequence
  chemically synthesized
gggaggctacaatagagctg

SEQ ID NO: 55893 - DNA, 20 bp, Artificial Sequence
  chemically synthesized
aggctacaatagagctgagg

SEQ ID NO: 55894 - DNA, 20 bp, Artificial Sequence
  chemically synthesized
acaatagagctgaggcggaa

SEQ ID NO: 55895 - DNA, 20 bp, Artificial Sequence
  chemically synthesized
caatagagctgaggcggaat

SEQ ID NO: 55896 - DNA, 20 bp, Artificial Sequence
  chemically synthesized
atagagctgaggcggaatgg

SEQ ID NO: 55897 - DNA, 20 bp, Artificial Sequence
  chemically synthesized
cggaatgggagccacttgct

SEQ ID NO: 55898 - DNA, 20 bp, Artificial Sequence
  chemically synthesized
acttgctgagtttccccttg

SEQ ID NO: 55899 - DNA, 20 bp, Artificial Sequence
  chemically synthesized
gcagctctccctgtacatgc

SEQ ID NO: 55900 - DNA, 20 bp, Artificial Sequence
  chemically synthesized
agctctccctgtacatgctg

SEQ ID NO: 55901 - DNA, 20 bp, Artificial Sequence
  chemically synthesized
tccctgtacatgctggagtt

SEQ ID NO: 55902 - DNA, 20 bp, Artificial Sequence
  chemically synthesized
cctgtacatgctggagttga

SEQ ID NO: 55903 - DNA, 20 bp, Artificial Sequence
  chemically synthesized
tacatgctggagttgagagc

SEQ ID NO: 55904 - DNA, 20 bp, Artificial Sequence
  chemically synthesized
ctggagttgagagccagccc

SEQ ID NO: 55905 - DNA, 20 bp, Artificial Sequence
  chemically synthesized
tggagttgagagccagcccc

SEQ ID NO: 55906 - DNA, 20 bp, Artificial Sequence
  chemically synthesized
tgagagccagccccaggcca

SEQ ID NO: 55907 - DNA, 20 bp, Artificial Sequence
  chemically synthesized
agagccagccccaggccaaa

SEQ ID NO: 55908 - DNA, 20 bp, Artificial Sequence
  chemically synthesized
cccaggccaaagagcgtgcc

SEQ ID NO: 55909 - DNA, 20 bp, Artificial Sequence
  chemically synthesized
ccaggccaaagagcgtgccc

SEQ ID NO: 55910 - DNA, 20 bp, Artificial Sequence
  chemically synthesized
aagagcgtgcccaggttctt

SEQ ID NO: 55911 - DNA, 20 bp, Artificial Sequence
  chemically synthesized
agagcgtgcccaggttcttg

SEQ ID NO: 55912 - DNA, 20 bp, Artificial Sequence
  chemically synthesized
agcgtgcccaggttcttgag

SEQ ID NO: 55913 - DNA, 20 bp, Artificial Sequence
  chemically synthesized
gcgtgcccaggttcttgagg

SEQ ID NO: 55914 - DNA, 20 bp, Artificial Sequence
  chemically synthesized
gcccaggttcttgaggaggc

SEQ ID NO: 55915 - DNA, 20 bp, Artificial Sequence
  chemically synthesized
ggttcttgaggaggctggca

SEQ ID NO: 55916 - DNA, 20 bp, Artificial Sequence
  chemically synthesized
gttcttgaggaggctggcaa

SEQ ID NO: 55917 - DNA, 20 bp, Artificial Sequence
  chemically synthesized
ttcttgaggaggctggcaaa

SEQ ID NO: 55918 - DNA, 20 bp, Artificial Sequence
  chemically synthesized
gaggaggctggcaaagggtg

SEQ ID NO: 55919 - DNA, 20 bp, Artificial Sequence
  chemically synthesized
caaagggtgtggtgtcaatg

SEQ ID NO: 55920 - DNA, 20 bp, Artificial Sequence
  chemically synthesized
gtgtcaatgtggacccattc

SEQ ID NO: 55921 - DNA, 20 bp, Artificial Sequence
  chemically synthesized
ctggctgctcgcaccacctc

SEQ ID NO: 55922 - DNA, 20 bp, Artificial Sequence
  chemically synthesized
tggctgctcgcaccacctct

SEQ ID NO: 55923 - DNA, 20 bp, Artificial Sequence
  chemically synthesized
caccacctctgggctttctc

SEQ ID NO: 55924 - DNA, 20 bp, Artificial Sequence
  chemically synthesized
ccacctctgggctttctcca

SEQ ID NO: 55925 - DNA, 20 bp, Artificial Sequence
  chemically synthesized
tgggctttctccagagtcca

SEQ ID NO: 55926 - DNA, 20 bp, Artificial Sequence
  chemically synthesized
gggctttctccagagtccac

SEQ ID NO: 55927 - DNA, 20 bp, Artificial Sequence
  chemically synthesized
gctttctccagagtccacag

SEQ ID NO: 55928 - DNA, 20 bp, Artificial Sequence
  chemically synthesized
ctttctccagagtccacagg

SEQ ID NO: 55929 - DNA, 20 bp, Artificial Sequence
  chemically synthesized
gtccacaggaggtctacacc

SEQ ID NO: 55930 - DNA, 20 bp, Artificial Sequence
  chemically synthesized
aggtctacacccagtccctt

SEQ ID NO: 55931 - DNA, 20 bp, Artificial Sequence
  chemically synthesized
tctacacccagtcccttgag

SEQ ID NO: 55932 - DNA, 20 bp, Artificial Sequence
  chemically synthesized
acacccagtcccttgagcag

SEQ ID NO: 55933 - DNA, 20 bp, Artificial Sequence
  chemically synthesized
gagcagcagataaaatccga

SEQ ID NO: 55934 - DNA, 20 bp, Artificial Sequence
  chemically synthesized
gcagataaaatccgatggcg

SEQ ID NO: 55935 - DNA, 20 bp, Artificial Sequence
  chemically synthesized
aatccgatggcgaagctgaa

SEQ ID NO: 55936 - DNA, 20 bp, Artificial Sequence
  chemically synthesized
atccgatggcgaagctgaac

SEQ ID NO: 55937 - DNA, 20 bp, Artificial Sequence
  chemically synthesized
cgatggcgaagctgaacagg

SEQ ID NO: 55938 - DNA, 20 bp, Artificial Sequence
  chemically synthesized
tggcgaagctgaacaggaag

SEQ ID NO: 55939 - DNA, 20 bp, Artificial Sequence
  chemically synthesized
ggcgaagctgaacaggaaga

SEQ ID NO: 55940 - DNA, 20 bp, Artificial Sequence
  chemically synthesized
ctgaacaggaagaaggtaat

SEQ ID NO: 55941 - DNA, 20 bp, Artificial Sequence
  chemically synthesized
gtaatgagaaaatatttctt

SEQ ID NO: 55942 - DNA, 20 bp, Artificial Sequence
  chemically synthesized
taatgagaaaatatttcttg

SEQ ID NO: 55943 - DNA, 20 bp, Artificial Sequence
  chemically synthesized
gagaaaatatttcttgaggc

SEQ ID NO: 55944 - DNA, 20 bp, Artificial Sequence
  chemically synthesized
atttcttgaggctggcatta

SEQ ID NO: 55945 - DNA, 20 bp, Artificial Sequence
  chemically synthesized
ggctggcattatagatgctg

SEQ ID NO: 55946 - DNA, 20 bp, Artificial Sequence
  chemically synthesized
cattatagatgctgtggatg

SEQ ID NO: 55947 - DNA, 20 bp, Artificial Sequence
  chemically synthesized
gatgctgtggatgtggctga

SEQ ID NO: 55948 - DNA, 20 bp, Artificial Sequence
  chemically synthesized
gtggctgaaagtttctgcaa

SEQ ID NO: 55949 - DNA, 20 bp, Artificial Sequence
  chemically synthesized
tttctgcaacagcaatgcct

SEQ ID NO: 55950 - DNA, 20 bp, Artificial Sequence
  chemically synthesized
ctgcaacagcaatgcctgag

SEQ ID NO: 55951 - DNA, 20 bp, Artificial Sequence
  chemically synthesized
caacagcaatgcctgagtgg

SEQ ID NO: 55952 - DNA, 20 bp, Artificial Sequence
  chemically synthesized
agcaatgcctgagtggaaga

SEQ ID NO: 55953 - DNA, 20 bp, Artificial Sequence
  chemically synthesized
gtggaagaaagcatgactgt

SEQ ID NO: 55954 - DNA, 20 bp, Artificial Sequence
  chemically synthesized
ggaagaaagcatgactgtga

SEQ ID NO: 55955 - DNA, 20 bp, Artificial Sequence
  chemically synthesized
gaaagcatgactgtgagaga

SEQ ID NO: 55956 - DNA, 20 bp, Artificial Sequence
  chemically synthesized
aaagcatgactgtgagagat

SEQ ID NO: 55957 - DNA, 20 bp, Artificial Sequence
  chemically synthesized
gcatgactgtgagagatagg

SEQ ID NO: 55958 - DNA, 20 bp, Artificial Sequence
  chemically synthesized
catgactgtgagagatagga

SEQ ID NO: 55959 - DNA, 20 bp, Artificial Sequence
  chemically synthesized
tgtgagagataggaaggatt

SEQ ID NO: 55960 - DNA, 20 bp, Artificial Sequence
  chemically synthesized
gtgagagataggaaggattt

SEQ ID NO: 55961 - DNA, 20 bp, Artificial Sequence
  chemically synthesized
gaaggatttgggacctttgc

SEQ ID NO: 55962 - DNA, 20 bp, Artificial Sequence
  chemically synthesized
aggatttgggacctttgcta

SEQ ID NO: 55963 - DNA, 20 bp, Artificial Sequence
  chemically synthesized
ggatttgggacctttgctag

SEQ ID NO: 55964 - DNA, 20 bp, Artificial Sequence
  chemically synthesized
tttgggacctttgctagagg

SEQ ID NO: 55965 - DNA, 20 bp, Artificial Sequence
  chemically synthesized
ttgggacctttgctagaggt

SEQ ID NO: 55966 - DNA, 20 bp, Artificial Sequence
  chemically synthesized
acctttgctagaggtgggtt

SEQ ID NO: 55967 - DNA, 20 bp, Artificial Sequence
  chemically synthesized
ctttgctagaggtgggtttg

SEQ ID NO: 55968 - DNA, 20 bp, Artificial Sequence
  chemically synthesized
tttgctagaggtgggtttgg

SEQ ID NO: 55969 - DNA, 20 bp, Artificial Sequence
  chemically synthesized
tgctagaggtgggtttggag

SEQ ID NO: 55970 - DNA, 20 bp, Artificial Sequence
  chemically synthesized
tagaggtgggtttggaggag

SEQ ID NO: 55971 - DNA, 20 bp, Artificial Sequence
  chemically synthesized
agaggtgggtttggaggagt

SEQ ID NO: 55972 - DNA, 20 bp, Artificial Sequence
  chemically synthesized
tgccatccgttctgcgactg

SEQ ID NO: 55973 - DNA, 20 bp, Artificial Sequence
  chemically synthesized
gcgactgtggaattaaatca

SEQ ID NO: 55974 - DNA, 20 bp, Artificial Sequence
  chemically synthesized
ctgtggaattaaatcacaga

SEQ ID NO: 55975 - DNA, 20 bp, Artificial Sequence
  chemically synthesized
tggaattaaatcacagatgg

SEQ ID NO: 55976 - DNA, 20 bp, Artificial Sequence
  chemically synthesized
attaaatcacagatggcaga

SEQ ID NO: 55977 - DNA, 20 bp, Artificial Sequence
  chemically synthesized
ttaaatcacagatggcagat

SEQ ID NO: 55978 - DNA, 20 bp, Artificial Sequence
  chemically synthesized
aaatcacagatggcagatgg

SEQ ID NO: 55979 - DNA, 20 bp, Artificial Sequence
  chemically synthesized
aatcacagatggcagatggg

SEQ ID NO: 55980 - DNA, 20 bp, Artificial Sequence
  chemically synthesized
atcacagatggcagatggga

SEQ ID NO: 55981 - DNA, 20 bp, Artificial Sequence
  chemically synthesized
tggcagatgggagggtcgcc

SEQ ID NO: 55982 - DNA, 20 bp, Artificial Sequence
  chemically synthesized
cttattcccatgtgtgactc

SEQ ID NO: 55983 - DNA, 20 bp, Artificial Sequence
  chemically synthesized
actccagcctgccctcaata

SEQ ID NO: 55984 - DNA, 20 bp, Artificial Sequence
  chemically synthesized
gccctcaatatagactcttt

SEQ ID NO: 55985 - DNA, 20 bp, Artificial Sequence
  chemically synthesized
tcaatatagactctttcaga

SEQ ID NO: 55986 - DNA, 20 bp, Artificial Sequence
  chemically synthesized
aatatagactctttcagatg

SEQ ID NO: 55987 - DNA, 20 bp, Artificial Sequence
  chemically synthesized
atatagactctttcagatgg

SEQ ID NO: 55988 - DNA, 20 bp, Artificial Sequence
  chemically synthesized
accgtatgcaaatttcctac

SEQ ID NO: 55989 - DNA, 20 bp, Artificial Sequence
  chemically synthesized
ccgtatgcaaatttcctacc

SEQ ID NO: 55990 - DNA, 20 bp, Artificial Sequence
  chemically synthesized
gtatgcaaatttcctaccag

SEQ ID NO: 55991 - DNA, 20 bp, Artificial Sequence
  chemically synthesized
tatgcaaatttcctaccagg

SEQ ID NO: 55992 - DNA, 20 bp, Artificial Sequence
  chemically synthesized
atctctacttgaaataccct

SEQ ID NO: 55993 - DNA, 20 bp, Artificial Sequence
  chemically synthesized
ctctacttgaaataccctca

SEQ ID NO: 55994 - DNA, 20 bp, Artificial Sequence
  chemically synthesized
tctacttgaaataccctcag

SEQ ID NO: 55995 - DNA, 20 bp, Artificial Sequence
  chemically synthesized
acttgaaataccctcagagg

SEQ ID NO: 55996 - DNA, 20 bp, Artificial Sequence
  chemically synthesized
cttgaaataccctcagaggt

SEQ ID NO: 55997 - DNA, 20 bp, Artificial Sequence
  chemically synthesized
ttgaaataccctcagaggta

SEQ ID NO: 55998 - DNA, 20 bp, Artificial Sequence
  chemically synthesized
gaaataccctcagaggtagg

SEQ ID NO: 55999 - DNA, 20 bp, Artificial Sequence
  chemically synthesized
ggagctcacccccactataa

SEQ ID NO: 56000 - DNA, 20 bp, Artificial Sequence
  chemically synthesized
cagtccattttatctttgaa

SEQ ID NO: 56001 - DNA, 20 bp, Artificial Sequence
  chemically synthesized
gaacggaattgattgctgaa

SEQ ID NO: 56002 - DNA, 20 bp, Artificial Sequence
  chemically synthesized
cttccttgtctgtgtgaaac

SEQ ID NO: 56003 - DNA, 20 bp, Artificial Sequence
  chemically synthesized
ctaatactgtctatttttct

SEQ ID NO: 56004 - DNA, 20 bp, Artificial Sequence
  chemically synthesized
atttttctcagttctttctg

SEQ ID NO: 56005 - DNA, 20 bp, Artificial Sequence
  chemically synthesized
tttttctcagttctttctgc

SEQ ID NO: 56006 - DNA, 20 bp, Artificial Sequence
  chemically synthesized
tttctcagttctttctgcag

SEQ ID NO: 56007 - DNA, 20 bp, Artificial Sequence
  chemically synthesized
tcagttctttctgcaggagt

SEQ ID NO: 56008 - DNA, 20 bp, Artificial Sequence
  chemically synthesized
ttctttctgcaggagttagt

SEQ ID NO: 56009 - DNA, 20 bp, Artificial Sequence
  chemically synthesized
gagttagtaagtgatgaatc

SEQ ID NO: 56010 - DNA, 20 bp, Artificial Sequence
  chemically synthesized
ctctgtcacacatttgaaca

SEQ ID NO: 56011 - DNA, 20 bp, Artificial Sequence
  chemically synthesized
ctctctaacctaaacattcc

SEQ ID NO: 56012 - DNA, 20 bp, Artificial Sequence
  chemically synthesized
tctctaacctaaacattccc

SEQ ID NO: 56013 - DNA, 20 bp, Artificial Sequence
  chemically synthesized
cccaggtttttcatgtgata

SEQ ID NO: 56014 - DNA, 20 bp, Artificial Sequence
  chemically synthesized
ttttcatgtgatatggcttc

SEQ ID NO: 56015 - DNA, 20 bp, Artificial Sequence
  chemically synthesized
tttcatgtgatatggcttcc

SEQ ID NO: 56016 - DNA, 20 bp, Artificial Sequence
  chemically synthesized
tccaggttcttcctcaaaca

SEQ ID NO: 56017 - DNA, 20 bp, Artificial Sequence
  chemically synthesized
tcttcctcaaacatggaacc

SEQ ID NO: 56018 - DNA, 20 bp, Artificial Sequence
  chemically synthesized
gttccgttcttacaaatctc

SEQ ID NO: 56019 - DNA, 20 bp, Artificial Sequence
  chemically synthesized
ttccgttcttacaaatctcc

SEQ ID NO: 56020 - DNA, 20 bp, Artificial Sequence
  chemically synthesized
tccgttcttacaaatctcca

SEQ ID NO: 56021 - DNA, 20 bp, Artificial Sequence
  chemically synthesized
ccgttcttacaaatctccag

SEQ ID NO: 56022 - DNA, 20 bp, Artificial Sequence
  chemically synthesized
gttcttacaaatctccaggg

SEQ ID NO: 56023 - DNA, 20 bp, Artificial Sequence
  chemically synthesized
tctccaggggagaaattcca

SEQ ID NO: 56024 - DNA, 20 bp, Artificial Sequence
  chemically synthesized
agaaattccacagttttgtt

SEQ ID NO: 56025 - DNA, 20 bp, Artificial Sequence
  chemically synthesized
gaaattccacagttttgtta

SEQ ID NO: 56026 - DNA, 20 bp, Artificial Sequence
  chemically synthesized
tttgttaaggtcttatattc

SEQ ID NO: 56027 - DNA, 20 bp, Artificial Sequence
  chemically synthesized
cttgtcttacccttgttaat

SEQ ID NO: 56028 - DNA, 20 bp, Artificial Sequence
  chemically synthesized
tacccttgttaattggatct

SEQ ID NO: 56029 - DNA, 20 bp, Artificial Sequence
  chemically synthesized
gatctaagaaaacacatatt

SEQ ID NO: 56030 - DNA, 20 bp, Artificial Sequence
  chemically synthesized
atctaagaaaacacatattc

SEQ ID NO: 56031 - DNA, 20 bp, Artificial Sequence
  chemically synthesized
taagaaaacacatattcagg

SEQ ID NO: 56032 - DNA, 20 bp, Artificial Sequence
  chemically synthesized
aagaaaacacatattcaggc

SEQ ID NO: 56033 - DNA, 20 bp, Artificial Sequence
  chemically synthesized
agaaaacacatattcaggca

SEQ ID NO: 56034 - DNA, 20 bp, Artificial Sequence
  chemically synthesized
acacatattcaggcagggtg

SEQ ID NO: 56035 - DNA, 20 bp, Artificial Sequence
  chemically synthesized
catattcaggcagggtgcgg

SEQ ID NO: 56036 - DNA, 20 bp, Artificial Sequence
  chemically synthesized
gtggctcacccttgtaatcc

SEQ ID NO: 56037 - DNA, 20 bp, Artificial Sequence
  chemically synthesized
cccttgtaatcccagcgctt

SEQ ID NO: 56038 - DNA, 20 bp, Artificial Sequence
  chemically synthesized
ccttgtaatcccagcgcttt

SEQ ID NO: 56039 - DNA, 20 bp, Artificial Sequence
  chemically synthesized
ttgtaatcccagcgctttgg

SEQ ID NO: 56040 - DNA, 20 bp, Artificial Sequence
  chemically synthesized
tgtaatcccagcgctttggg

SEQ ID NO: 56041 - DNA, 20 bp, Artificial Sequence
  chemically synthesized
tcccagcgctttgggaggcc

SEQ ID NO: 56042 - DNA, 20 bp, Artificial Sequence
  chemically synthesized
cccagcgctttgggaggccg

SEQ ID NO: 56043 - DNA, 20 bp, Artificial Sequence
  chemically synthesized
agcgctttgggaggccgagg

SEQ ID NO: 56044 - DNA, 20 bp, Artificial Sequence
  chemically synthesized
gcgctttgggaggccgaggc

SEQ ID NO: 56045 - DNA, 20 bp, Artificial Sequence
  chemically synthesized
ctttgggaggccgaggcggg

SEQ ID NO: 56046 - DNA, 20 bp, Artificial Sequence
  chemically synthesized
ggccgaggcgggcggatcac

SEQ ID NO: 56047 - DNA, 20 bp, Artificial Sequence
  chemically synthesized
gccgaggcgggcggatcacg

SEQ ID NO: 56048 - DNA, 20 bp, Artificial Sequence
  chemically synthesized
aggcgggcggatcacgaggt

SEQ ID NO: 56049 - DNA, 20 bp, Artificial Sequence
  chemically synthesized
ggcgggcggatcacgaggtc

SEQ ID NO: 56050 - DNA, 20 bp, Artificial Sequence
  chemically synthesized
cgggcggatcacgaggtcag

SEQ ID NO: 56051 - DNA, 20 bp, Artificial Sequence
  chemically synthesized
gatcacgaggtcaggagatc

SEQ ID NO: 56052 - DNA, 20 bp, Artificial Sequence
  chemically synthesized
aggtcaggagatcaagacca

SEQ ID NO: 56053 - DNA, 20 bp, Artificial Sequence
  chemically synthesized
ctgctaaaaatacaaaaaat

SEQ ID NO: 56054 - DNA, 20 bp, Artificial Sequence
  chemically synthesized
taaaaatacaaaaaattagc

SEQ ID NO: 56055 - DNA, 20 bp, Artificial Sequence
  chemically synthesized
aaaaatacaaaaaattagcc

SEQ ID NO: 56056 - DNA, 20 bp, Artificial Sequence
  chemically synthesized
tacaaaaaattagccgggca

SEQ ID NO: 56057 - DNA, 20 bp, Artificial Sequence
  chemically synthesized
aaaaaattagccgggcatgg

SEQ ID NO: 56058 - DNA, 20 bp, Artificial Sequence
  chemically synthesized
aaattagccgggcatggtgg

SEQ ID NO: 56059 - DNA, 20 bp, Artificial Sequence
  chemically synthesized
aattagccgggcatggtggc

SEQ ID NO: 56060 - DNA, 20 bp, Artificial Sequence
  chemically synthesized
ggcatggtggcgggcgcctg

SEQ ID NO: 56061 - DNA, 20 bp, Artificial Sequence
  chemically synthesized
gtggcgggcgcctgtagtcc

SEQ ID NO: 56062 - DNA, 20 bp, Artificial Sequence
  chemically synthesized
cgcctgtagtcccagctact

SEQ ID NO: 56063 - DNA, 20 bp, Artificial Sequence
  chemically synthesized
cctgtagtcccagctactcg

SEQ ID NO: 56064 - DNA, 20 bp, Artificial Sequence
  chemically synthesized
tgtagtcccagctactcgga

SEQ ID NO: 56065 - DNA, 20 bp, Artificial Sequence
  chemically synthesized
gtagtcccagctactcggag

SEQ ID NO: 56066 - DNA, 20 bp, Artificial Sequence
  chemically synthesized
cccagctactcggagaggct

SEQ ID NO: 56067 - DNA, 20 bp, Artificial Sequence
  chemically synthesized
ccagctactcggagaggctg

SEQ ID NO: 56068 - DNA, 20 bp, Artificial Sequence
  chemically synthesized
gctactcggagaggctgagg

SEQ ID NO: 56069 - DNA, 20 bp, Artificial Sequence
  chemically synthesized
ctactcggagaggctgaggc

SEQ ID NO: 56070 - DNA, 20 bp, Artificial Sequence
  chemically synthesized
actcggagaggctgaggcag

SEQ ID NO: 56071 - DNA, 20 bp, Artificial Sequence
  chemically synthesized
gagaggctgaggcaggagaa

SEQ ID NO: 56072 - DNA, 20 bp, Artificial Sequence
  chemically synthesized
gcaggagaatggcgtgaacc

SEQ ID NO: 56073 - DNA, 20 bp, Artificial Sequence
  chemically synthesized
caggagaatggcgtgaaccc

SEQ ID NO: 56074 - DNA, 20 bp, Artificial Sequence
  chemically synthesized
ggagaatggcgtgaacccag

SEQ ID NO: 56075 - DNA, 20 bp, Artificial Sequence
  chemically synthesized
gagaatggcgtgaacccagg

SEQ ID NO: 56076 - DNA, 20 bp, Artificial Sequence
  chemically synthesized
aatggcgtgaacccaggagg

SEQ ID NO: 56077 - DNA, 20 bp, Artificial Sequence
  chemically synthesized
tggcgtgaacccaggaggtg

SEQ ID NO: 56078 - DNA, 20 bp, Artificial Sequence
  chemically synthesized
aacccaggaggtggagcttg

SEQ ID NO: 56079 - DNA, 20 bp, Artificial Sequence
  chemically synthesized
caggaggtggagcttgcagt

SEQ ID NO: 56080 - DNA, 20 bp, Artificial Sequence
  chemically synthesized
ggtggagcttgcagtgagcc

SEQ ID NO: 56081 - DNA, 20 bp, Artificial Sequence
  chemically synthesized
gagatcgcaccactgcactc

SEQ ID NO: 56082 - DNA, 20 bp, Artificial Sequence
  chemically synthesized
cgcaccactgcactctagcc

SEQ ID NO: 56083 - DNA, 20 bp, Artificial Sequence
  chemically synthesized
gcaccactgcactctagcct

SEQ ID NO: 56084 - DNA, 20 bp, Artificial Sequence
  chemically synthesized
ctgcactctagcctgggtca

SEQ ID NO: 56085 - DNA, 20 bp, Artificial Sequence
  chemically synthesized
gcactctagcctgggtcaca

SEQ ID NO: 56086 - DNA, 20 bp, Artificial Sequence
  chemically synthesized
tctagcctgggtcacagagc

SEQ ID NO: 56087 - DNA, 20 bp, Artificial Sequence
  chemically synthesized
tcaaaactctgaacctataa

SEQ ID NO: 56088 - DNA, 20 bp, Artificial Sequence
  chemically synthesized
aaaactctgaacctataaaa

SEQ ID NO: 56089 - DNA, 20 bp, Artificial Sequence
  chemically synthesized
cctataaaagagatcaactg

SEQ ID NO: 56090 - DNA, 20 bp, Artificial Sequence
  chemically synthesized
gatcaactgcagttatctat

SEQ ID NO: 56091 - DNA, 20 bp, Artificial Sequence
  chemically synthesized
atcaactgcagttatctatt

SEQ ID NO: 56092 - DNA, 20 bp, Artificial Sequence
  chemically synthesized
aatgaatgtatttaaatgaa

SEQ ID NO: 56093 - DNA, 20 bp, Artificial Sequence
  chemically synthesized
atttaaatgaacagctttcc

SEQ ID NO: 56094 - DNA, 20 bp, Artificial Sequence
  chemically synthesized
tttaaatgaacagctttcct

SEQ ID NO: 56095 - DNA, 20 bp, Artificial Sequence
  chemically synthesized
tcgtgttaatttgttaaatt

SEQ ID NO: 56096 - DNA, 20 bp, Artificial Sequence
  chemically synthesized
tgttaatttgttaaatttgg

SEQ ID NO: 56097 - DNA, 20 bp, Artificial Sequence
  chemically synthesized
aatttggcagattccctgaa

SEQ ID NO: 56098 - DNA, 20 bp, Artificial Sequence
  chemically synthesized
agattccctgaaaagtaaat

SEQ ID NO: 56099 - DNA, 20 bp, Artificial Sequence
  chemically synthesized
gattccctgaaaagtaaatt

SEQ ID NO: 56100 - DNA, 20 bp, Artificial Sequence
  chemically synthesized
attccctgaaaagtaaatta

SEQ ID NO: 56101 - DNA, 20 bp, Artificial Sequence
  chemically synthesized
aagtaaattagggcctgttg

SEQ ID NO: 56102 - DNA, 20 bp, Artificial Sequence
  chemically synthesized
aattagggcctgttgaagac

SEQ ID NO: 56103 - DNA, 20 bp, Artificial Sequence
  chemically synthesized
agggcctgttgaagaccagt

SEQ ID NO: 56104 - DNA, 20 bp, Artificial Sequence
  chemically synthesized
ttgaagaccagtaagaaata

SEQ ID NO: 56105 - DNA, 20 bp, Artificial Sequence
  chemically synthesized
taagaaataaagattgtaaa

SEQ ID NO: 56106 - DNA, 20 bp, Artificial Sequence
  chemically synthesized
taaagattgtaaaaagctct

SEQ ID NO: 56107 - DNA, 20 bp, Artificial Sequence
  chemically synthesized
gtaaaaagctctgagatttc

SEQ ID NO: 56108 - DNA, 20 bp, Artificial Sequence
  chemically synthesized
gatttcaagctaattcaatt

SEQ ID NO: 56109 - DNA, 20 bp, Artificial Sequence
  chemically synthesized
tggtgcgttaatttgatgta

SEQ ID NO: 56110 - DNA, 20 bp, Artificial Sequence
  chemically synthesized
cttctacacaattcattcta

SEQ ID NO: 56111 - DNA, 20 bp, Artificial Sequence
  chemically synthesized
cacaattcattctatagatc

SEQ ID NO: 56112 - DNA, 20 bp, Artificial Sequence
  chemically synthesized
acaattcattctatagatct

SEQ ID NO: 56113 - DNA, 20 bp, Artificial Sequence
  chemically synthesized
tatagatctgggcactctta

SEQ ID NO: 56114 - DNA, 20 bp, Artificial Sequence
  chemically synthesized
ttatagaaattaatcatttc

SEQ ID NO: 56115 - DNA, 20 bp, Artificial Sequence
  chemically synthesized
cattcttgactttcaaccca

SEQ ID NO: 56116 - DNA, 20 bp, Artificial Sequence
  chemically synthesized
tcaacccacagaaatgctaa

SEQ ID NO: 56117 - DNA, 20 bp, Artificial Sequence
  chemically synthesized
ctaacagtactgattacaca

SEQ ID NO: 56118 - DNA, 20 bp, Artificial Sequence
  chemically synthesized
taacagtactgattacacac

SEQ ID NO: 56119 - DNA, 20 bp, Artificial Sequence
  chemically synthesized
tactgattacacacaggatg

SEQ ID NO: 56120 - DNA, 20 bp, Artificial Sequence
  chemically synthesized
gattacacacaggatgtggc

SEQ ID NO: 56121 - DNA, 20 bp, Artificial Sequence
  chemically synthesized
acaggatgtggctggaatgc

SEQ ID NO: 56122 - DNA, 20 bp, Artificial Sequence
  chemically synthesized
caggatgtggctggaatgct

SEQ ID NO: 56123 - DNA, 20 bp, Artificial Sequence
  chemically synthesized
tgctgggattttgtcctgat

SEQ ID NO: 56124 - DNA, 20 bp, Artificial Sequence
  chemically synthesized
gctgggattttgtcctgatt

SEQ ID NO: 56125 - DNA, 20 bp, Artificial Sequence
  chemically synthesized
ctgggattttgtcctgatta

SEQ ID NO: 56126 - DNA, 20 bp, Artificial Sequence
  chemically synthesized
gggattttgtcctgattagg

SEQ ID NO: 56127 - DNA, 20 bp, Artificial Sequence
  chemically synthesized
gattttgtcctgattaggga

SEQ ID NO: 56128 - DNA, 20 bp, Artificial Sequence
  chemically synthesized
gtcctgattagggagagaaa

SEQ ID NO: 56129 - DNA, 20 bp, Artificial Sequence
  chemically synthesized
gattagggagagaaacggaa

SEQ ID NO: 56130 - DNA, 20 bp, Artificial Sequence
  chemically synthesized
attagggagagaaacggaat

SEQ ID NO: 56131 - DNA, 20 bp, Artificial Sequence
  chemically synthesized
ttagggagagaaacggaatg

SEQ ID NO: 56132 - DNA, 20 bp, Artificial Sequence
  chemically synthesized
gagagaaacggaatggggtt

SEQ ID NO: 56133 - DNA, 20 bp, Artificial Sequence
  chemically synthesized
agagaaacggaatggggttt

SEQ ID NO: 56134 - DNA, 20 bp, Artificial Sequence
  chemically synthesized
gagaaacggaatggggtttg

SEQ ID NO: 56135 - DNA, 20 bp, Artificial Sequence
  chemically synthesized
agaaacggaatggggtttgg

SEQ ID NO: 56136 - DNA, 20 bp, Artificial Sequence
  chemically synthesized
aaacggaatggggtttgggg

SEQ ID NO: 56137 - DNA, 20 bp, Artificial Sequence
  chemically synthesized
cggaatggggtttgggggag

SEQ ID NO: 56138 - DNA, 20 bp, Artificial Sequence
  chemically synthesized
ggaatggggtttgggggaga

SEQ ID NO: 56139 - DNA, 20 bp, Artificial Sequence
  chemically synthesized
atggggtttgggggagaagg

SEQ ID NO: 56140 - DNA, 20 bp, Artificial Sequence
  chemically synthesized
tggggtttgggggagaagga

SEQ ID NO: 56141 - DNA, 20 bp, Artificial Sequence
  chemically synthesized
ggggtttgggggagaaggaa

SEQ ID NO: 56142 - DNA, 20 bp, Artificial Sequence
  chemically synthesized
ggtttgggggagaaggaagg

SEQ ID NO: 56143 - DNA, 20 bp, Artificial Sequence
  chemically synthesized
tgggggagaaggaagggagt

SEQ ID NO: 56144 - DNA, 20 bp, Artificial Sequence
  chemically synthesized
gagaaggaagggagtcagat

SEQ ID NO: 56145 - DNA, 20 bp, Artificial Sequence
  chemically synthesized
tcagatcagcccatacctga

SEQ ID NO: 56146 - DNA, 20 bp, Artificial Sequence
  chemically synthesized
cagatcagcccatacctgac

SEQ ID NO: 56147 - DNA, 20 bp, Artificial Sequence
  chemically synthesized
gcccatacctgacaggactc

SEQ ID NO: 56148 - DNA, 20 bp, Artificial Sequence
  chemically synthesized
gactccagcaacaacttgat

SEQ ID NO: 56149 - DNA, 20 bp, Artificial Sequence
  chemically synthesized
actccagcaacaacttgatg

SEQ ID NO: 56150 - DNA, 20 bp, Artificial Sequence
  chemically synthesized
aacaacttgatgaggaaaat

SEQ ID NO: 56151 - DNA, 20 bp, Artificial Sequence
  chemically synthesized
aacttgatgaggaaaatgag

SEQ ID NO: 56152 - DNA, 20 bp, Artificial Sequence
  chemically synthesized
tgatgaggaaaatgagcagc

SEQ ID NO: 56153 - DNA, 20 bp, Artificial Sequence
  chemically synthesized
gatgaggaaaatgagcagca

SEQ ID NO: 56154 - DNA, 20 bp, Artificial Sequence
  chemically synthesized
gaggaaaatgagcagcaagg

SEQ ID NO: 56155 - DNA, 20 bp, Artificial Sequence
  chemically synthesized
gcagcaaggtagattcgtga

SEQ ID NO: 56156 - DNA, 20 bp, Artificial Sequence
  chemically synthesized
caaggtagattcgtgacaga

SEQ ID NO: 56157 - DNA, 20 bp, Artificial Sequence
  chemically synthesized
attcgtgacagacagacatt

SEQ ID NO: 56158 - DNA, 20 bp, Artificial Sequence
  chemically synthesized
cagacagacattcagctgca

SEQ ID NO: 56159 - DNA, 20 bp, Artificial Sequence
  chemically synthesized
agacattcagctgcacagcc

SEQ ID NO: 56160 - DNA, 20 bp, Artificial Sequence
  chemically synthesized
ccaaccacaaaatgacattc

SEQ ID NO: 56161 - DNA, 20 bp, Artificial Sequence
  chemically synthesized
tgacattcaagcacctgcaa

SEQ ID NO: 56162 - DNA, 20 bp, Artificial Sequence
  chemically synthesized
cattcaagcacctgcaacag

SEQ ID NO: 56163 - DNA, 20 bp, Artificial Sequence
  chemically synthesized
ttcaagcacctgcaacagaa

SEQ ID NO: 56164 - DNA, 20 bp, Artificial Sequence
  chemically synthesized
tcaagcacctgcaacagaag

SEQ ID NO: 56165 - DNA, 20 bp, Artificial Sequence
  chemically synthesized
aacagaagaggcaaccataa

SEQ ID NO: 56166 - DNA, 20 bp, Artificial Sequence
  chemically synthesized
gaggcaaccataacagaaca

SEQ ID NO: 56167 - DNA, 20 bp, Artificial Sequence
  chemically synthesized
aggcaaccataacagaacac

SEQ ID NO: 56168 - DNA, 20 bp, Artificial Sequence
  chemically synthesized
accataacagaacacaggtg

SEQ ID NO: 56169 - DNA, 20 bp, Artificial Sequence
  chemically synthesized
gaacacaggtgcagatcctt

SEQ ID NO: 56170 - DNA, 20 bp, Artificial Sequence
  chemically synthesized
caggtgcagatccttcagca

SEQ ID NO: 56171 - DNA, 20 bp, Artificial Sequence
  chemically synthesized
agatccttcagcaaagaaaa

SEQ ID NO: 56172 - DNA, 20 bp, Artificial Sequence
  chemically synthesized
agcaaagaaaacagcccctg

SEQ ID NO: 56173 - DNA, 20 bp, Artificial Sequence
  chemically synthesized
aacagcccctgcagaaatgt

SEQ ID NO: 56174 - DNA, 20 bp, Artificial Sequence
  chemically synthesized
cagcccctgcagaaatgttg

SEQ ID NO: 56175 - DNA, 20 bp, Artificial Sequence
  chemically synthesized
cctgcagaaatgttggagcc

SEQ ID NO: 56176 - DNA, 20 bp, Artificial Sequence
  chemically synthesized
atgttggagcctggcaaact

SEQ ID NO: 56177 - DNA, 20 bp, Artificial Sequence
  chemically synthesized
tgttggagcctggcaaactt

SEQ ID NO: 56178 - DNA, 20 bp, Artificial Sequence
  chemically synthesized
ctggcaaacttaggtgctct

SEQ ID NO: 56179 - DNA, 20 bp, Artificial Sequence
  chemically synthesized
gcaaacttaggtgctctcag

SEQ ID NO: 56180 - DNA, 20 bp, Artificial Sequence
  chemically synthesized
agtggaatttttgtaaatta

SEQ ID NO: 56181 - DNA, 20 bp, Artificial Sequence
  chemically synthesized
gaatttttgtaaattaaagc

SEQ ID NO: 56182 - DNA, 20 bp, Artificial Sequence
  chemically synthesized
aaattaaagccagtactcaa

SEQ ID NO: 56183 - DNA, 20 bp, Artificial Sequence
  chemically synthesized
agccagtactcaaaagtcca

SEQ ID NO: 56184 - DNA, 20 bp, Artificial Sequence
  chemically synthesized
aaaagtccaaagatgcctgt

SEQ ID NO: 56185 - DNA, 20 bp, Artificial Sequence
  chemically synthesized
aaagtccaaagatgcctgtt

SEQ ID NO: 56186 - DNA, 20 bp, Artificial Sequence
  chemically synthesized
aagtccaaagatgcctgttg

SEQ ID NO: 56187 - DNA, 20 bp, Artificial Sequence
  chemically synthesized
agtccaaagatgcctgttgg

SEQ ID NO: 56188 - DNA, 20 bp, Artificial Sequence
  chemically synthesized
caaagatgcctgttgggggc

SEQ ID NO: 56189 - DNA, 20 bp, Artificial Sequence
  chemically synthesized
aaagatgcctgttgggggct

SEQ ID NO: 56190 - DNA, 20 bp, Artificial Sequence
  chemically synthesized
tgcctgttgggggctgggtg

SEQ ID NO: 56191 - DNA, 20 bp, Artificial Sequence
  chemically synthesized
ctgttgggggctgggtgcag

SEQ ID NO: 56192 - DNA, 20 bp, Artificial Sequence
  chemically synthesized
gggggctgggtgcagcggct

SEQ ID NO: 56193 - DNA, 20 bp, Artificial Sequence
  chemically synthesized
gacctgtaatcccaatactt

SEQ ID NO: 56194 - DNA, 20 bp, Artificial Sequence
  chemically synthesized
acctgtaatcccaatacttt

SEQ ID NO: 56195 - DNA, 20 bp, Artificial Sequence
  chemically synthesized
ctgtaatcccaatactttgg

SEQ ID NO: 56196 - DNA, 20 bp, Artificial Sequence
  chemically synthesized
tgtaatcccaatactttggg

SEQ ID NO: 56197 - DNA, 20 bp, Artificial Sequence
  chemically synthesized
tcccaatactttgggaggcc

SEQ ID NO: 56198 - DNA, 20 bp, Artificial Sequence
  chemically synthesized
cccaatactttgggaggccg

SEQ ID NO: 56199 - DNA, 20 bp, Artificial Sequence
  chemically synthesized
atactttgggaggccgaggt

SEQ ID NO: 56200 - DNA, 20 bp, Artificial Sequence
  chemically synthesized
actttgggaggccgaggtga

SEQ ID NO: 56201 - DNA, 20 bp, Artificial Sequence
  chemically synthesized
ctttgggaggccgaggtgag

SEQ ID NO: 56202 - DNA, 20 bp, Artificial Sequence
  chemically synthesized
ccgaggtgagaggatcactt

SEQ ID NO: 56203 - DNA, 20 bp, Artificial Sequence
  chemically synthesized
cgaggtgagaggatcacttg

SEQ ID NO: 56204 - DNA, 20 bp, Artificial Sequence
  chemically synthesized
gtgagaggatcacttgaggc

SEQ ID NO: 56205 - DNA, 20 bp, Artificial Sequence
  chemically synthesized
tgagaggatcacttgaggcc

SEQ ID NO: 56206 - DNA, 20 bp, Artificial Sequence
  chemically synthesized
agaggatcacttgaggccag

SEQ ID NO: 56207 - DNA, 20 bp, Artificial Sequence
  chemically synthesized
tcacttgaggccaggagttc

SEQ ID NO: 56208 - DNA, 20 bp, Artificial Sequence
  chemically synthesized
tgaggccaggagttcaagac

SEQ ID NO: 56209 - DNA, 20 bp, Artificial Sequence
  chemically synthesized
ccaggagttcaagactagtc

SEQ ID NO: 56210 - DNA, 20 bp, Artificial Sequence
  chemically synthesized
caggagttcaagactagtct

SEQ ID NO: 56211 - DNA, 20 bp, Artificial Sequence
  chemically synthesized
caagactagtctgggcaaca

SEQ ID NO: 56212 - DNA, 20 bp, Artificial Sequence
  chemically synthesized
actagtctgggcaacatagc

SEQ ID NO: 56213 - DNA, 20 bp, Artificial Sequence
  chemically synthesized
agacccctgtctctttaaaa

SEQ ID NO: 56214 - DNA, 20 bp, Artificial Sequence
  chemically synthesized
taaaaaagatcaaaattgac

SEQ ID NO: 56215 - DNA, 20 bp, Artificial Sequence
  chemically synthesized
aaaaaagatcaaaattgacc

SEQ ID NO: 56216 - DNA, 20 bp, Artificial Sequence
  chemically synthesized
agatcaaaattgaccaggca

SEQ ID NO: 56217 - DNA, 20 bp, Artificial Sequence
  chemically synthesized
tcaaaattgaccaggcacgg

SEQ ID NO: 56218 - DNA, 20 bp, Artificial Sequence
  chemically synthesized
gtggcttatgcttgtaatcc

SEQ ID NO: 56219 - DNA, 20 bp, Artificial Sequence
  chemically synthesized
tgcttgtaatcccagcactt

SEQ ID NO: 56220 - DNA, 20 bp, Artificial Sequence
  chemically synthesized
gcttgtaatcccagcacttt

SEQ ID NO: 56221 - DNA, 20 bp, Artificial Sequence
  chemically synthesized
ttgtaatcccagcactttgg

SEQ ID NO: 56222 - DNA, 20 bp, Artificial Sequence
  chemically synthesized
tgtaatcccagcactttggg

SEQ ID NO: 56223 - DNA, 20 bp, Artificial Sequence
  chemically synthesized
tcccagcactttgggaggcc

SEQ ID NO: 56224 - DNA, 20 bp, Artificial Sequence
  chemically synthesized
cccagcactttgggaggccg

SEQ ID NO: 56225 - DNA, 20 bp, Artificial Sequence
  chemically synthesized
agcactttgggaggccgagg

SEQ ID NO: 56226 - DNA, 20 bp, Artificial Sequence
  chemically synthesized
gcactttgggaggccgaggt

SEQ ID NO: 56227 - DNA, 20 bp, Artificial Sequence
  chemically synthesized
ctttgggaggccgaggtggg

SEQ ID NO: 56228 - DNA, 20 bp, Artificial Sequence
  chemically synthesized
ccgaggtgggtggatcactt

SEQ ID NO: 56229 - DNA, 20 bp, Artificial Sequence
  chemically synthesized
cgaggtgggtggatcacttg

SEQ ID NO: 56230 - DNA, 20 bp, Artificial Sequence
  chemically synthesized
gtgggtggatcacttgaggt

SEQ ID NO: 56231 - DNA, 20 bp, Artificial Sequence
  chemically synthesized
tgggtggatcacttgaggtc

SEQ ID NO: 56232 - DNA, 20 bp, Artificial Sequence
  chemically synthesized
ggtggatcacttgaggtcag

SEQ ID NO: 56233 - DNA, 20 bp, Artificial Sequence
  chemically synthesized
tcacttgaggtcaggagttt

SEQ ID NO: 56234 - DNA, 20 bp, Artificial Sequence
  chemically synthesized
tgaggtcaggagtttgagac

SEQ ID NO: 56235 - DNA, 20 bp, Artificial Sequence
  chemically synthesized
tttgagaccagcctgatcaa

SEQ ID NO: 56236 - DNA, 20 bp, Artificial Sequence
  chemically synthesized
ttgagaccagcctgatcaac

SEQ ID NO: 56237 - DNA, 20 bp, Artificial Sequence
  chemically synthesized
taaaaaaaaaattacaaaat

SEQ ID NO: 56238 - DNA, 20 bp, Artificial Sequence
  chemically synthesized
aaaaaaattacaaaattagc

SEQ ID NO: 56239 - DNA, 20 bp, Artificial Sequence
  chemically synthesized
aaaaaattacaaaattagcc

SEQ ID NO: 56240 - DNA, 20 bp, Artificial Sequence
  chemically synthesized
aaattacaaaattagccagg

SEQ ID NO: 56241 - DNA, 20 bp, Artificial Sequence
  chemically synthesized
aattacaaaattagccaggt

SEQ ID NO: 56242 - DNA, 20 bp, Artificial Sequence
  chemically synthesized
attacaaaattagccaggtg

SEQ ID NO: 56243 - DNA, 20 bp, Artificial Sequence
  chemically synthesized
acaaaattagccaggtgggg

SEQ ID NO: 56244 - DNA, 20 bp, Artificial Sequence
  chemically synthesized
gtggctcacgcctgtaatcc

SEQ ID NO: 56245 - DNA, 20 bp, Artificial Sequence
  chemically synthesized
gcctgtaatcccagctattt

SEQ ID NO: 56246 - DNA, 20 bp, Artificial Sequence
  chemically synthesized
ctgtaatcccagctatttga

SEQ ID NO: 56247 - DNA, 20 bp, Artificial Sequence
  chemically synthesized
tgtaatcccagctatttgag

SEQ ID NO: 56248 - DNA, 20 bp, Artificial Sequence
  chemically synthesized
tcccagctatttgagaggct

SEQ ID NO: 56249 - DNA, 20 bp, Artificial Sequence
  chemically synthesized
cccagctatttgagaggctg

SEQ ID NO: 56250 - DNA, 20 bp, Artificial Sequence
  chemically synthesized
agctatttgagaggctgagg

SEQ ID NO: 56251 - DNA, 20 bp, Artificial Sequence
  chemically synthesized
gctatttgagaggctgaggc

SEQ ID NO: 56252 - DNA, 20 bp, Artificial Sequence
  chemically synthesized
tatttgagaggctgaggcag

SEQ ID NO: 56253 - DNA, 20 bp, Artificial Sequence
  chemically synthesized
gcaggagaattgcttgaact

SEQ ID NO: 56254 - DNA, 20 bp, Artificial Sequence
  chemically synthesized
caggagaattgcttgaactc

SEQ ID NO: 56255 - DNA, 20 bp, Artificial Sequence
  chemically synthesized
ggagaattgcttgaactcag

SEQ ID NO: 56256 - DNA, 20 bp, Artificial Sequence
  chemically synthesized
gagaattgcttgaactcagg

SEQ ID NO: 56257 - DNA, 20 bp, Artificial Sequence
  chemically synthesized
aattgcttgaactcaggagg

SEQ ID NO: 56258 - DNA, 20 bp, Artificial Sequence
  chemically synthesized
ttgcttgaactcaggaggtg

SEQ ID NO: 56259 - DNA, 20 bp, Artificial Sequence
  chemically synthesized
tgcttgaactcaggaggtgg

SEQ ID NO: 56260 - DNA, 20 bp, Artificial Sequence
  chemically synthesized
aactcaggaggtggaggtta

SEQ ID NO: 56261 - DNA, 20 bp, Artificial Sequence
  chemically synthesized
caggaggtggaggttacagt

SEQ ID NO: 56262 - DNA, 20 bp, Artificial Sequence
  chemically synthesized
ggtggaggttacagtgagcc

SEQ ID NO: 56263 - DNA, 20 bp, Artificial Sequence
  chemically synthesized
gagactgcgccactgcactc

SEQ ID NO: 56264 - DNA, 20 bp, Artificial Sequence
  chemically synthesized
tgcgccactgcactctagcc

SEQ ID NO: 56265 - DNA, 20 bp, Artificial Sequence
  chemically synthesized
gcgccactgcactctagcct

SEQ ID NO: 56266 - DNA, 20 bp, Artificial Sequence
  chemically synthesized
tgcactctagcctgggcaac

SEQ ID NO: 56267 - DNA, 20 bp, Artificial Sequence
  chemically synthesized
cactctagcctgggcaacaa

SEQ ID NO: 56268 - DNA, 20 bp, Artificial Sequence
  chemically synthesized
cgtctcaaaaaaaaaaaaaa

SEQ ID NO: 56269 - DNA, 20 bp, Artificial Sequence
  chemically synthesized
gtctcaaaaaaaaaaaaaaa

SEQ ID NO: 56270 - DNA, 20 bp, Artificial Sequence
  chemically synthesized
caaaaaaaaaaaaaaaaggc

SEQ ID NO: 56271 - DNA, 20 bp, Artificial Sequence
  chemically synthesized
aaaaaaaaaaaaaaaaggcc

SEQ ID NO: 56272 - DNA, 20 bp, Artificial Sequence
  chemically synthesized
aaaaaaaaaaaggccaggcg

SEQ ID NO: 56273 - DNA, 20 bp, Artificial Sequence
  chemically synthesized
aaaaaaaaggccaggcgcgg

SEQ ID NO: 56274 - DNA, 20 bp, Artificial Sequence
  chemically synthesized
gtggctcatgcctgcaatcc

SEQ ID NO: 56275 - DNA, 20 bp, Artificial Sequence
  chemically synthesized
tgcctgcaatcccagcactt

SEQ ID NO: 56276 - DNA, 20 bp, Artificial Sequence
  chemically synthesized
gcctgcaatcccagcacttt

SEQ ID NO: 56277 - DNA, 20 bp, Artificial Sequence
  chemically synthesized
ctgcaatcccagcactttgg

SEQ ID NO: 56278 - DNA, 20 bp, Artificial Sequence
  chemically synthesized
tgcaatcccagcactttggg

SEQ ID NO: 56279 - DNA, 20 bp, Artificial Sequence
  chemically synthesized
tcccagcactttgggaggct

SEQ ID NO: 56280 - DNA, 20 bp, Artificial Sequence
  chemically synthesized
cccagcactttgggaggctg

SEQ ID NO: 56281 - DNA, 20 bp, Artificial Sequence
  chemically synthesized
agcactttgggaggctgagg

SEQ ID NO: 56282 - DNA, 20 bp, Artificial Sequence
  chemically synthesized
ctttgggaggctgaggcgga

SEQ ID NO: 56283 - DNA, 20 bp, Artificial Sequence
  chemically synthesized
ggctgaggcggatggatcac

SEQ ID NO: 56284 - DNA, 20 bp, Artificial Sequence
  chemically synthesized
gctgaggcggatggatcact

SEQ ID NO: 56285 - DNA, 20 bp, Artificial Sequence
  chemically synthesized
aggcggatggatcactaggt

SEQ ID NO: 56286 - DNA, 20 bp, Artificial Sequence
  chemically synthesized
ggcggatggatcactaggtc

SEQ ID NO: 56287 - DNA, 20 bp, Artificial Sequence
  chemically synthesized
cggatggatcactaggtcag

SEQ ID NO: 56288 - DNA, 20 bp, Artificial Sequence
  chemically synthesized
gatcactaggtcaggagttc

SEQ ID NO: 56289 - DNA, 20 bp, Artificial Sequence
  chemically synthesized
ctaggtcaggagttcaagac

SEQ ID NO: 56290 - DNA, 20 bp, Artificial Sequence
  chemically synthesized
tcaggagttcaagaccagcc

SEQ ID NO: 56291 - DNA, 20 bp, Artificial Sequence
  chemically synthesized
caagaccagcctggccaata

SEQ ID NO: 56292 - DNA, 20 bp, Artificial Sequence
  chemically synthesized
tctactaaaaataaaaaaat

SEQ ID NO: 56293 - DNA, 20 bp, Artificial Sequence
  chemically synthesized
ctaaaaataaaaaaattagc

SEQ ID NO: 56294 - DNA, 20 bp, Artificial Sequence
  chemically synthesized
taaaaataaaaaaattagcc

SEQ ID NO: 56295 - DNA, 20 bp, Artificial Sequence
  chemically synthesized
ataaaaaaattagccaggtg

SEQ ID NO: 56296 - DNA, 20 bp, Artificial Sequence
  chemically synthesized
aaaaaattagccaggtgtgg

SEQ ID NO: 56297 - DNA, 20 bp, Artificial Sequence
  chemically synthesized
ggtgtggtggcacgtgcctg

SEQ ID NO: 56298 - DNA, 20 bp, Artificial Sequence
  chemically synthesized
gtggcacgtgcctgtagtcc

SEQ ID NO: 56299 - DNA, 20 bp, Artificial Sequence
  chemically synthesized
tgcctgtagtcccagctact

SEQ ID NO: 56300 - DNA, 20 bp, Artificial Sequence
  chemically synthesized
ctgtagtcccagctactcgg

SEQ ID NO: 56301 - DNA, 20 bp, Artificial Sequence
  chemically synthesized
tgtagtcccagctactcggt

SEQ ID NO: 56302 - DNA, 20 bp, Artificial Sequence
  chemically synthesized
tcccagctactcggtaggct

SEQ ID NO: 56303 - DNA, 20 bp, Artificial Sequence
  chemically synthesized
cccagctactcggtaggctg

SEQ ID NO: 56304 - DNA, 20 bp, Artificial Sequence
  chemically synthesized
agctactcggtaggctgagg

SEQ ID NO: 56305 - DNA, 20 bp, Artificial Sequence
  chemically synthesized
tactcggtaggctgaggcag

SEQ ID NO: 56306 - DNA, 20 bp, Artificial Sequence
  chemically synthesized
ggtaggctgaggcagaagaa

SEQ ID NO: 56307 - DNA, 20 bp, Artificial Sequence
  chemically synthesized
gcagaagaatagcttgaacc

SEQ ID NO: 56308 - DNA, 20 bp, Artificial Sequence
  chemically synthesized
cagaagaatagcttgaaccc

SEQ ID NO: 56309 - DNA, 20 bp, Artificial Sequence
  chemically synthesized
aagaatagcttgaacccagg

SEQ ID NO: 56310 - DNA, 20 bp, Artificial Sequence
  chemically synthesized
aatagcttgaacccaggaag

SEQ ID NO: 56311 - DNA, 20 bp, Artificial Sequence
  chemically synthesized
tagcttgaacccaggaagcg

SEQ ID NO: 56312 - DNA, 20 bp, Artificial Sequence
  chemically synthesized
agcttgaacccaggaagcgg

SEQ ID NO: 56313 - DNA, 20 bp, Artificial Sequence
  chemically synthesized
aacccaggaagcggaggttg

SEQ ID NO: 56314 - DNA, 20 bp, Artificial Sequence
  chemically synthesized
caggaagcggaggttgcagt

SEQ ID NO: 56315 - DNA, 20 bp, Artificial Sequence
  chemically synthesized
aggaagcggaggttgcagtg

SEQ ID NO: 56316 - DNA, 20 bp, Artificial Sequence
  chemically synthesized
agcggaggttgcagtgaggc

SEQ ID NO: 56317 - DNA, 20 bp, Artificial Sequence
  chemically synthesized
gaggttgcagtgaggcgaga

SEQ ID NO: 56318 - DNA, 20 bp, Artificial Sequence
  chemically synthesized
gagatggcgccactgcactc

SEQ ID NO: 56319 - DNA, 20 bp, Artificial Sequence
  chemically synthesized
ggcgccactgcactccagcc

SEQ ID NO: 56320 - DNA, 20 bp, Artificial Sequence
  chemically synthesized
gcgccactgcactccagcct

SEQ ID NO: 56321 - DNA, 20 bp, Artificial Sequence
  chemically synthesized
ctgcactccagcctgggcaa

SEQ ID NO: 56322 - DNA, 20 bp, Artificial Sequence
  chemically synthesized
gcactccagcctgggcaaca

SEQ ID NO: 56323 - DNA, 20 bp, Artificial Sequence
  chemically synthesized
tccagcctgggcaacagagc

SEQ ID NO: 56324 - DNA, 20 bp, Artificial Sequence
  chemically synthesized
aaaaaaaaaaaaaatgcctg

SEQ ID NO: 56325 - DNA, 20 bp, Artificial Sequence
  chemically synthesized
aaaaaaaaaatgcctgtggc

SEQ ID NO: 56326 - DNA, 20 bp, Artificial Sequence
  chemically synthesized
aaaaaaatgcctgtggcaag

SEQ ID NO: 56327 - DNA, 20 bp, Artificial Sequence
  chemically synthesized
attttatctgtttgataatt

SEQ ID NO: 56328 - DNA, 20 bp, Artificial Sequence
  chemically synthesized
ttttatctgtttgataatta

SEQ ID NO: 56329 - DNA, 20 bp, Artificial Sequence
  chemically synthesized
ttgataattaaggatttgca

SEQ ID NO: 56330 - DNA, 20 bp, Artificial Sequence
  chemically synthesized
taattaaggatttgcatggc

SEQ ID NO: 56331 - DNA, 20 bp, Artificial Sequence
  chemically synthesized
aaggatttgcatggctggcg

SEQ ID NO: 56332 - DNA, 20 bp, Artificial Sequence
  chemically synthesized
gatttgcatggctggcgcgg

SEQ ID NO: 56333 - DNA, 20 bp, Artificial Sequence
  chemically synthesized
tgcctgtaatcccaatattt

SEQ ID NO: 56334 - DNA, 20 bp, Artificial Sequence
  chemically synthesized
gcctgtaatcccaatatttt

SEQ ID NO: 56335 - DNA, 20 bp, Artificial Sequence
  chemically synthesized
ctgtaatcccaatattttag

SEQ ID NO: 56336 - DNA, 20 bp, Artificial Sequence
  chemically synthesized
tgtaatcccaatattttagg

SEQ ID NO: 56337 - DNA, 20 bp, Artificial Sequence
  chemically synthesized
tcccaatattttaggaggct

SEQ ID NO: 56338 - DNA, 20 bp, Artificial Sequence
  chemically synthesized
cccaatattttaggaggctg

SEQ ID NO: 56339 - DNA, 20 bp, Artificial Sequence
  chemically synthesized
atattttaggaggctgaggc

SEQ ID NO: 56340 - DNA, 20 bp, Artificial Sequence
  chemically synthesized
ctgaggcaagccaattgctt

SEQ ID NO: 56341 - DNA, 20 bp, Artificial Sequence
  chemically synthesized
caagccaattgcttgagatc

SEQ ID NO: 56342 - DNA, 20 bp, Artificial Sequence
  chemically synthesized
caattgcttgagatcaagac

SEQ ID NO: 56343 - DNA, 20 bp, Artificial Sequence
  chemically synthesized
cttgagatcaagaccagcct

SEQ ID NO: 56344 - DNA, 20 bp, Artificial Sequence
  chemically synthesized
gatcaagaccagcctgagcc

SEQ ID NO: 56345 - DNA, 20 bp, Artificial Sequence
  chemically synthesized
atcaagaccagcctgagcct

SEQ ID NO: 56346 - DNA, 20 bp, Artificial Sequence
  chemically synthesized
cagcctgagcctgggcaaca

SEQ ID NO: 56347 - DNA, 20 bp, Artificial Sequence
  chemically synthesized
cctgagcctgggcaacatag

SEQ ID NO: 56348 - DNA, 20 bp, Artificial Sequence
  chemically synthesized
cagaactctgtctctacaaa

SEQ ID NO: 56349 - DNA, 20 bp, Artificial Sequence
  chemically synthesized
ctgtctctacaaaaagatac

SEQ ID NO: 56350 - DNA, 20 bp, Artificial Sequence
  chemically synthesized
tacaaaaagatacgagaaat

SEQ ID NO: 56351 - DNA, 20 bp, Artificial Sequence
  chemically synthesized
aaaagatacgagaaattagc

SEQ ID NO: 56352 - DNA, 20 bp, Artificial Sequence
  chemically synthesized
aaagatacgagaaattagct

SEQ ID NO: 56353 - DNA, 20 bp, Artificial Sequence
  chemically synthesized
tacgagaaattagctgggtg

SEQ ID NO: 56354 - DNA, 20 bp, Artificial Sequence
  chemically synthesized
aattagctgggtgtggtgtg

SEQ ID NO: 56355 - DNA, 20 bp, Artificial Sequence
  chemically synthesized
tgggtgtggtgtgtggcctg

SEQ ID NO: 56356 - DNA, 20 bp, Artificial Sequence
  chemically synthesized
tggtgtgtggcctgtggtcc

SEQ ID NO: 56357 - DNA, 20 bp, Artificial Sequence
  chemically synthesized
ggcctgtggtcccagctact

SEQ ID NO: 56358 - DNA, 20 bp, Artificial Sequence
  chemically synthesized
tgtggtcccagctactcaga

SEQ ID NO: 56359 - DNA, 20 bp, Artificial Sequence
  chemically synthesized
tcccagctactcagatggct

SEQ ID NO: 56360 - DNA, 20 bp, Artificial Sequence
  chemically synthesized
cccagctactcagatggctg

SEQ ID NO: 56361 - DNA, 20 bp, Artificial Sequence
  chemically synthesized
agctactcagatggctgagg

SEQ ID NO: 56362 - DNA, 20 bp, Artificial Sequence
  chemically synthesized
gctactcagatggctgaggt

SEQ ID NO: 56363 - DNA, 20 bp, Artificial Sequence
  chemically synthesized
tactcagatggctgaggtgg

SEQ ID NO: 56364 - DNA, 20 bp, Artificial Sequence
  chemically synthesized
actcagatggctgaggtggg

SEQ ID NO: 56365 - DNA, 20 bp, Artificial Sequence
  chemically synthesized
ctgaggtgggaggatcgctt

SEQ ID NO: 56366 - DNA, 20 bp, Artificial Sequence
  chemically synthesized
gtgggaggatcgcttgagcc

SEQ ID NO: 56367 - DNA, 20 bp, Artificial Sequence
  chemically synthesized
tgggaggatcgcttgagcct

SEQ ID NO: 56368 - DNA, 20 bp, Artificial Sequence
  chemically synthesized
ggaggatcgcttgagcctgg

SEQ ID NO: 56369 - DNA, 20 bp, Artificial Sequence
  chemically synthesized
gaggatcgcttgagcctggg

SEQ ID NO: 56370 - DNA, 20 bp, Artificial Sequence
  chemically synthesized
gatcgcttgagcctgggagg

SEQ ID NO: 56371 - DNA, 20 bp, Artificial Sequence
  chemically synthesized
tcgcttgagcctgggaggca

SEQ ID NO: 56372 - DNA, 20 bp, Artificial Sequence
  chemically synthesized
cgcttgagcctgggaggcag

SEQ ID NO: 56373 - DNA, 20 bp, Artificial Sequence
  chemically synthesized
agcctgggaggcagaggttg

SEQ ID NO: 56374 - DNA, 20 bp, Artificial Sequence
  chemically synthesized
tgggaggcagaggttgcagc

SEQ ID NO: 56375 - DNA, 20 bp, Artificial Sequence
  chemically synthesized
atgatcgtgccactgcactt

SEQ ID NO: 56376 - DNA, 20 bp, Artificial Sequence
  chemically synthesized
cgtgccactgcacttcagcc

SEQ ID NO: 56377 - DNA, 20 bp, Artificial Sequence
  chemically synthesized
ctgcacttcagcctggatga

SEQ ID NO: 56378 - DNA, 20 bp, Artificial Sequence
  chemically synthesized
gcacttcagcctggatgaca

SEQ ID NO: 56379 - DNA, 20 bp, Artificial Sequence
  chemically synthesized
ttcagcctggatgacagagc

SEQ ID NO: 56380 - DNA, 20 bp, Artificial Sequence
  chemically synthesized
atctcaaaaataaaaataaa

SEQ ID NO: 56381 - DNA, 20 bp, Artificial Sequence
  chemically synthesized
tctcaaaaataaaaataaaa

SEQ ID NO: 56382 - DNA, 20 bp, Artificial Sequence
  chemically synthesized
aataaaaaggatttgcactg

SEQ ID NO: 56383 - DNA, 20 bp, Artificial Sequence
  chemically synthesized
ttgcactgtggctgcacacc

SEQ ID NO: 56384 - DNA, 20 bp, Artificial Sequence
  chemically synthesized
tgcacacccggaattctctg

SEQ ID NO: 56385 - DNA, 20 bp, Artificial Sequence
  chemically synthesized
acacccggaattctctgtag

SEQ ID NO: 56386 - DNA, 20 bp, Artificial Sequence
  chemically synthesized
cacccggaattctctgtagt

SEQ ID NO: 56387 - DNA, 20 bp, Artificial Sequence
  chemically synthesized
aggaatatcttctgtttctc

SEQ ID NO: 56388 - DNA, 20 bp, Artificial Sequence
  chemically synthesized
tttctctggttattttaacc

SEQ ID NO: 56389 - DNA, 20 bp, Artificial Sequence
  chemically synthesized
tctggttattttaacctgga

SEQ ID NO: 56390 - DNA, 20 bp, Artificial Sequence
  chemically synthesized
ctggttattttaacctggat

SEQ ID NO: 56391 - DNA, 20 bp, Artificial Sequence
  chemically synthesized
aacctggatgggtgactctg

SEQ ID NO: 56392 - DNA, 20 bp, Artificial Sequence
  chemically synthesized
tggatgggtgactctgtggt

SEQ ID NO: 56393 - DNA, 20 bp, Artificial Sequence
  chemically synthesized
gggtgactctgtggttggta

SEQ ID NO: 56394 - DNA, 20 bp, Artificial Sequence
  chemically synthesized
ctctgtggttggtacagaca

SEQ ID NO: 56395 - DNA, 20 bp, Artificial Sequence
  chemically synthesized
tctgtggttggtacagacat

SEQ ID NO: 56396 - DNA, 20 bp, Artificial Sequence
  chemically synthesized
acagacatgggtttttattt

SEQ ID NO: 56397 - DNA, 20 bp, Artificial Sequence
  chemically synthesized
cttcactaccttatttttat

SEQ ID NO: 56398 - DNA, 20 bp, Artificial Sequence
  chemically synthesized
tatttttataagtcccttca

SEQ ID NO: 56399 - DNA, 20 bp, Artificial Sequence
  chemically synthesized
tataagtcccttcatggtgt

SEQ ID NO: 56400 - DNA, 20 bp, Artificial Sequence
  chemically synthesized
ataagtcccttcatggtgtt

SEQ ID NO: 56401 - DNA, 20 bp, Artificial Sequence
  chemically synthesized
tttccttatctgtaaaacaa

SEQ ID NO: 56402 - DNA, 20 bp, Artificial Sequence
  chemically synthesized
aaaacaacggattgcactac

SEQ ID NO: 56403 - DNA, 20 bp, Artificial Sequence
  chemically synthesized
ttgcactactggatcccttt

SEQ ID NO: 56404 - DNA, 20 bp, Artificial Sequence
  chemically synthesized
cccaaacattccctgactct

SEQ ID NO: 56405 - DNA, 20 bp, Artificial Sequence
  chemically synthesized
ccaaacattccctgactctg

SEQ ID NO: 56406 - DNA, 20 bp, Artificial Sequence
  chemically synthesized
ctgaggtttatccctatcca

SEQ ID NO: 56407 - DNA, 20 bp, Artificial Sequence
  chemically synthesized
aaagtgccacaactcttaat

SEQ ID NO: 56408 - DNA, 20 bp, Artificial Sequence
  chemically synthesized
gtgccacaactcttaatcag

SEQ ID NO: 56409 - DNA, 20 bp, Artificial Sequence
  chemically synthesized
actcttaatcagcggctgcc

SEQ ID NO: 56410 - DNA, 20 bp, Artificial Sequence
  chemically synthesized
ctcttaatcagcggctgccc

SEQ ID NO: 56411 - DNA, 20 bp, Artificial Sequence
  chemically synthesized
aatcagcggctgcccaggtg

SEQ ID NO: 56412 - DNA, 20 bp, Artificial Sequence
  chemically synthesized
atcagcggctgcccaggtgt

SEQ ID NO: 56413 - DNA, 20 bp, Artificial Sequence
  chemically synthesized
cagcggctgcccaggtgtgg

SEQ ID NO: 56414 - DNA, 20 bp, Artificial Sequence
  chemically synthesized
cggctgcccaggtgtgggag

SEQ ID NO: 56415 - DNA, 20 bp, Artificial Sequence
  chemically synthesized
ggctgcccaggtgtgggagc

SEQ ID NO: 56416 - DNA, 20 bp, Artificial Sequence
  chemically synthesized
gcccaggtgtgggagcgggc

SEQ ID NO: 56417 - DNA, 20 bp, Artificial Sequence
  chemically synthesized
cccaggtgtgggagcgggct

SEQ ID NO: 56418 - DNA, 20 bp, Artificial Sequence
  chemically synthesized
ccaggtgtgggagcgggcta

SEQ ID NO: 56419 - DNA, 20 bp, Artificial Sequence
  chemically synthesized
caggtgtgggagcgggctag

SEQ ID NO: 56420 - DNA, 20 bp, Artificial Sequence
  chemically synthesized
aggtgtgggagcgggctagg

SEQ ID NO: 56421 - DNA, 20 bp, Artificial Sequence
  chemically synthesized
ggagcgggctagggggatgt

SEQ ID NO: 56422 - DNA, 20 bp, Artificial Sequence
  chemically synthesized
gagcgggctagggggatgtg

SEQ ID NO: 56423 - DNA, 20 bp, Artificial Sequence
  chemically synthesized
cgggctagggggatgtgagg

SEQ ID NO: 56424 - DNA, 20 bp, Artificial Sequence
  chemically synthesized
gggatgtgaggaagaatacg

SEQ ID NO: 56425 - DNA, 20 bp, Artificial Sequence
  chemically synthesized
aggaagaatacgtggtgtgt

SEQ ID NO: 56426 - DNA, 20 bp, Artificial Sequence
  chemically synthesized
aatacgtggtgtgtcagcta

SEQ ID NO: 56427 - DNA, 20 bp, Artificial Sequence
  chemically synthesized
tacgtggtgtgtcagctaca

SEQ ID NO: 56428 - DNA, 20 bp, Artificial Sequence
  chemically synthesized
cgtggtgtgtcagctacaga

SEQ ID NO: 56429 - DNA, 20 bp, Artificial Sequence
  chemically synthesized
tggtgtgtcagctacagaga

SEQ ID NO: 56430 - DNA, 20 bp, Artificial Sequence
  chemically synthesized
gccctccaccacctacaccc

SEQ ID NO: 56431 - DNA, 20 bp, Artificial Sequence
  chemically synthesized
ctccaccacctacaccccag

SEQ ID NO: 56432 - DNA, 20 bp, Artificial Sequence
  chemically synthesized
accacctacaccccagtggt

SEQ ID NO: 56433 - DNA, 20 bp, Artificial Sequence
  chemically synthesized
tgagttcttaccgaaatctg

SEQ ID NO: 56434 - DNA, 20 bp, Artificial Sequence
  chemically synthesized
gagttcttaccgaaatctgt

SEQ ID NO: 56435 - DNA, 20 bp, Artificial Sequence
  chemically synthesized
tcttaccgaaatctgtaggt

SEQ ID NO: 56436 - DNA, 20 bp, Artificial Sequence
  chemically synthesized
tcggctttatctttccctga

SEQ ID NO: 56437 - DNA, 20 bp, Artificial Sequence
  chemically synthesized
ctttatctttccctgaaaga

SEQ ID NO: 56438 - DNA, 20 bp, Artificial Sequence
  chemically synthesized
atctttccctgaaagatgga

SEQ ID NO: 56439 - DNA, 20 bp, Artificial Sequence
  chemically synthesized
ctttccctgaaagatggaaa

SEQ ID NO: 56440 - DNA, 20 bp, Artificial Sequence
  chemically synthesized
tccctgaaagatggaaagag

SEQ ID NO: 56441 - DNA, 20 bp, Artificial Sequence
  chemically synthesized
gagtagatgtgaccatcacg

SEQ ID NO: 56442 - DNA, 20 bp, Artificial Sequence
  chemically synthesized
gtatacacctgctgtgccca

SEQ ID NO: 56443 - DNA, 20 bp, Artificial Sequence
  chemically synthesized
cacctgctgtgcccatggca

SEQ ID NO: 56444 - DNA, 20 bp, Artificial Sequence
  chemically synthesized
tgctgtgcccatggcatggc

SEQ ID NO: 56445 - DNA, 20 bp, Artificial Sequence
  chemically synthesized
ctgtgcccatggcatggcca

SEQ ID NO: 56446 - DNA, 20 bp, Artificial Sequence
  chemically synthesized
tgtgcccatggcatggccag

SEQ ID NO: 56447 - DNA, 20 bp, Artificial Sequence
  chemically synthesized
gtgcccatggcatggccaga

SEQ ID NO: 56448 - DNA, 20 bp, Artificial Sequence
  chemically synthesized
tgcccatggcatggccagag

SEQ ID NO: 56449 - DNA, 20 bp, Artificial Sequence
  chemically synthesized
atggccagaggggctcccta

SEQ ID NO: 56450 - DNA, 20 bp, Artificial Sequence
  chemically synthesized
tggccagaggggctccctaa

SEQ ID NO: 56451 - DNA, 20 bp, Artificial Sequence
  chemically synthesized
ggccagaggggctccctaaa

SEQ ID NO: 56452 - DNA, 20 bp, Artificial Sequence
  chemically synthesized
cagaggggctccctaaaggg

SEQ ID NO: 56453 - DNA, 20 bp, Artificial Sequence
  chemically synthesized
agaggggctccctaaagggc

SEQ ID NO: 56454 - DNA, 20 bp, Artificial Sequence
  chemically synthesized
gggctccctaaagggcagga

SEQ ID NO: 56455 - DNA, 20 bp, Artificial Sequence
  chemically synthesized
gctccctaaagggcaggaaa

SEQ ID NO: 56456 - DNA, 20 bp, Artificial Sequence
  chemically synthesized
ctaaagggcaggaaagagaa

SEQ ID NO: 56457 - DNA, 20 bp, Artificial Sequence
  chemically synthesized
aaagggcaggaaagagaatg

SEQ ID NO: 56458 - DNA, 20 bp, Artificial Sequence
  chemically synthesized
gcaggaaagagaatggagta

SEQ ID NO: 56459 - DNA, 20 bp, Artificial Sequence
  chemically synthesized
caggaaagagaatggagtaa

SEQ ID NO: 56460 - DNA, 20 bp, Artificial Sequence
  chemically synthesized
gagaatggagtaaaggtgaa

SEQ ID NO: 56461 - DNA, 20 bp, Artificial Sequence
  chemically synthesized
agaatggagtaaaggtgaaa

SEQ ID NO: 56462 - DNA, 20 bp, Artificial Sequence
  chemically synthesized
aaggtgaaaaggtcctcatc

SEQ ID NO: 56463 - DNA, 20 bp, Artificial Sequence
  chemically synthesized
aggtgaaaaggtcctcatct

SEQ ID NO: 56464 - DNA, 20 bp, Artificial Sequence
  chemically synthesized
gtgaaaaggtcctcatctgg

SEQ ID NO: 56465 - DNA, 20 bp, Artificial Sequence
  chemically synthesized
aaaggtcctcatctgggaga

SEQ ID NO: 56466 - DNA, 20 bp, Artificial Sequence
  chemically synthesized
gagacagtgcatcatctacc

SEQ ID NO: 56467 - DNA, 20 bp, Artificial Sequence
  chemically synthesized
gcatcatctacccagccacc

SEQ ID NO: 56468 - DNA, 20 bp, Artificial Sequence
  chemically synthesized
atttccatctcctatgcacc

SEQ ID NO: 56469 - DNA, 20 bp, Artificial Sequence
  chemically synthesized
ctatgcaccaagcattgtgc

SEQ ID NO: 56470 - DNA, 20 bp, Artificial Sequence
  chemically synthesized
tatgcaccaagcattgtgca

SEQ ID NO: 56471 - DNA, 20 bp, Artificial Sequence
  chemically synthesized
ccaagcattgtgcaaggctc

SEQ ID NO: 56472 - DNA, 20 bp, Artificial Sequence
  chemically synthesized
caagcattgtgcaaggctct

SEQ ID NO: 56473 - DNA, 20 bp, Artificial Sequence
  chemically synthesized
ggctctgggaatacaatgat

SEQ ID NO: 56474 - DNA, 20 bp, Artificial Sequence
  chemically synthesized
tgggaatacaatgatgagca

SEQ ID NO: 56475 - DNA, 20 bp, Artificial Sequence
  chemically synthesized
aatacaatgatgagcaaagc

SEQ ID NO: 56476 - DNA, 20 bp, Artificial Sequence
  chemically synthesized
tacaatgatgagcaaagcca

SEQ ID NO: 56477 - DNA, 20 bp, Artificial Sequence
  chemically synthesized
caatgatgagcaaagccaga

SEQ ID NO: 56478 - DNA, 20 bp, Artificial Sequence
  chemically synthesized
aatgatgagcaaagccagag

SEQ ID NO: 56479 - DNA, 20 bp, Artificial Sequence
  chemically synthesized
atgatgagcaaagccagaga

SEQ ID NO: 56480 - DNA, 20 bp, Artificial Sequence
  chemically synthesized
tgatgagcaaagccagagag

SEQ ID NO: 56481 - DNA, 20 bp, Artificial Sequence
  chemically synthesized
agagaggggccctgctcttg

SEQ ID NO: 56482 - DNA, 20 bp, Artificial Sequence
  chemically synthesized
cctgctcttgcagtttaata

SEQ ID NO: 56483 - DNA, 20 bp, Artificial Sequence
  chemically synthesized
tcttgcagtttaatacagtc

SEQ ID NO: 56484 - DNA, 20 bp, Artificial Sequence
  chemically synthesized
ttgcagtttaatacagtctg

SEQ ID NO: 56485 - DNA, 20 bp, Artificial Sequence
  chemically synthesized
tacagtctggagattacaca

SEQ ID NO: 56486 - DNA, 20 bp, Artificial Sequence
  chemically synthesized
ctggagattacacaaagaat

SEQ ID NO: 56487 - DNA, 20 bp, Artificial Sequence
  chemically synthesized
tacacaaagaatcagcatac

SEQ ID NO: 56488 - DNA, 20 bp, Artificial Sequence
  chemically synthesized
acacaaagaatcagcatact

SEQ ID NO: 56489 - DNA, 20 bp, Artificial Sequence
  chemically synthesized
tctccttgcacactctgttc

SEQ ID NO: 56490 - DNA, 20 bp, Artificial Sequence
  chemically synthesized
acactctgttctggctacac

SEQ ID NO: 56491 - DNA, 20 bp, Artificial Sequence
  chemically synthesized
caccaaacacgttcccacct

SEQ ID NO: 56492 - DNA, 20 bp, Artificial Sequence
  chemically synthesized
accaaacacgttcccacctc

SEQ ID NO: 56493 - DNA, 20 bp, Artificial Sequence
  chemically synthesized
ccaaacacgttcccacctca

SEQ ID NO: 56494 - DNA, 20 bp, Artificial Sequence
  chemically synthesized
ttttgcattgcaatcttctc

SEQ ID NO: 56495 - DNA, 20 bp, Artificial Sequence
  chemically synthesized
gcattgcaatcttctctggc

SEQ ID NO: 56496 - DNA, 20 bp, Artificial Sequence
  chemically synthesized
tgcaatcttctctggccaga

SEQ ID NO: 56497 - DNA, 20 bp, Artificial Sequence
  chemically synthesized
tctggccagacagcccttca

SEQ ID NO: 56498 - DNA, 20 bp, Artificial Sequence
  chemically synthesized
gcccttcacagctcttctgc

SEQ ID NO: 56499 - DNA, 20 bp, Artificial Sequence
  chemically synthesized
cttacttcctcacatccttg

SEQ ID NO: 56500 - DNA, 20 bp, Artificial Sequence
  chemically synthesized
acatccttgaagacttgact

SEQ ID NO: 56501 - DNA, 20 bp, Artificial Sequence
  chemically synthesized
tgactcagatctcatattct

SEQ ID NO: 56502 - DNA, 20 bp, Artificial Sequence
  chemically synthesized
tcagatctcatattctcagt

SEQ ID NO: 56503 - DNA, 20 bp, Artificial Sequence
  chemically synthesized
tatttaaccctgcttgcaac

SEQ ID NO: 56504 - DNA, 20 bp, Artificial Sequence
  chemically synthesized
ttgtttgttttttgtttttt

SEQ ID NO: 56505 - DNA, 20 bp, Artificial Sequence
  chemically synthesized
gtttgttttttgttttttta

SEQ ID NO: 56506 - DNA, 20 bp, Artificial Sequence
  chemically synthesized
gttttttgtttttttagaga

SEQ ID NO: 56507 - DNA, 20 bp, Artificial Sequence
  chemically synthesized
cagtgtcttgctttgtctcc

SEQ ID NO: 56508 - DNA, 20 bp, Artificial Sequence
  chemically synthesized
agtgtcttgctttgtctcct

SEQ ID NO: 56509 - DNA, 20 bp, Artificial Sequence
  chemically synthesized
ttgtctcctaggctgcaatg

SEQ ID NO: 56510 - DNA, 20 bp, Artificial Sequence
  chemically synthesized
gcaatgcagtgccatgatca

SEQ ID NO: 56511 - DNA, 20 bp, Artificial Sequence
  chemically synthesized
gccatgatcatagctcactg

SEQ ID NO: 56512 - DNA, 20 bp, Artificial Sequence
  chemically synthesized
tcactgcagcctcgacctcc

SEQ ID NO: 56513 - DNA, 20 bp, Artificial Sequence
  chemically synthesized
agcctcgacctcctggactc

SEQ ID NO: 56514 - DNA, 20 bp, Artificial Sequence
  chemically synthesized
ctcaagcaatcctcccacct

SEQ ID NO: 56515 - DNA, 20 bp, Artificial Sequence
  chemically synthesized
tcctcccacctcagccccct

SEQ ID NO: 56516 - DNA, 20 bp, Artificial Sequence
  chemically synthesized
tcccacctcagccccctgag

SEQ ID NO: 56517 - DNA, 20 bp, Artificial Sequence
  chemically synthesized
acctcagccccctgagtagc

SEQ ID NO: 56518 - DNA, 20 bp, Artificial Sequence
  chemically synthesized
cctcagccccctgagtagct

SEQ ID NO: 56519 - DNA, 20 bp, Artificial Sequence
  chemically synthesized
cccctgagtagctgggacca

SEQ ID NO: 56520 - DNA, 20 bp, Artificial Sequence
  chemically synthesized
ccctgagtagctgggaccac

SEQ ID NO: 56521 - DNA, 20 bp, Artificial Sequence
  chemically synthesized
caggtgcacaccaccacaca

SEQ ID NO: 56522 - DNA, 20 bp, Artificial Sequence
  chemically synthesized
tttgtttgattgtttttgcc

SEQ ID NO: 56523 - DNA, 20 bp, Artificial Sequence
  chemically synthesized
ttgtttgattgtttttgccc

SEQ ID NO: 56524 - DNA, 20 bp, Artificial Sequence
  chemically synthesized
ttgattgtttttgcccaggc

SEQ ID NO: 56525 - DNA, 20 bp, Artificial Sequence
  chemically synthesized
ccaggctggttttgaactct

SEQ ID NO: 56526 - DNA, 20 bp, Artificial Sequence
  chemically synthesized
caggctggttttgaactctt

SEQ ID NO: 56527 - DNA, 20 bp, Artificial Sequence
  chemically synthesized
ggttttgaactcttgggctc

SEQ ID NO: 56528 - DNA, 20 bp, Artificial Sequence
  chemically synthesized
tcaagcaatcctcctaccct

SEQ ID NO: 56529 - DNA, 20 bp, Artificial Sequence
  chemically synthesized
ctcctacccttggcctccca

SEQ ID NO: 56530 - DNA, 20 bp, Artificial Sequence
  chemically synthesized
cccttggcctcccaaagtgt

SEQ ID NO: 56531 - DNA, 20 bp, Artificial Sequence
  chemically synthesized
ccttggcctcccaaagtgtt

SEQ ID NO: 56532 - DNA, 20 bp, Artificial Sequence
  chemically synthesized
ctcccaaagtgttgggatta

SEQ ID NO: 56533 - DNA, 20 bp, Artificial Sequence
  chemically synthesized
tcccaaagtgttgggattat

SEQ ID NO: 56534 - DNA, 20 bp, Artificial Sequence
  chemically synthesized
agtgttgggattataggtgt

SEQ ID NO: 56535 - DNA, 20 bp, Artificial Sequence
  chemically synthesized
attataggtgtgagccacca

SEQ ID NO: 56536 - DNA, 20 bp, Artificial Sequence
  chemically synthesized
gtgagccaccatggcccgtc

SEQ ID NO: 56537 - DNA, 20 bp, Artificial Sequence
  chemically synthesized
attcttaattcctctaccct

SEQ ID NO: 56538 - DNA, 20 bp, Artificial Sequence
  chemically synthesized
tcttaattcctctaccctga

SEQ ID NO: 56539 - DNA, 20 bp, Artificial Sequence
  chemically synthesized
aattcctctaccctgagaga

SEQ ID NO: 56540 - DNA, 20 bp, Artificial Sequence
  chemically synthesized
ttcctctaccctgagagata

SEQ ID NO: 56541 - DNA, 20 bp, Artificial Sequence
  chemically synthesized
tcctctaccctgagagatag

SEQ ID NO: 56542 - DNA, 20 bp, Artificial Sequence
  chemically synthesized
cctctaccctgagagataga

SEQ ID NO: 56543 - DNA, 20 bp, Artificial Sequence
  chemically synthesized
cctgagagatagagggtcct

SEQ ID NO: 56544 - DNA, 20 bp, Artificial Sequence
  chemically synthesized
gggtcctgagatgtgccgcc

SEQ ID NO: 56545 - DNA, 20 bp, Artificial Sequence
  chemically synthesized
cagacctccctcctgaactg

SEQ ID NO: 56546 - DNA, 20 bp, Artificial Sequence
  chemically synthesized
agacctccctcctgaactgc

SEQ ID NO: 56547 - DNA, 20 bp, Artificial Sequence
  chemically synthesized
gaactgcaggacttatttcg

SEQ ID NO: 56548 - DNA, 20 bp, Artificial Sequence
  chemically synthesized
ggacttatttcgtagctgtt

SEQ ID NO: 56549 - DNA, 20 bp, Artificial Sequence
  chemically synthesized
acttatttcgtagctgttga

SEQ ID NO: 56550 - DNA, 20 bp, Artificial Sequence
  chemically synthesized
cgtagctgttgagagtgtga

SEQ ID NO: 56551 - DNA, 20 bp, Artificial Sequence
  chemically synthesized
agctgttgagagtgtgatgg

SEQ ID NO: 56552 - DNA, 20 bp, Artificial Sequence
  chemically synthesized
gttgagagtgtgatggtaga

SEQ ID NO: 56553 - DNA, 20 bp, Artificial Sequence
  chemically synthesized
ggtagatggctttctgctct

SEQ ID NO: 56554 - DNA, 20 bp, Artificial Sequence
  chemically synthesized
ttctgctctcagccttctcc

SEQ ID NO: 56555 - DNA, 20 bp, Artificial Sequence
  chemically synthesized
gccttctcctggcattgccc

SEQ ID NO: 56556 - DNA, 20 bp, Artificial Sequence
  chemically synthesized
ccttctcctggcattgccct

SEQ ID NO: 56557 - DNA, 20 bp, Artificial Sequence
  chemically synthesized
cctggcattgccctgggcta

SEQ ID NO: 56558 - DNA, 20 bp, Artificial Sequence
  chemically synthesized
tggcattgccctgggctaaa

SEQ ID NO: 56559 - DNA, 20 bp, Artificial Sequence
  chemically synthesized
gcattgccctgggctaaaga

SEQ ID NO: 56560 - DNA, 20 bp, Artificial Sequence
  chemically synthesized
taaagagagtcgccttgatc

SEQ ID NO: 56561 - DNA, 20 bp, Artificial Sequence
  chemically synthesized
aaagagagtcgccttgatca

SEQ ID NO: 56562 - DNA, 20 bp, Artificial Sequence
  chemically synthesized
gatcaaggttacgctctccc

SEQ ID NO: 56563 - DNA, 20 bp, Artificial Sequence
  chemically synthesized
atcaaggttacgctctcccc

SEQ ID NO: 56564 - DNA, 20 bp, Artificial Sequence
  chemically synthesized
tcaaggttacgctctcccca

SEQ ID NO: 56565 - DNA, 20 bp, Artificial Sequence
  chemically synthesized
ctgattcccttgtcccaact

SEQ ID NO: 56566 - DNA, 20 bp, Artificial Sequence
  chemically synthesized
tcccaacttggaccaactct

SEQ ID NO: 56567 - DNA, 20 bp, Artificial Sequence
  chemically synthesized
cccaacttggaccaactctg

SEQ ID NO: 56568 - DNA, 20 bp, Artificial Sequence
  chemically synthesized
caacttggaccaactctgag

SEQ ID NO: 56569 - DNA, 20 bp, Artificial Sequence
  chemically synthesized
caactctgaggagccatccc

SEQ ID NO: 56570 - DNA, 20 bp, Artificial Sequence
  chemically synthesized
tgaggagccatccccagctt

SEQ ID NO: 56571 - DNA, 20 bp, Artificial Sequence
  chemically synthesized
aggagccatccccagcttca

SEQ ID NO: 56572 - DNA, 20 bp, Artificial Sequence
  chemically synthesized
cccagcttcagagctcgctg

SEQ ID NO: 56573 - DNA, 20 bp, Artificial Sequence
  chemically synthesized
ccagcttcagagctcgctgt

SEQ ID NO: 56574 - DNA, 20 bp, Artificial Sequence
  chemically synthesized
cagcttcagagctcgctgtg

SEQ ID NO: 56575 - DNA, 20 bp, Artificial Sequence
  chemically synthesized
ttcagagctcgctgtggggt

SEQ ID NO: 56576 - DNA, 20 bp, Artificial Sequence
  chemically synthesized
agctcgctgtggggttggat

SEQ ID NO: 56577 - DNA, 20 bp, Artificial Sequence
  chemically synthesized
gctcgctgtggggttggatg

SEQ ID NO: 56578 - DNA, 20 bp, Artificial Sequence
  chemically synthesized
cgctgtggggttggatgagg

SEQ ID NO: 56579 - DNA, 20 bp, Artificial Sequence
  chemically synthesized
ggatgaggcagaatcacaac

SEQ ID NO: 56580 - DNA, 20 bp, Artificial Sequence
  chemically synthesized
tcctgttccttcccttctac

SEQ ID NO: 56581 - DNA, 20 bp, Artificial Sequence
  chemically synthesized
ttccttcccttctacaagta

SEQ ID NO: 56582 - DNA, 20 bp, Artificial Sequence
  chemically synthesized
cttctacaagtatagttccc

SEQ ID NO: 56583 - DNA, 20 bp, Artificial Sequence
  chemically synthesized
tctacaagtatagttcccca

SEQ ID NO: 56584 - DNA, 20 bp, Artificial Sequence
  chemically synthesized
ctgcacgtgaatctccattt

SEQ ID NO: 56585 - DNA, 20 bp, Artificial Sequence
  chemically synthesized
ctccatttcagcctgctttc

SEQ ID NO: 56586 - DNA, 20 bp, Artificial Sequence
  chemically synthesized
tccatttcagcctgctttcc

SEQ ID NO: 56587 - DNA, 20 bp, Artificial Sequence
  chemically synthesized
ccatttcagcctgctttcca

SEQ ID NO: 56588 - DNA, 20 bp, Artificial Sequence
  chemically synthesized
ctgctttccagggaacccca

SEQ ID NO: 56589 - DNA, 20 bp, Artificial Sequence
  chemically synthesized
gggaaccccatagataaata

SEQ ID NO: 56590 - DNA, 20 bp, Artificial Sequence
  chemically synthesized
ggaaccccatagataaataa

SEQ ID NO: 56591 - DNA, 20 bp, Artificial Sequence
  chemically synthesized
acactaacaattatatacct

SEQ ID NO: 56592 - DNA, 20 bp, Artificial Sequence
  chemically synthesized
cactaacaattatatacctt

SEQ ID NO: 56593 - DNA, 20 bp, Artificial Sequence
  chemically synthesized
cttttttttttttttcctga

SEQ ID NO: 56594 - DNA, 20 bp, Artificial Sequence
  chemically synthesized
cagaatctttctctgtcacc

SEQ ID NO: 56595 - DNA, 20 bp, Artificial Sequence
  chemically synthesized
agaatctttctctgtcacca

SEQ ID NO: 56596 - DNA, 20 bp, Artificial Sequence
  chemically synthesized
tctttctctgtcaccaaggc

SEQ ID NO: 56597 - DNA, 20 bp, Artificial Sequence
  chemically synthesized
tttctctgtcaccaaggctg

SEQ ID NO: 56598 - DNA, 20 bp, Artificial Sequence
  chemically synthesized
ctgtcaccaaggctggagtg

SEQ ID NO: 56599 - DNA, 20 bp, Artificial Sequence
  chemically synthesized
tcaccaaggctggagtgcag

SEQ ID NO: 56600 - DNA, 20 bp, Artificial Sequence
  chemically synthesized
ggagtgcagtggtgtgattt

SEQ ID NO: 56601 - DNA, 20 bp, Artificial Sequence
  chemically synthesized
tcactgcaacctctgcctcc

SEQ ID NO: 56602 - DNA, 20 bp, Artificial Sequence
  chemically synthesized
cactgcaacctctgcctccc

SEQ ID NO: 56603 - DNA, 20 bp, Artificial Sequence
  chemically synthesized
aacctctgcctcccgggttg

SEQ ID NO: 56604 - DNA, 20 bp, Artificial Sequence
  chemically synthesized
ttgaagtgattctcctgccg

SEQ ID NO: 56605 - DNA, 20 bp, Artificial Sequence
  chemically synthesized
attctcctgccgcagcctcc

SEQ ID NO: 56606 - DNA, 20 bp, Artificial Sequence
  chemically synthesized
ttctcctgccgcagcctcct

SEQ ID NO: 56607 - DNA, 20 bp, Artificial Sequence
  chemically synthesized
tcctgccgcagcctcctggg

SEQ ID NO: 56608 - DNA, 20 bp, Artificial Sequence
  chemically synthesized
gccgcagcctcctgggtagc

SEQ ID NO: 56609 - DNA, 20 bp, Artificial Sequence
  chemically synthesized
ccgcagcctcctgggtagct

SEQ ID NO: 56610 - DNA, 20 bp, Artificial Sequence
  chemically synthesized
ctcctgggtagctgggatta

SEQ ID NO: 56611 - DNA, 20 bp, Artificial Sequence
  chemically synthesized
tcctgggtagctgggattac

SEQ ID NO: 56612 - DNA, 20 bp, Artificial Sequence
  chemically synthesized
caggcgcccgccaccatgcc

SEQ ID NO: 56613 - DNA, 20 bp, Artificial Sequence
  chemically synthesized
gcccgccaccatgcctggct

SEQ ID NO: 56614 - DNA, 20 bp, Artificial Sequence
  chemically synthesized
aagtttttgtatttttttat

SEQ ID NO: 56615 - DNA, 20 bp, Artificial Sequence
  chemically synthesized
tgtatttttttattagtgac

SEQ ID NO: 56616 - DNA, 20 bp, Artificial Sequence
  chemically synthesized
gtatttttttattagtgacg

SEQ ID NO: 56617 - DNA, 20 bp, Artificial Sequence
  chemically synthesized
gtgacgaggtttcaccatgt

SEQ ID NO: 56618 - DNA, 20 bp, Artificial Sequence
  chemically synthesized
cgaggtttcaccatgttggc

SEQ ID NO: 56619 - DNA, 20 bp, Artificial Sequence
  chemically synthesized
gaggtttcaccatgttggcc

SEQ ID NO: 56620 - DNA, 20 bp, Artificial Sequence
  chemically synthesized
tttcaccatgttggccaggc

SEQ ID NO: 56621 - DNA, 20 bp, Artificial Sequence
  chemically synthesized
tggtctcaaactcctgacct

SEQ ID NO: 56622 - DNA, 20 bp, Artificial Sequence
  chemically synthesized
ggtctcaaactcctgacctc

SEQ ID NO: 56623 - DNA, 20 bp, Artificial Sequence
  chemically synthesized
ctcaggtgatccacctgcgt

SEQ ID NO: 56624 - DNA, 20 bp, Artificial Sequence
  chemically synthesized
ccacctgcgttggcctccca

SEQ ID NO: 56625 - DNA, 20 bp, Artificial Sequence
  chemically synthesized
gcgttggcctcccaaagtgc

SEQ ID NO: 56626 - DNA, 20 bp, Artificial Sequence
  chemically synthesized
cgttggcctcccaaagtgct

SEQ ID NO: 56627 - DNA, 20 bp, Artificial Sequence
  chemically synthesized
ctcccaaagtgctaggatta

SEQ ID NO: 56628 - DNA, 20 bp, Artificial Sequence
  chemically synthesized
tcccaaagtgctaggattac

SEQ ID NO: 56629 - DNA, 20 bp, Artificial Sequence
  chemically synthesized
agtgctaggattacaggcgt

SEQ ID NO: 56630 - DNA, 20 bp, Artificial Sequence
  chemically synthesized
caggcgtgagccaccgcgcc

SEQ ID NO: 56631 - DNA, 20 bp, Artificial Sequence
  chemically synthesized
ccgcgcccggcctactttct

SEQ ID NO: 56632 - DNA, 20 bp, Artificial Sequence
  chemically synthesized
ccggcctactttctgagcct

SEQ ID NO: 56633 - DNA, 20 bp, Artificial Sequence
  chemically synthesized
gagccttagctactctacct

SEQ ID NO: 56634 - DNA, 20 bp, Artificial Sequence
  chemically synthesized
agccttagctactctaccta

SEQ ID NO: 56635 - DNA, 20 bp, Artificial Sequence
  chemically synthesized
ccttagctactctacctaag

SEQ ID NO: 56636 - DNA, 20 bp, Artificial Sequence
  chemically synthesized
tagctactctacctaaggag

SEQ ID NO: 56637 - DNA, 20 bp, Artificial Sequence
  chemically synthesized
gctactctacctaaggagca

SEQ ID NO: 56638 - DNA, 20 bp, Artificial Sequence
  chemically synthesized
gataataatttgcttctatt

SEQ ID NO: 56639 - DNA, 20 bp, Artificial Sequence
  chemically synthesized
ataatttgcttctattaaga

SEQ ID NO: 56640 - DNA, 20 bp, Artificial Sequence
  chemically synthesized
aatttgcttctattaagaca

SEQ ID NO: 56641 - DNA, 20 bp, Artificial Sequence
  chemically synthesized
atttgcttctattaagacag

SEQ ID NO: 56642 - DNA, 20 bp, Artificial Sequence
  chemically synthesized
ctaaataaaataacctctta

SEQ ID NO: 56643 - DNA, 20 bp, Artificial Sequence
  chemically synthesized
taaagccactttaaactttc

SEQ ID NO: 56644 - DNA, 20 bp, Artificial Sequence
  chemically synthesized
gtctgtgcctccattaattt

SEQ ID NO: 56645 - DNA, 20 bp, Artificial Sequence
  chemically synthesized
tctgtgcctccattaatttc

SEQ ID NO: 56646 - DNA, 20 bp, Artificial Sequence
  chemically synthesized
ctgtgcctccattaatttca

SEQ ID NO: 56647 - DNA, 20 bp, Artificial Sequence
  chemically synthesized
gtgcctccattaatttcagg

SEQ ID NO: 56648 - DNA, 20 bp, Artificial Sequence
  chemically synthesized
agaaattcatccttgataac

SEQ ID NO: 56649 - DNA, 20 bp, Artificial Sequence
  chemically synthesized
ataacaagctgttatgatga

SEQ ID NO: 56650 - DNA, 20 bp, Artificial Sequence
  chemically synthesized
aagcaaacatatttctacaa

SEQ ID NO: 56651 - DNA, 20 bp, Artificial Sequence
  chemically synthesized
atatttctacaaaagatgtt

SEQ ID NO: 56652 - DNA, 20 bp, Artificial Sequence
  chemically synthesized
gcctataaacaatcattttc

SEQ ID NO: 56653 - DNA, 20 bp, Artificial Sequence
  chemically synthesized
atatattttttttttttttt

SEQ ID NO: 56654 - DNA, 20 bp, Artificial Sequence
  chemically synthesized
atttttttttttttttcaga

SEQ ID NO: 56655 - DNA, 20 bp, Artificial Sequence
  chemically synthesized
tggtgtctcattttgtcgcc

SEQ ID NO: 56656 - DNA, 20 bp, Artificial Sequence
  chemically synthesized
ggtgtctcattttgtcgccc

SEQ ID NO: 56657 - DNA, 20 bp, Artificial Sequence
  chemically synthesized
tctcattttgtcgcccaggc

SEQ ID NO: 56658 - DNA, 20 bp, Artificial Sequence
  chemically synthesized
tcattttgtcgcccaggctg

SEQ ID NO: 56659 - DNA, 20 bp, Artificial Sequence
  chemically synthesized
tcgcccaggctggagtgcaa

SEQ ID NO: 56660 - DNA, 20 bp, Artificial Sequence
  chemically synthesized
ggagtgcaatggcgcaatct

SEQ ID NO: 56661 - DNA, 20 bp, Artificial Sequence
  chemically synthesized
aatcttggctcaccacctcc

SEQ ID NO: 56662 - DNA, 20 bp, Artificial Sequence
  chemically synthesized
atcttggctcaccacctccc

SEQ ID NO: 56663 - DNA, 20 bp, Artificial Sequence
  chemically synthesized
gctcaccacctcccaggttc

SEQ ID NO: 56664 - DNA, 20 bp, Artificial Sequence
  chemically synthesized
ttcaagcgattctcctgcct

SEQ ID NO: 56665 - DNA, 20 bp, Artificial Sequence
  chemically synthesized
ttctcctgccttagcctcct

SEQ ID NO: 56666 - DNA, 20 bp, Artificial Sequence
  chemically synthesized
tcctgccttagcctcctgag

SEQ ID NO: 56667 - DNA, 20 bp, Artificial Sequence
  chemically synthesized
ccttagcctcctgagtagct

SEQ ID NO: 56668 - DNA, 20 bp, Artificial Sequence
  chemically synthesized
ctcctgagtagctcagatta

SEQ ID NO: 56669 - DNA, 20 bp, Artificial Sequence
  chemically synthesized
tcctgagtagctcagattac

SEQ ID NO: 56670 - DNA, 20 bp, Artificial Sequence
  chemically synthesized
ctcagattacaggcatgcac

SEQ ID NO: 56671 - DNA, 20 bp, Artificial Sequence
  chemically synthesized
tcagattacaggcatgcacc

SEQ ID NO: 56672 - DNA, 20 bp, Artificial Sequence
  chemically synthesized
caggcatgcaccaggacacc

SEQ ID NO: 56673 - DNA, 20 bp, Artificial Sequence
  chemically synthesized
ccagctaatttttgtatttt

SEQ ID NO: 56674 - DNA, 20 bp, Artificial Sequence
  chemically synthesized
gctaatttttgtatttttag

SEQ ID NO: 56675 - DNA, 20 bp, Artificial Sequence
  chemically synthesized
taatttttgtatttttagta

SEQ ID NO: 56676 - DNA, 20 bp, Artificial Sequence
  chemically synthesized
ttttgtatttttagtagaga

SEQ ID NO: 56677 - DNA, 20 bp, Artificial Sequence
  chemically synthesized
tttgtatttttagtagagac

SEQ ID NO: 56678 - DNA, 20 bp, Artificial Sequence
  chemically synthesized
ttgtatttttagtagagaca

SEQ ID NO: 56679 - DNA, 20 bp, Artificial Sequence
  chemically synthesized
gagacagggttttgccatgt

SEQ ID NO: 56680 - DNA, 20 bp, Artificial Sequence
  chemically synthesized
cagggttttgccatgttggc

SEQ ID NO: 56681 - DNA, 20 bp, Artificial Sequence
  chemically synthesized
agggttttgccatgttggcc

SEQ ID NO: 56682 - DNA, 20 bp, Artificial Sequence
  chemically synthesized
ttttgccatgttggccaggc

SEQ ID NO: 56683 - DNA, 20 bp, Artificial Sequence
  chemically synthesized
tggtcttgaactcctcacct

SEQ ID NO: 56684 - DNA, 20 bp, Artificial Sequence
  chemically synthesized
ggtcttgaactcctcacctc

SEQ ID NO: 56685 - DNA, 20 bp, Artificial Sequence
  chemically synthesized
ctcaggtgatccacccgcct

SEQ ID NO: 56686 - DNA, 20 bp, Artificial Sequence
  chemically synthesized
ccacccgcctcagcctccca

SEQ ID NO: 56687 - DNA, 20 bp, Artificial Sequence
  chemically synthesized
gcctcagcctcccaaagtgc

SEQ ID NO: 56688 - DNA, 20 bp, Artificial Sequence
  chemically synthesized
cctcagcctcccaaagtgct

SEQ ID NO: 56689 - DNA, 20 bp, Artificial Sequence
  chemically synthesized
ctcccaaagtgctgggatta

SEQ ID NO: 56690 - DNA, 20 bp, Artificial Sequence
  chemically synthesized
tcccaaagtgctgggattac

SEQ ID NO: 56691 - DNA, 20 bp, Artificial Sequence
  chemically synthesized
cccaaagtgctgggattaca

SEQ ID NO: 56692 - DNA, 20 bp, Artificial Sequence
  chemically synthesized
aagtgctgggattacagggt

SEQ ID NO: 56693 - DNA, 20 bp, Artificial Sequence
  chemically synthesized
acagggtgagccaccgtgcc

SEQ ID NO: 56694 - DNA, 20 bp, Artificial Sequence
  chemically synthesized
tggcctatcctacatattaa

SEQ ID NO: 56695 - DNA, 20 bp, Artificial Sequence
  chemically synthesized
taatagtttacttttttttt

SEQ ID NO: 56696 - DNA, 20 bp, Artificial Sequence
  chemically synthesized
agtttactttttttttgaga

SEQ ID NO: 56697 - DNA, 20 bp, Artificial Sequence
  chemically synthesized
tttactttttttttgagaca

SEQ ID NO: 56698 - DNA, 20 bp, Artificial Sequence
  chemically synthesized
cagagtctcgttctgtcatt

SEQ ID NO: 56699 - DNA, 20 bp, Artificial Sequence
  chemically synthesized
agagtctcgttctgtcattc

SEQ ID NO: 56700 - DNA, 20 bp, Artificial Sequence
  chemically synthesized
tctcgttctgtcattcaggc

SEQ ID NO: 56701 - DNA, 20 bp, Artificial Sequence
  chemically synthesized
tcgttctgtcattcaggctg

SEQ ID NO: 56702 - DNA, 20 bp, Artificial Sequence
  chemically synthesized
ctgtcattcaggctggagtg

SEQ ID NO: 56703 - DNA, 20 bp, Artificial Sequence
  chemically synthesized
tcattcaggctggagtgcag

SEQ ID NO: 56704 - DNA, 20 bp, Artificial Sequence
  chemically synthesized
ggagtgcagtggtccgatct

SEQ ID NO: 56705 - DNA, 20 bp, Artificial Sequence
  chemically synthesized
tcactgcaacctctgcctcc

SEQ ID NO: 56706 - DNA, 20 bp, Artificial Sequence
  chemically synthesized
cactgcaacctctgcctccc

SEQ ID NO: 56707 - DNA, 20 bp, Artificial Sequence
  chemically synthesized
aacctctgcctcccaggttc

SEQ ID NO: 56708 - DNA, 20 bp, Artificial Sequence
  chemically synthesized
ttcaagcgattctcctgcct

SEQ ID NO: 56709 - DNA, 20 bp, Artificial Sequence
  chemically synthesized
attctcctgcctcagcctcc

SEQ ID NO: 56710 - DNA, 20 bp, Artificial Sequence
  chemically synthesized
ttctcctgcctcagcctccc

SEQ ID NO: 56711 - DNA, 20 bp, Artificial Sequence
  chemically synthesized
tcctgcctcagcctcccagg

SEQ ID NO: 56712 - DNA, 20 bp, Artificial Sequence
  chemically synthesized
cctcagcctcccaggtagct

SEQ ID NO: 56713 - DNA, 20 bp, Artificial Sequence
  chemically synthesized
ctcccaggtagctgagacta

SEQ ID NO: 56714 - DNA, 20 bp, Artificial Sequence
  chemically synthesized
tcccaggtagctgagactac

SEQ ID NO: 56715 - DNA, 20 bp, Artificial Sequence
  chemically synthesized
ctgaccaatttttccatttt

SEQ ID NO: 56716 - DNA, 20 bp, Artificial Sequence
  chemically synthesized
caatttttccatttttagta

SEQ ID NO: 56717 - DNA, 20 bp, Artificial Sequence
  chemically synthesized
ttttccatttttagtaaaga

SEQ ID NO: 56718 - DNA, 20 bp, Artificial Sequence
  chemically synthesized
tttccatttttagtaaagac

SEQ ID NO: 56719 - DNA, 20 bp, Artificial Sequence
  chemically synthesized
aagacaggattttgcaatgt

SEQ ID NO: 56720 - DNA, 20 bp, Artificial Sequence
  chemically synthesized
caggattttgcaatgttggc

SEQ ID NO: 56721 - DNA, 20 bp, Artificial Sequence
  chemically synthesized
aggattttgcaatgttggcc

SEQ ID NO: 56722 - DNA, 20 bp, Artificial Sequence
  chemically synthesized
ttttgcaatgttggccaggc

SEQ ID NO: 56723 - DNA, 20 bp, Artificial Sequence
  chemically synthesized
tggttttgaactcctgacct

SEQ ID NO: 56724 - DNA, 20 bp, Artificial Sequence
  chemically synthesized
ggttttgaactcctgacctc

SEQ ID NO: 56725 - DNA, 20 bp, Artificial Sequence
  chemically synthesized
ctcaggtgatctacctacct

SEQ ID NO: 56726 - DNA, 20 bp, Artificial Sequence
  chemically synthesized
ctacctaccttggcttccca

SEQ ID NO: 56727 - DNA, 20 bp, Artificial Sequence
  chemically synthesized
accttggcttcccaaagtgc

SEQ ID NO: 56728 - DNA, 20 bp, Artificial Sequence
  chemically synthesized
ccttggcttcccaaagtgct

SEQ ID NO: 56729 - DNA, 20 bp, Artificial Sequence
  chemically synthesized
ttcccaaagtgctgggatta

SEQ ID NO: 56730 - DNA, 20 bp, Artificial Sequence
  chemically synthesized
tcccaaagtgctgggattac

SEQ ID NO: 56731 - DNA, 20 bp, Artificial Sequence
  chemically synthesized
agtgctgggattacaggcat

SEQ ID NO: 56732 - DNA, 20 bp, Artificial Sequence
  chemically synthesized
caggcatgagcaaccacaac

SEQ ID NO: 56733 - DNA, 20 bp, Artificial Sequence
  chemically synthesized
atgagcaaccacaactggcc

SEQ ID NO: 56734 - DNA, 20 bp, Artificial Sequence
  chemically synthesized
tatatttcacctcctctatt

SEQ ID NO: 56735 - DNA, 20 bp, Artificial Sequence
  chemically synthesized
cacctcctctattcagattt

SEQ ID NO: 56736 - DNA, 20 bp, Artificial Sequence
  chemically synthesized
tattcagatttcagctccac

SEQ ID NO: 56737 - DNA, 20 bp, Artificial Sequence
  chemically synthesized
attcagatttcagctccaca

SEQ ID NO: 56738 - DNA, 20 bp, Artificial Sequence
  chemically synthesized
ttcagatttcagctccacaa

SEQ ID NO: 56739 - DNA, 20 bp, Artificial Sequence
  chemically synthesized
agatttcagctccacaaggg

SEQ ID NO: 56740 - DNA, 20 bp, Artificial Sequence
  chemically synthesized
gatttcagctccacaagggc

SEQ ID NO: 56741 - DNA, 20 bp, Artificial Sequence
  chemically synthesized
atttcagctccacaagggca

SEQ ID NO: 56742 - DNA, 20 bp, Artificial Sequence
  chemically synthesized
gtgtctgtgttgttcactga

SEQ ID NO: 56743 - DNA, 20 bp, Artificial Sequence
  chemically synthesized
gtctgtgttgttcactgaca

SEQ ID NO: 56744 - DNA, 20 bp, Artificial Sequence
  chemically synthesized
tctgtgttgttcactgacag

SEQ ID NO: 56745 - DNA, 20 bp, Artificial Sequence
  chemically synthesized
ttcactgacagaggtatccc

SEQ ID NO: 56746 - DNA, 20 bp, Artificial Sequence
  chemically synthesized
acagaggtatccctagcaca

SEQ ID NO: 56747 - DNA, 20 bp, Artificial Sequence
  chemically synthesized
ggtatccctagcacatagaa

SEQ ID NO: 56748 - DNA, 20 bp, Artificial Sequence
  chemically synthesized
ctagcacatagaacagtgta

SEQ ID NO: 56749 - DNA, 20 bp, Artificial Sequence
  chemically synthesized
atagaacagtgtatagctcc

SEQ ID NO: 56750 - DNA, 20 bp, Artificial Sequence
  chemically synthesized
gaacagtgtatagctcccag

SEQ ID NO: 56751 - DNA, 20 bp, Artificial Sequence
  chemically synthesized
aacagtgtatagctcccagt

SEQ ID NO: 56752 - DNA, 20 bp, Artificial Sequence
  chemically synthesized
tatagctcccagtaggtgct

SEQ ID NO: 56753 - DNA, 20 bp, Artificial Sequence
  chemically synthesized
gctcccagtaggtgcttggt

SEQ ID NO: 56754 - DNA, 20 bp, Artificial Sequence
  chemically synthesized
agtaggtgcttggtaagtaa

SEQ ID NO: 56755 - DNA, 20 bp, Artificial Sequence
  chemically synthesized
ttggtaagtaacagctgaat

SEQ ID NO: 56756 - DNA, 20 bp, Artificial Sequence
  chemically synthesized
tgaatgagtgaatatgctct

SEQ ID NO: 56757 - DNA, 20 bp, Artificial Sequence
  chemically synthesized
gaatgagtgaatatgctctg

SEQ ID NO: 56758 - DNA, 20 bp, Artificial Sequence
  chemically synthesized
tatgctctgaggtaaatgcg

SEQ ID NO: 56759 - DNA, 20 bp, Artificial Sequence
  chemically synthesized
gaggtaaatgcgtggtctgt

SEQ ID NO: 56760 - DNA, 20 bp, Artificial Sequence
  chemically synthesized
ggtaaatgcgtggtctgtga

SEQ ID NO: 56761 - DNA, 20 bp, Artificial Sequence
  chemically synthesized
gtctgtgagagcaaataact

SEQ ID NO: 56762 - DNA, 20 bp, Artificial Sequence
  chemically synthesized
tctgtgagagcaaataacta

SEQ ID NO: 56763 - DNA, 20 bp, Artificial Sequence
  chemically synthesized
ctgtgagagcaaataactaa

SEQ ID NO: 56764 - DNA, 20 bp, Artificial Sequence
  chemically synthesized
aataactaagggaccttccc

SEQ ID NO: 56765 - DNA, 20 bp, Artificial Sequence
  chemically synthesized
taagggaccttccctagttt

SEQ ID NO: 56766 - DNA, 20 bp, Artificial Sequence
  chemically synthesized
aagggaccttccctagtttt

SEQ ID NO: 56767 - DNA, 20 bp, Artificial Sequence
  chemically synthesized
agggaccttccctagttttg

SEQ ID NO: 56768 - DNA, 20 bp, Artificial Sequence
  chemically synthesized
accttccctagttttggggt

SEQ ID NO: 56769 - DNA, 20 bp, Artificial Sequence
  chemically synthesized
ccttccctagttttggggtc

SEQ ID NO: 56770 - DNA, 20 bp, Artificial Sequence
  chemically synthesized
cttccctagttttggggtca

SEQ ID NO: 56771 - DNA, 20 bp, Artificial Sequence
  chemically synthesized
cctagttttggggtcaggga

SEQ ID NO: 56772 - DNA, 20 bp, Artificial Sequence
  chemically synthesized
ctagttttggggtcagggaa

SEQ ID NO: 56773 - DNA, 20 bp, Artificial Sequence
  chemically synthesized
tagttttggggtcagggaaa

SEQ ID NO: 56774 - DNA, 20 bp, Artificial Sequence
  chemically synthesized
gggtcagggaaagggtctct

SEQ ID NO: 56775 - DNA, 20 bp, Artificial Sequence
  chemically synthesized
ggtcagggaaagggtctctg

SEQ ID NO: 56776 - DNA, 20 bp, Artificial Sequence
  chemically synthesized
cagggaaagggtctctgagg

SEQ ID NO: 56777 - DNA, 20 bp, Artificial Sequence
  chemically synthesized
agggaaagggtctctgagga

SEQ ID NO: 56778 - DNA, 20 bp, Artificial Sequence
  chemically synthesized
gggaaagggtctctgaggaa

SEQ ID NO: 56779 - DNA, 20 bp, Artificial Sequence
  chemically synthesized
ggtctctgaggaagggatac

SEQ ID NO: 56780 - DNA, 20 bp, Artificial Sequence
  chemically synthesized
aggaagggatactagtacct

SEQ ID NO: 56781 - DNA, 20 bp, Artificial Sequence
  chemically synthesized
gaagggatactagtacctta

SEQ ID NO: 56782 - DNA, 20 bp, Artificial Sequence
  chemically synthesized
agggatactagtaccttaga

SEQ ID NO: 56783 - DNA, 20 bp, Artificial Sequence
  chemically synthesized
actagtaccttagagagtac

SEQ ID NO: 56784 - DNA, 20 bp, Artificial Sequence
  chemically synthesized
accttagagagtactagtct

SEQ ID NO: 56785 - DNA, 20 bp, Artificial Sequence
  chemically synthesized
cttagagagtactagtctta

SEQ ID NO: 56786 - DNA, 20 bp, Artificial Sequence
  chemically synthesized
ttagagagtactagtcttag

SEQ ID NO: 56787 - DNA, 20 bp, Artificial Sequence
  chemically synthesized
tagagagtactagtcttaga

SEQ ID NO: 56788 - DNA, 20 bp, Artificial Sequence
  chemically synthesized
agagtactagtcttagaggg

SEQ ID NO: 56789 - DNA, 20 bp, Artificial Sequence
  chemically synthesized
actagtcttagagggcagct

SEQ ID NO: 56790 - DNA, 20 bp, Artificial Sequence
  chemically synthesized
ttagagggcagctgagactt

SEQ ID NO: 56791 - DNA, 20 bp, Artificial Sequence
  chemically synthesized
tagagggcagctgagacttt

SEQ ID NO: 56792 - DNA, 20 bp, Artificial Sequence
  chemically synthesized
agagggcagctgagacttta

SEQ ID NO: 56793 - DNA, 20 bp, Artificial Sequence
  chemically synthesized
ggcagctgagactttagggt

SEQ ID NO: 56794 - DNA, 20 bp, Artificial Sequence
  chemically synthesized
gcagctgagactttagggtg

SEQ ID NO: 56795 - DNA, 20 bp, Artificial Sequence
  chemically synthesized
cagctgagactttagggtga

SEQ ID NO: 56796 - DNA, 20 bp, Artificial Sequence
  chemically synthesized
gctgagactttagggtgagg

SEQ ID NO: 56797 - DNA, 20 bp, Artificial Sequence
  chemically synthesized
ctgagactttagggtgaggg

SEQ ID NO: 56798 - DNA, 20 bp, Artificial Sequence
  chemically synthesized
tgagactttagggtgaggga

SEQ ID NO: 56799 - DNA, 20 bp, Artificial Sequence
  chemically synthesized
gagactttagggtgagggag

SEQ ID NO: 56800 - DNA, 20 bp, Artificial Sequence
  chemically synthesized
aaatctatcatttgatttga

SEQ ID NO: 56801 - DNA, 20 bp, Artificial Sequence
  chemically synthesized
ttgatttgacagtaaccatc

SEQ ID NO: 56802 - DNA, 20 bp, Artificial Sequence
  chemically synthesized
tggctgtaactaataaaacg

SEQ ID NO: 56803 - DNA, 20 bp, Artificial Sequence
  chemically synthesized
ggctgtaactaataaaacgt

SEQ ID NO: 56804 - DNA, 20 bp, Artificial Sequence
  chemically synthesized
taactaataaaacgtaggca

SEQ ID NO: 56805 - DNA, 20 bp, Artificial Sequence
  chemically synthesized
actaataaaacgtaggcaca

SEQ ID NO: 56806 - DNA, 20 bp, Artificial Sequence
  chemically synthesized
taataaaacgtaggcacaga

SEQ ID NO: 56807 - DNA, 20 bp, Artificial Sequence
  chemically synthesized
aataaaacgtaggcacagag

SEQ ID NO: 56808 - DNA, 20 bp, Artificial Sequence
  chemically synthesized
ataaaacgtaggcacagaga

SEQ ID NO: 56809 - DNA, 20 bp, Artificial Sequence
  chemically synthesized
aacgtaggcacagagagggc

SEQ ID NO: 56810 - DNA, 20 bp, Artificial Sequence
  chemically synthesized
acgtaggcacagagagggca

SEQ ID NO: 56811 - DNA, 20 bp, Artificial Sequence
  chemically synthesized
cgtaggcacagagagggcaa

SEQ ID NO: 56812 - DNA, 20 bp, Artificial Sequence
  chemically synthesized
gcacagagagggcaagggat

SEQ ID NO: 56813 - DNA, 20 bp, Artificial Sequence
  chemically synthesized
agagagggcaagggattgga

SEQ ID NO: 56814 - DNA, 20 bp, Artificial Sequence
  chemically synthesized
agggcaagggattggacggt

SEQ ID NO: 56815 - DNA, 20 bp, Artificial Sequence
  chemically synthesized
aagggattggacggtcagct

SEQ ID NO: 56816 - DNA, 20 bp, Artificial Sequence
  chemically synthesized
agggattggacggtcagctc

SEQ ID NO: 56817 - DNA, 20 bp, Artificial Sequence
  chemically synthesized
ggattggacggtcagctcag

SEQ ID NO: 56818 - DNA, 20 bp, Artificial Sequence
  chemically synthesized
gattggacggtcagctcagg

SEQ ID NO: 56819 - DNA, 20 bp, Artificial Sequence
  chemically synthesized
attggacggtcagctcagga

SEQ ID NO: 56820 - DNA, 20 bp, Artificial Sequence
  chemically synthesized
tcagctcaggagggcacatc

SEQ ID NO: 56821 - DNA, 20 bp, Artificial Sequence
  chemically synthesized
gctcaggagggcacatccag

SEQ ID NO: 56822 - DNA, 20 bp, Artificial Sequence
  chemically synthesized
ctcaggagggcacatccagt

SEQ ID NO: 56823 - DNA, 20 bp, Artificial Sequence
  chemically synthesized
ggagggcacatccagtgggc

SEQ ID NO: 56824 - DNA, 20 bp, Artificial Sequence
  chemically synthesized
gagggcacatccagtgggcc

SEQ ID NO: 56825 - DNA, 20 bp, Artificial Sequence
  chemically synthesized
catccagtgggccaggccat

SEQ ID NO: 56826 - DNA, 20 bp, Artificial Sequence
  chemically synthesized
atccagtgggccaggccatt

SEQ ID NO: 56827 - DNA, 20 bp, Artificial Sequence
  chemically synthesized
cagtgggccaggccattggg

SEQ ID NO: 56828 - DNA, 20 bp, Artificial Sequence
  chemically synthesized
agtgggccaggccattggga

SEQ ID NO: 56829 - DNA, 20 bp, Artificial Sequence
  chemically synthesized
aggccattgggaaggacccc

SEQ ID NO: 56830 - DNA, 20 bp, Artificial Sequence
  chemically synthesized
ccattgggaaggacccccag

SEQ ID NO: 56831 - DNA, 20 bp, Artificial Sequence
  chemically synthesized
gggaaggacccccagaagct

SEQ ID NO: 56832 - DNA, 20 bp, Artificial Sequence
  chemically synthesized
ggaaggacccccagaagctc

SEQ ID NO: 56833 - DNA, 20 bp, Artificial Sequence
  chemically synthesized
gcttctgccccctcctttct

SEQ ID NO: 56834 - DNA, 20 bp, Artificial Sequence
  chemically synthesized
cttctgccccctcctttctc

SEQ ID NO: 56835 - DNA, 20 bp, Artificial Sequence
  chemically synthesized
ccccctcctttctcaggaca

SEQ ID NO: 56836 - DNA, 20 bp, Artificial Sequence
  chemically synthesized
tttctcaggacacagcgctg

SEQ ID NO: 56837 - DNA, 20 bp, Artificial Sequence
  chemically synthesized
ttctcaggacacagcgctgc

SEQ ID NO: 56838 - DNA, 20 bp, Artificial Sequence
  chemically synthesized
tctcaggacacagcgctgca

SEQ ID NO: 56839 - DNA, 20 bp, Artificial Sequence
  chemically synthesized
caggacacagcgctgcaggg

SEQ ID NO: 56840 - DNA, 20 bp, Artificial Sequence
  chemically synthesized
tgcagggcggtgactctcac

SEQ ID NO: 56841 - DNA, 20 bp, Artificial Sequence
  chemically synthesized
tctcacgagccctttgccca

SEQ ID NO: 56842 - DNA, 20 bp, Artificial Sequence
  chemically synthesized
catggatgcccgtgcctctc

SEQ ID NO: 56843 - DNA, 20 bp, Artificial Sequence
  chemically synthesized
gtgcctctctggactccatc

SEQ ID NO: 56844 - DNA, 20 bp, Artificial Sequence
  chemically synthesized
tgcctctctggactccatcc

SEQ ID NO: 56845 - DNA, 20 bp, Artificial Sequence
  chemically synthesized
actccatccaggttctgtaa

SEQ ID NO: 56846 - DNA, 20 bp, Artificial Sequence
  chemically synthesized
ctccatccaggttctgtaat

SEQ ID NO: 56847 - DNA, 20 bp, Artificial Sequence
  chemically synthesized
catccaggttctgtaatagg

SEQ ID NO: 56848 - DNA, 20 bp, Artificial Sequence
  chemically synthesized
tccaatactactgtgctatt

SEQ ID NO: 56849 - DNA, 20 bp, Artificial Sequence
  chemically synthesized
ccaatactactgtgctattc

SEQ ID NO: 56850 - DNA, 20 bp, Artificial Sequence
  chemically synthesized
tactactgtgctattcagga

SEQ ID NO: 56851 - DNA, 20 bp, Artificial Sequence
  chemically synthesized
tgctattcaggaaagtattg

SEQ ID NO: 56852 - DNA, 20 bp, Artificial Sequence
  chemically synthesized
tattcaggaaagtattgcag

SEQ ID NO: 56853 - DNA, 20 bp, Artificial Sequence
  chemically synthesized
gaattaatttgtgccaattg

SEQ ID NO: 56854 - DNA, 20 bp, Artificial Sequence
  chemically synthesized
attaatttgtgccaattgaa

SEQ ID NO: 56855 - DNA, 20 bp, Artificial Sequence
  chemically synthesized
ccaattgaagagcatgacaa

SEQ ID NO: 56856 - DNA, 20 bp, Artificial Sequence
  chemically synthesized
aagagcatgacaaaagtaca

SEQ ID NO: 56857 - DNA, 20 bp, Artificial Sequence
  chemically synthesized
agagcatgacaaaagtacaa

SEQ ID NO: 56858 - DNA, 20 bp, Artificial Sequence
  chemically synthesized
atgacaaaagtacaaaggaa

SEQ ID NO: 56859 - DNA, 20 bp, Artificial Sequence
  chemically synthesized
ggctctcctcatgtcccctc

SEQ ID NO: 56860 - DNA, 20 bp, Artificial Sequence
  chemically synthesized
gctctcctcatgtcccctca

SEQ ID NO: 56861 - DNA, 20 bp, Artificial Sequence
  chemically synthesized
tcctcatgtcccctcaaggt

SEQ ID NO: 56862 - DNA, 20 bp, Artificial Sequence
  chemically synthesized
aaggtcagtttcatccataa

SEQ ID NO: 56863 - DNA, 20 bp, Artificial Sequence
  chemically synthesized
aggtcagtttcatccataac

SEQ ID NO: 56864 - DNA, 20 bp, Artificial Sequence
  chemically synthesized
ttcatccataacaggtaaac

SEQ ID NO: 56865 - DNA, 20 bp, Artificial Sequence
  chemically synthesized
tcatccataacaggtaaacg

SEQ ID NO: 56866 - DNA, 20 bp, Artificial Sequence
  chemically synthesized
acaggtaaacgaggtccact

SEQ ID NO: 56867 - DNA, 20 bp, Artificial Sequence
  chemically synthesized
gtccactcagcttctgtctg

SEQ ID NO: 56868 - DNA, 20 bp, Artificial Sequence
  chemically synthesized
tccactcagcttctgtctgc

SEQ ID NO: 56869 - DNA, 20 bp, Artificial Sequence
  chemically synthesized
ccactcagcttctgtctgca

SEQ ID NO: 56870 - DNA, 20 bp, Artificial Sequence
  chemically synthesized
cactcagcttctgtctgcag

SEQ ID NO: 56871 - DNA, 20 bp, Artificial Sequence
  chemically synthesized
cagcttctgtctgcaggggc

SEQ ID NO: 56872 - DNA, 20 bp, Artificial Sequence
  chemically synthesized
agcttctgtctgcaggggct

SEQ ID NO: 56873 - DNA, 20 bp, Artificial Sequence
  chemically synthesized
caggggctgggacgcttacc

SEQ ID NO: 56874 - DNA, 20 bp, Artificial Sequence
  chemically synthesized
gctgggacgcttacctggtc

SEQ ID NO: 56875 - DNA, 20 bp, Artificial Sequence
  chemically synthesized
gcttacctggtccagtctca

SEQ ID NO: 56876 - DNA, 20 bp, Artificial Sequence
  chemically synthesized
cttacctggtccagtctcac

SEQ ID NO: 56877 - DNA, 20 bp, Artificial Sequence
  chemically synthesized
tggtccagtctcacaggtta

SEQ ID NO: 56878 - DNA, 20 bp, Artificial Sequence
  chemically synthesized
ggtccagtctcacaggttac

SEQ ID NO: 56879 - DNA, 20 bp, Artificial Sequence
  chemically synthesized
gtccagtctcacaggttaca

SEQ ID NO: 56880 - DNA, 20 bp, Artificial Sequence
  chemically synthesized
gttacagggaactgctttat

SEQ ID NO: 56881 - DNA, 20 bp, Artificial Sequence
  chemically synthesized
ttacagggaactgctttatc

SEQ ID NO: 56882 - DNA, 20 bp, Artificial Sequence
  chemically synthesized
tacagggaactgctttatca

SEQ ID NO: 56883 - DNA, 20 bp, Artificial Sequence
  chemically synthesized
acagggaactgctttatcag

SEQ ID NO: 56884 - DNA, 20 bp, Artificial Sequence
  chemically synthesized
gaactgctttatcaggggca

SEQ ID NO: 56885 - DNA, 20 bp, Artificial Sequence
  chemically synthesized
ctgctttatcaggggcacgg

SEQ ID NO: 56886 - DNA, 20 bp, Artificial Sequence
  chemically synthesized
ggggcacggaagtgttgctg

SEQ ID NO: 56887 - DNA, 20 bp, Artificial Sequence
  chemically synthesized
gcacggaagtgttgctgtag

SEQ ID NO: 56888 - DNA, 20 bp, Artificial Sequence
  chemically synthesized
ggaagtgttgctgtagtagt

SEQ ID NO: 56889 - DNA, 20 bp, Artificial Sequence
  chemically synthesized
agtcagtatccaaaacccac

SEQ ID NO: 56890 - DNA, 20 bp, Artificial Sequence
  chemically synthesized
gtatccaaaacccaccagta

SEQ ID NO: 56891 - DNA, 20 bp, Artificial Sequence
  chemically synthesized
accagtatggacgctgtcca

SEQ ID NO: 56892 - DNA, 20 bp, Artificial Sequence
  chemically synthesized
cagtatggacgctgtccaaa

SEQ ID NO: 56893 - DNA, 20 bp, Artificial Sequence
  chemically synthesized
gctgtccaaagagaatccta

SEQ ID NO: 56894 - DNA, 20 bp, Artificial Sequence
  chemically synthesized
aagagaatcctatggaaaaa

SEQ ID NO: 56895 - DNA, 20 bp, Artificial Sequence
  chemically synthesized
atcctatggaaaaacagaac

SEQ ID NO: 56896 - DNA, 20 bp, Artificial Sequence
  chemically synthesized
ggaaaaacagaacaagtttc

SEQ ID NO: 56897 - DNA, 20 bp, Artificial Sequence
  chemically synthesized
gaaaaacagaacaagtttct

SEQ ID NO: 56898 - DNA, 20 bp, Artificial Sequence
  chemically synthesized
aaaaacagaacaagtttctg

SEQ ID NO: 56899 - DNA, 20 bp, Artificial Sequence
  chemically synthesized
tgaatgaatgcttttgccca

SEQ ID NO: 56900 - DNA, 20 bp, Artificial Sequence
  chemically synthesized
tgcccaaagcctacaccttc

SEQ ID NO: 56901 - DNA, 20 bp, Artificial Sequence
  chemically synthesized
ccaaagcctacaccttcaag

SEQ ID NO: 56902 - DNA, 20 bp, Artificial Sequence
  chemically synthesized
aaagcctacaccttcaagaa

SEQ ID NO: 56903 - DNA, 20 bp, Artificial Sequence
  chemically synthesized
ctacaccttcaagaagagtg

SEQ ID NO: 56904 - DNA, 20 bp, Artificial Sequence
  chemically synthesized
cttcaagaagagtgtagcct

SEQ ID NO: 56905 - DNA, 20 bp, Artificial Sequence
  chemically synthesized
caagaagagtgtagcctgag

SEQ ID NO: 56906 - DNA, 20 bp, Artificial Sequence
  chemically synthesized
aagaagagtgtagcctgaga

SEQ ID NO: 56907 - DNA, 20 bp, Artificial Sequence
  chemically synthesized
aggatttcacatgttgcctc

SEQ ID NO: 56908 - DNA, 20 bp, Artificial Sequence
  chemically synthesized
atttcacatgttgcctctag

SEQ ID NO: 56909 - DNA, 20 bp, Artificial Sequence
  chemically synthesized
tttcacatgttgcctctaga

SEQ ID NO: 56910 - DNA, 20 bp, Artificial Sequence
  chemically synthesized
ttcacatgttgcctctagaa

SEQ ID NO: 56911 - DNA, 20 bp, Artificial Sequence
  chemically synthesized
cacatgttgcctctagaagg

SEQ ID NO: 56912 - DNA, 20 bp, Artificial Sequence
  chemically synthesized
ttgcctctagaagggagaac

SEQ ID NO: 56913 - DNA, 20 bp, Artificial Sequence
  chemically synthesized
tgcctctagaagggagaact

SEQ ID NO: 56914 - DNA, 20 bp, Artificial Sequence
  chemically synthesized
ctctagaagggagaactggg

SEQ ID NO: 56915 - DNA, 20 bp, Artificial Sequence
  chemically synthesized
agaagggagaactgggtggc

SEQ ID NO: 56916 - DNA, 20 bp, Artificial Sequence
  chemically synthesized
gaagggagaactgggtggct

SEQ ID NO: 56917 - DNA, 20 bp, Artificial Sequence
  chemically synthesized
aagggagaactgggtggctg

SEQ ID NO: 56918 - DNA, 20 bp, Artificial Sequence
  chemically synthesized
gggagaactgggtggctggg

SEQ ID NO: 56919 - DNA, 20 bp, Artificial Sequence
  chemically synthesized
agaactgggtggctggggag

SEQ ID NO: 56920 - DNA, 20 bp, Artificial Sequence
  chemically synthesized
gggtggctggggagaagtgt

SEQ ID NO: 56921 - DNA, 20 bp, Artificial Sequence
  chemically synthesized
gtggctggggagaagtgtga

SEQ ID NO: 56922 - DNA, 20 bp, Artificial Sequence
  chemically synthesized
tggctggggagaagtgtgag

SEQ ID NO: 56923 - DNA, 20 bp, Artificial Sequence
  chemically synthesized
ggctggggagaagtgtgaga

SEQ ID NO: 56924 - DNA, 20 bp, Artificial Sequence
  chemically synthesized
ctggggagaagtgtgagagg

SEQ ID NO: 56925 - DNA, 20 bp, Artificial Sequence
  chemically synthesized
gtattatctttttttttttt

SEQ ID NO: 56926 - DNA, 20 bp, Artificial Sequence
  chemically synthesized
tatcttttttttttttgaga

SEQ ID NO: 56927 - DNA, 20 bp, Artificial Sequence
  chemically synthesized
atcttttttttttttgagac

SEQ ID NO: 56928 - DNA, 20 bp, Artificial Sequence
  chemically synthesized
tttttttttgagacaggatc

SEQ ID NO: 56929 - DNA, 20 bp, Artificial Sequence
  chemically synthesized
ttttgagacaggatctggct

SEQ ID NO: 56930 - DNA, 20 bp, Artificial Sequence
  chemically synthesized
caggatctggctcagtaacc

SEQ ID NO: 56931 - DNA, 20 bp, Artificial Sequence
  chemically synthesized
tctggctcagtaacccagcc

SEQ ID NO: 56932 - DNA, 20 bp, Artificial Sequence
  chemically synthesized
tggctcagtaacccagcctg

SEQ ID NO: 56933 - DNA, 20 bp, Artificial Sequence
  chemically synthesized
cagtaacccagcctggagtg

SEQ ID NO: 56934 - DNA, 20 bp, Artificial Sequence
  chemically synthesized
taacccagcctggagtgcag

SEQ ID NO: 56935 - DNA, 20 bp, Artificial Sequence
  chemically synthesized
ggagtgcagtggcgcaatct

SEQ ID NO: 56936 - DNA, 20 bp, Artificial Sequence
  chemically synthesized
tcattgtgacctctacctcc

SEQ ID NO: 56937 - DNA, 20 bp, Artificial Sequence
  chemically synthesized
cattgtgacctctacctcct

SEQ ID NO: 56938 - DNA, 20 bp, Artificial Sequence
  chemically synthesized
ctcctgggatcctcccacct

SEQ ID NO: 56939 - DNA, 20 bp, Artificial Sequence
  chemically synthesized
tcccacctcagcctcctgaa

SEQ ID NO: 56940 - DNA, 20 bp, Artificial Sequence
  chemically synthesized
acctcagcctcctgaatagc

SEQ ID NO: 56941 - DNA, 20 bp, Artificial Sequence
  chemically synthesized
cctcagcctcctgaatagct

SEQ ID NO: 56942 - DNA, 20 bp, Artificial Sequence
  chemically synthesized
ctcctgaatagctgggacta

SEQ ID NO: 56943 - DNA, 20 bp, Artificial Sequence
  chemically synthesized
tcctgaatagctgggactac

SEQ ID NO: 56944 - DNA, 20 bp, Artificial Sequence
  chemically synthesized
caggtgtgtgccaccacatc

SEQ ID NO: 56945 - DNA, 20 bp, Artificial Sequence
  chemically synthesized
tgtgtgccaccacatccagc

SEQ ID NO: 56946 - DNA, 20 bp, Artificial Sequence
  chemically synthesized
ccagctagtttttgtatttt

SEQ ID NO: 56947 - DNA, 20 bp, Artificial Sequence
  chemically synthesized
gctagtttttgtatttttag

SEQ ID NO: 56948 - DNA, 20 bp, Artificial Sequence
  chemically synthesized
tagtttttgtatttttagta

SEQ ID NO: 56949 - DNA, 20 bp, Artificial Sequence
  chemically synthesized
ttttgtatttttagtagaga

SEQ ID NO: 56950 - DNA, 20 bp, Artificial Sequence
  chemically synthesized
tttgtatttttagtagagac

SEQ ID NO: 56951 - DNA, 20 bp, Artificial Sequence
  chemically synthesized
ttgtatttttagtagagacg

SEQ ID NO: 56952 - DNA, 20 bp, Artificial Sequence
  chemically synthesized
cggggtttcaccatgttgcc

SEQ ID NO: 56953 - DNA, 20 bp, Artificial Sequence
  chemically synthesized
ggggtttcaccatgttgccc

SEQ ID NO: 56954 - DNA, 20 bp, Artificial Sequence
  chemically synthesized
tttcaccatgttgcccaggc

SEQ ID NO: 56955 - DNA, 20 bp, Artificial Sequence
  chemically synthesized
tggtctccatctcctgaact

SEQ ID NO: 56956 - DNA, 20 bp, Artificial Sequence
  chemically synthesized
ggtctccatctcctgaactc

SEQ ID NO: 56957 - DNA, 20 bp, Artificial Sequence
  chemically synthesized
ctcaggcaatcctcccacct

SEQ ID NO: 56958 - DNA, 20 bp, Artificial Sequence
  chemically synthesized
cctcccacctcagcctccca

SEQ ID NO: 56959 - DNA, 20 bp, Artificial Sequence
  chemically synthesized
acctcagcctcccaaagtgc

SEQ ID NO: 56960 - DNA, 20 bp, Artificial Sequence
  chemically synthesized
cctcagcctcccaaagtgct

SEQ ID NO: 56961 - DNA, 20 bp, Artificial Sequence
  chemically synthesized
ctcccaaagtgctgggatta

SEQ ID NO: 56962 - DNA, 20 bp, Artificial Sequence
  chemically synthesized
tcccaaagtgctgggattac

SEQ ID NO: 56963 - DNA, 20 bp, Artificial Sequence
  chemically synthesized
agtgctgggattacaggcat

SEQ ID NO: 56964 - DNA, 20 bp, Artificial Sequence
  chemically synthesized
ctatttaaacacaaataatg

SEQ ID NO: 56965 - DNA, 20 bp, Artificial Sequence
  chemically synthesized
aaacacaaataatgaagccc

SEQ ID NO: 56966 - DNA, 20 bp, Artificial Sequence
  chemically synthesized
aagcccaagattctgaactc

SEQ ID NO: 56967 - DNA, 20 bp, Artificial Sequence
  chemically synthesized
agcccaagattctgaactcc

SEQ ID NO: 56968 - DNA, 20 bp, Artificial Sequence
  chemically synthesized
ccaagattctgaactccagg

SEQ ID NO: 56969 - DNA, 20 bp, Artificial Sequence
  chemically synthesized
caagattctgaactccaggc

SEQ ID NO: 56970 - DNA, 20 bp, Artificial Sequence
  chemically synthesized
ttctgaactccaggcaggcg

SEQ ID NO: 56971 - DNA, 20 bp, Artificial Sequence
  chemically synthesized
tgaactccaggcaggcgcgg

SEQ ID NO: 56972 - DNA, 20 bp, Artificial Sequence
  chemically synthesized
gtggctcacacctgtaatct

SEQ ID NO: 56973 - DNA, 20 bp, Artificial Sequence
  chemically synthesized
cacctgtaatctcagcactt

SEQ ID NO: 56974 - DNA, 20 bp, Artificial Sequence
  chemically synthesized
acctgtaatctcagcacttt

SEQ ID NO: 56975 - DNA, 20 bp, Artificial Sequence
  chemically synthesized
ctgtaatctcagcactttgg

SEQ ID NO: 56976 - DNA, 20 bp, Artificial Sequence
  chemically synthesized
tgtaatctcagcactttggg

SEQ ID NO: 56977 - DNA, 20 bp, Artificial Sequence
  chemically synthesized
tctcagcactttgggaggcc

SEQ ID NO: 56978 - DNA, 20 bp, Artificial Sequence
  chemically synthesized
ctcagcactttgggaggcca

SEQ ID NO: 56979 - DNA, 20 bp, Artificial Sequence
  chemically synthesized
agcactttgggaggccaagg

SEQ ID NO: 56980 - DNA, 20 bp, Artificial Sequence
  chemically synthesized
gcactttgggaggccaaggc

SEQ ID NO: 56981 - DNA, 20 bp, Artificial Sequence
  chemically synthesized
ctttgggaggccaaggcagg

SEQ ID NO: 56982 - DNA, 20 bp, Artificial Sequence
  chemically synthesized
ccaaggcaggcagatcacat

SEQ ID NO: 56983 - DNA, 20 bp, Artificial Sequence
  chemically synthesized
caaggcaggcagatcacatg

SEQ ID NO: 56984 - DNA, 20 bp, Artificial Sequence
  chemically synthesized
gcaggcagatcacatgaggt

SEQ ID NO: 56985 - DNA, 20 bp, Artificial Sequence
  chemically synthesized
caggcagatcacatgaggtc

SEQ ID NO: 56986 - DNA, 20 bp, Artificial Sequence
  chemically synthesized
ggcagatcacatgaggtcag

SEQ ID NO: 56987 - DNA, 20 bp, Artificial Sequence
  chemically synthesized
tcacatgaggtcaggagttt

SEQ ID NO: 56988 - DNA, 20 bp, Artificial Sequence
  chemically synthesized
tgaggtcaggagtttgagac

SEQ ID NO: 56989 - DNA, 20 bp, Artificial Sequence
  chemically synthesized
tcaggagtttgagaccagcc

SEQ ID NO: 56990 - DNA, 20 bp, Artificial Sequence
  chemically synthesized
tgagaccagcctggccaaca

SEQ ID NO: 56991 - DNA, 20 bp, Artificial Sequence
  chemically synthesized
cgtttctaccaaaaaatata

SEQ ID NO: 56992 - DNA, 20 bp, Artificial Sequence
  chemically synthesized
taccaaaaaatataaagaat

SEQ ID NO: 56993 - DNA, 20 bp, Artificial Sequence
  chemically synthesized
aaaaaatataaagaattagc

SEQ ID NO: 56994 - DNA, 20 bp, Artificial Sequence
  chemically synthesized
tataaagaattagccagatg

SEQ ID NO: 56995 - DNA, 20 bp, Artificial Sequence
  chemically synthesized
aaagaattagccagatgtgg

SEQ ID NO: 56996 - DNA, 20 bp, Artificial Sequence
  chemically synthesized
gtggtgcgtgactgtaatcc

SEQ ID NO: 56997 - DNA, 20 bp, Artificial Sequence
  chemically synthesized
tgactgtaatcccagctact

SEQ ID NO: 56998 - DNA, 20 bp, Artificial Sequence
  chemically synthesized
gactgtaatcccagctactc

SEQ ID NO: 56999 - DNA, 20 bp, Artificial Sequence
  chemically synthesized
ctgtaatcccagctactcgg

SEQ ID NO: 57000 - DNA, 20 bp, Artificial Sequence
  chemically synthesized
tgtaatcccagctactcggg

SEQ ID NO: 57001 - DNA, 20 bp, Artificial Sequence
  chemically synthesized
tcccagctactcgggaggct

SEQ ID NO: 57002 - DNA, 20 bp, Artificial Sequence
  chemically synthesized
cccagctactcgggaggcta

SEQ ID NO: 57003 - DNA, 20 bp, Artificial Sequence
  chemically synthesized
gctactcgggaggctaaggc

SEQ ID NO: 57004 - DNA, 20 bp, Artificial Sequence
  chemically synthesized
tactcgggaggctaaggcaa

SEQ ID NO: 57005 - DNA, 20 bp, Artificial Sequence
  chemically synthesized
gcaagagaatcgcttgaacc

SEQ ID NO: 57006 - DNA, 20 bp, Artificial Sequence
  chemically synthesized
caagagaatcgcttgaacct

SEQ ID NO: 57007 - DNA, 20 bp, Artificial Sequence
  chemically synthesized
agagaatcgcttgaacctgg

SEQ ID NO: 57008 - DNA, 20 bp, Artificial Sequence
  chemically synthesized
gagaatcgcttgaacctggg

SEQ ID NO: 57009 - DNA, 20 bp, Artificial Sequence
  chemically synthesized
aatcgcttgaacctgggagg

SEQ ID NO: 57010 - DNA, 20 bp, Artificial Sequence
  chemically synthesized
tcgcttgaacctgggaggcg

SEQ ID NO: 57011 - DNA, 20 bp, Artificial Sequence
  chemically synthesized
cgcttgaacctgggaggcgg

SEQ ID NO: 57012 - DNA, 20 bp, Artificial Sequence
  chemically synthesized
tgggaggcggaggttgccgt

SEQ ID NO: 57013 - DNA, 20 bp, Artificial Sequence
  chemically synthesized
ggcggaggttgccgtgagcc

SEQ ID NO: 57014 - DNA, 20 bp, Artificial Sequence
  chemically synthesized
gagattatgccactgcacta

SEQ ID NO: 57015 - DNA, 20 bp, Artificial Sequence
  chemically synthesized
agattatgccactgcactac

SEQ ID NO: 57016 - DNA, 20 bp, Artificial Sequence
  chemically synthesized
tatgccactgcactacaggc

SEQ ID NO: 57017 - DNA, 20 bp, Artificial Sequence
  chemically synthesized
atgccactgcactacaggct

SEQ ID NO: 57018 - DNA, 20 bp, Artificial Sequence
  chemically synthesized
ctgcactacaggctgggtga

SEQ ID NO: 57019 - DNA, 20 bp, Artificial Sequence
  chemically synthesized
gcactacaggctgggtgaca

SEQ ID NO: 57020 - DNA, 20 bp, Artificial Sequence
  chemically synthesized
tacaggctgggtgacagagc

SEQ ID NO: 57021 - DNA, 20 bp, Artificial Sequence
  chemically synthesized
aaatcctgaaatccataaaa

SEQ ID NO: 57022 - DNA, 20 bp, Artificial Sequence
  chemically synthesized
tcctgaaatccataaaatgg

SEQ ID NO: 57023 - DNA, 20 bp, Artificial Sequence
  chemically synthesized
gactttttttttttaacctc

SEQ ID NO: 57024 - DNA, 20 bp, Artificial Sequence
  chemically synthesized
tttttttttttaacctcaag

SEQ ID NO: 57025 - DNA, 20 bp, Artificial Sequence
  chemically synthesized
acctcaagaagtatttgtcc

SEQ ID NO: 57026 - DNA, 20 bp, Artificial Sequence
  chemically synthesized
tcaagaagtatttgtcctgg

SEQ ID NO: 57027 - DNA, 20 bp, Artificial Sequence
  chemically synthesized
ttgtcctggaagaatgcata

SEQ ID NO: 57028 - DNA, 20 bp, Artificial Sequence
  chemically synthesized
gaagaatgcatatggaacta

SEQ ID NO: 57029 - DNA, 20 bp, Artificial Sequence
  chemically synthesized
tggaactacagtttgaaact

SEQ ID NO: 57030 - DNA, 20 bp, Artificial Sequence
  chemically synthesized
acttggacttgcatatacca

SEQ ID NO: 57031 - DNA, 20 bp, Artificial Sequence
  chemically synthesized
cttggacttgcatataccat

SEQ ID NO: 57032 - DNA, 20 bp, Artificial Sequence
  chemically synthesized
gcatataccatgggttccct

SEQ ID NO: 57033 - DNA, 20 bp, Artificial Sequence
  chemically synthesized
catataccatgggttccctc

SEQ ID NO: 57034 - DNA, 20 bp, Artificial Sequence
  chemically synthesized
ccatgggttccctcaggcct

SEQ ID NO: 57035 - DNA, 20 bp, Artificial Sequence
  chemically synthesized
catgggttccctcaggcctc

SEQ ID NO: 57036 - DNA, 20 bp, Artificial Sequence
  chemically synthesized
atgggttccctcaggcctca

SEQ ID NO: 57037 - DNA, 20 bp, Artificial Sequence
  chemically synthesized
tcttgcatttcctctgacat

SEQ ID NO: 57038 - DNA, 20 bp, Artificial Sequence
  chemically synthesized
ttgcatttcctctgacatca

SEQ ID NO: 57039 - DNA, 20 bp, Artificial Sequence
  chemically synthesized
tgacatcagagaatgcactc

SEQ ID NO: 57040 - DNA, 20 bp, Artificial Sequence
  chemically synthesized
agagaatgcactccagcccc

SEQ ID NO: 57041 - DNA, 20 bp, Artificial Sequence
  chemically synthesized
gagaatgcactccagcccct

SEQ ID NO: 57042 - DNA, 20 bp, Artificial Sequence
  chemically synthesized
tgcactccagcccctaggac

SEQ ID NO: 57043 - DNA, 20 bp, Artificial Sequence
  chemically synthesized
cccctaggacgagccccccc

SEQ ID NO: 57044 - DNA, 20 bp, Artificial Sequence
  chemically synthesized
ccctaggacgagcccccccc

SEQ ID NO: 57045 - DNA, 20 bp, Artificial Sequence
  chemically synthesized
cctaggacgagcccccccca

SEQ ID NO: 57046 - DNA, 20 bp, Artificial Sequence
  chemically synthesized
gagccccccccagggaaaca

SEQ ID NO: 57047 - DNA, 20 bp, Artificial Sequence
  chemically synthesized
aacatggcctgcatttccat

SEQ ID NO: 57048 - DNA, 20 bp, Artificial Sequence
  chemically synthesized
ccatcagaattgctctctgt

SEQ ID NO: 57049 - DNA, 20 bp, Artificial Sequence
  chemically synthesized
catcagaattgctctctgta

SEQ ID NO: 57050 - DNA, 20 bp, Artificial Sequence
  chemically synthesized
gctctctgtaaggatgtata

SEQ ID NO: 57051 - DNA, 20 bp, Artificial Sequence
  chemically synthesized
tgtaaggatgtatatagctt

SEQ ID NO: 57052 - DNA, 20 bp, Artificial Sequence
  chemically synthesized
gtatcctctctactttgaaa

SEQ ID NO: 57053 - DNA, 20 bp, Artificial Sequence
  chemically synthesized
atcctctctactttgaaaca

SEQ ID NO: 57054 - DNA, 20 bp, Artificial Sequence
  chemically synthesized
tactttgaaacagagtatct

SEQ ID NO: 57055 - DNA, 20 bp, Artificial Sequence
  chemically synthesized
acaaaccacttcccctttaa

SEQ ID NO: 57056 - DNA, 20 bp, Artificial Sequence
  chemically synthesized
cacttcccctttaaaagtac

SEQ ID NO: 57057 - DNA, 20 bp, Artificial Sequence
  chemically synthesized
actagatatatctttcactg

SEQ ID NO: 57058 - DNA, 20 bp, Artificial Sequence
  chemically synthesized
tatatctttcactgtggaaa

SEQ ID NO: 57059 - DNA, 20 bp, Artificial Sequence
  chemically synthesized
atatctttcactgtggaaat

SEQ ID NO: 57060 - DNA, 20 bp, Artificial Sequence
  chemically synthesized
tggaaataggtgtcaaccgc

SEQ ID NO: 57061 - DNA, 20 bp, Artificial Sequence
  chemically synthesized
aataggtgtcaaccgccagt

SEQ ID NO: 57062 - DNA, 20 bp, Artificial Sequence
  chemically synthesized
ataggtgtcaaccgccagtc

SEQ ID NO: 57063 - DNA, 20 bp, Artificial Sequence
  chemically synthesized
ggatgccttttatcccgtga

SEQ ID NO: 57064 - DNA, 20 bp, Artificial Sequence
  chemically synthesized
tgccttttatcccgtgatgg

SEQ ID NO: 57065 - DNA, 20 bp, Artificial Sequence
  chemically synthesized
tttatcccgtgatggtggaa

SEQ ID NO: 57066 - DNA, 20 bp, Artificial Sequence
  chemically synthesized
tagtgatttctcaccgaaat

SEQ ID NO: 57067 - DNA, 20 bp, Artificial Sequence
  chemically synthesized
agtgatttctcaccgaaatc

SEQ ID NO: 57068 - DNA, 20 bp, Artificial Sequence
  chemically synthesized
gtgatttctcaccgaaatca

SEQ ID NO: 57069 - DNA, 20 bp, Artificial Sequence
  chemically synthesized
gatttctcaccgaaatcagg

SEQ ID NO: 57070 - DNA, 20 bp, Artificial Sequence
  chemically synthesized
tttctcaccgaaatcaggga

SEQ ID NO: 57071 - DNA, 20 bp, Artificial Sequence
  chemically synthesized
tcagggagagccactaactc

SEQ ID NO: 57072 - DNA, 20 bp, Artificial Sequence
  chemically synthesized
aactctggcctctatcaacc

SEQ ID NO: 57073 - DNA, 20 bp, Artificial Sequence
  chemically synthesized
ctctggcctctatcaaccca

SEQ ID NO: 57074 - DNA, 20 bp, Artificial Sequence
  chemically synthesized
ctggcctctatcaacccaga

SEQ ID NO: 57075 - DNA, 20 bp, Artificial Sequence
  chemically synthesized
atcaacccagagagattgca

SEQ ID NO: 57076 - DNA, 20 bp, Artificial Sequence
  chemically synthesized
gagattgcatggttcttcaa

SEQ ID NO: 57077 - DNA, 20 bp, Artificial Sequence
  chemically synthesized
gattgcatggttcttcaatg

SEQ ID NO: 57078 - DNA, 20 bp, Artificial Sequence
  chemically synthesized
catggttcttcaatggagat

SEQ ID NO: 57079 - DNA, 20 bp, Artificial Sequence
  chemically synthesized
ttcaatggagatcagatgtt

SEQ ID NO: 57080 - DNA, 20 bp, Artificial Sequence
  chemically synthesized
cacttcatctttttattttt

SEQ ID NO: 57081 - DNA, 20 bp, Artificial Sequence
  chemically synthesized
ttttattttttagaatcatg

SEQ ID NO: 57082 - DNA, 20 bp, Artificial Sequence
  chemically synthesized
attttttagaatcatgcggc

SEQ ID NO: 57083 - DNA, 20 bp, Artificial Sequence
  chemically synthesized
ttttttagaatcatgcggct

SEQ ID NO: 57084 - DNA, 20 bp, Artificial Sequence
  chemically synthesized
tagaatcatgcggctgggtg

SEQ ID NO: 57085 - DNA, 20 bp, Artificial Sequence
  chemically synthesized
aatcatgcggctgggtgtag

SEQ ID NO: 57086 - DNA, 20 bp, Artificial Sequence
  chemically synthesized
gtggctcacgcctgtaatcc

SEQ ID NO: 57087 - DNA, 20 bp, Artificial Sequence
  chemically synthesized
acgcctgtaatcctagcact

SEQ ID NO: 57088 - DNA, 20 bp, Artificial Sequence
  chemically synthesized
cgcctgtaatcctagcactt

SEQ ID NO: 57089 - DNA, 20 bp, Artificial Sequence
  chemically synthesized
gcctgtaatcctagcactta

SEQ ID NO: 57090 - DNA, 20 bp, Artificial Sequence
  chemically synthesized
ctgtaatcctagcacttagg

SEQ ID NO: 57091 - DNA, 20 bp, Artificial Sequence
  chemically synthesized
tgtaatcctagcacttaggg

SEQ ID NO: 57092 - DNA, 20 bp, Artificial Sequence
  chemically synthesized
tcctagcacttagggaggcc

SEQ ID NO: 57093 - DNA, 20 bp, Artificial Sequence
  chemically synthesized
cctagcacttagggaggcca

SEQ ID NO: 57094 - DNA, 20 bp, Artificial Sequence
  chemically synthesized
agcacttagggaggccaagg

SEQ ID NO: 57095 - DNA, 20 bp, Artificial Sequence
  chemically synthesized
gcacttagggaggccaaggc

SEQ ID NO: 57096 - DNA, 20 bp, Artificial Sequence
  chemically synthesized
cttagggaggccaaggcagg

SEQ ID NO: 57097 - DNA, 20 bp, Artificial Sequence
  chemically synthesized
ggccaaggcaggcagatcat

SEQ ID NO: 57098 - DNA, 20 bp, Artificial Sequence
  chemically synthesized
gccaaggcaggcagatcatg

SEQ ID NO: 57099 - DNA, 20 bp, Artificial Sequence
  chemically synthesized
aggcaggcagatcatgaggt

SEQ ID NO: 57100 - DNA, 20 bp, Artificial Sequence
  chemically synthesized
ggcaggcagatcatgaggtc

SEQ ID NO: 57101 - DNA, 20 bp, Artificial Sequence
  chemically synthesized
caggcagatcatgaggtcag

SEQ ID NO: 57102 - DNA, 20 bp, Artificial Sequence
  chemically synthesized
gatcatgaggtcaggagttc

SEQ ID NO: 57103 - DNA, 20 bp, Artificial Sequence
  chemically synthesized
tgaggtcaggagttcgagac

SEQ ID NO: 57104 - DNA, 20 bp, Artificial Sequence
  chemically synthesized
tcaggagttcgagaccagcc

SEQ ID NO: 57105 - DNA, 20 bp, Artificial Sequence
  chemically synthesized
cgagaccagcctagtcaaca

SEQ ID NO: 57106 - DNA, 20 bp, Artificial Sequence
  chemically synthesized
actaaaaatacaaaaaaaat

SEQ ID NO: 57107 - DNA, 20 bp, Artificial Sequence
  chemically synthesized
aaaatacaaaaaaaattagc

SEQ ID NO: 57108 - DNA, 20 bp, Artificial Sequence
  chemically synthesized
aaatacaaaaaaaattagct

SEQ ID NO: 57109 - DNA, 20 bp, Artificial Sequence
  chemically synthesized
caaaaaaaattagctgggca

SEQ ID NO: 57110 - DNA, 20 bp, Artificial Sequence
  chemically synthesized
aaaaaattagctgggcatgg

SEQ ID NO: 57111 - DNA, 20 bp, Artificial Sequence
  chemically synthesized
aaattagctgggcatggtgg

SEQ ID NO: 57112 - DNA, 20 bp, Artificial Sequence
  chemically synthesized
aattagctgggcatggtggc

SEQ ID NO: 57113 - DNA, 20 bp, Artificial Sequence
  chemically synthesized
gtggcgggcacctgtaatcc

SEQ ID NO: 57114 - DNA, 20 bp, Artificial Sequence
  chemically synthesized
cacctgtaatcccagctact

SEQ ID NO: 57115 - DNA, 20 bp, Artificial Sequence
  chemically synthesized
acctgtaatcccagctactt

SEQ ID NO: 57116 - DNA, 20 bp, Artificial Sequence
  chemically synthesized
ctgtaatcccagctacttgg

SEQ ID NO: 57117 - DNA, 20 bp, Artificial Sequence
  chemically synthesized
tgtaatcccagctacttggg

SEQ ID NO: 57118 - DNA, 20 bp, Artificial Sequence
  chemically synthesized
tcccagctacttgggaggct

SEQ ID NO: 57119 - DNA, 20 bp, Artificial Sequence
  chemically synthesized
cccagctacttgggaggctg

SEQ ID NO: 57120 - DNA, 20 bp, Artificial Sequence
  chemically synthesized
agctacttgggaggctgagg

SEQ ID NO: 57121 - DNA, 20 bp, Artificial Sequence
  chemically synthesized
gctacttgggaggctgaggc

SEQ ID NO: 57122 - DNA, 20 bp, Artificial Sequence
  chemically synthesized
tacttgggaggctgaggcag

SEQ ID NO: 57123 - DNA, 20 bp, Artificial Sequence
  chemically synthesized
ggcaggagaatcacttgaac

SEQ ID NO: 57124 - DNA, 20 bp, Artificial Sequence
  chemically synthesized
caggagaatcacttgaaccg

SEQ ID NO: 57125 - DNA, 20 bp, Artificial Sequence
  chemically synthesized
ggagaatcacttgaaccgga

SEQ ID NO: 57126 - DNA, 20 bp, Artificial Sequence
  chemically synthesized
gagaatcacttgaaccggag

SEQ ID NO: 57127 - DNA, 20 bp, Artificial Sequence
  chemically synthesized
aatcacttgaaccggagagg

SEQ ID NO: 57128 - DNA, 20 bp, Artificial Sequence
  chemically synthesized
tcacttgaaccggagaggca

SEQ ID NO: 57129 - DNA, 20 bp, Artificial Sequence
  chemically synthesized
cacttgaaccggagaggcag

SEQ ID NO: 57130 - DNA, 20 bp, Artificial Sequence
  chemically synthesized
aaccggagaggcagaggttg

SEQ ID NO: 57131 - DNA, 20 bp, Artificial Sequence
  chemically synthesized
ggagaggcagaggttgcagt

SEQ ID NO: 57132 - DNA, 20 bp, Artificial Sequence
  chemically synthesized
ggcagaggttgcagtgagct

SEQ ID NO: 57133 - DNA, 20 bp, Artificial Sequence
  chemically synthesized
gagattgcaccattgcactc

SEQ ID NO: 57134 - DNA, 20 bp, Artificial Sequence
  chemically synthesized
ttgcaccattgcactccagc

SEQ ID NO: 57135 - DNA, 20 bp, Artificial Sequence
  chemically synthesized
tgcaccattgcactccagcc

SEQ ID NO: 57136 - DNA, 20 bp, Artificial Sequence
  chemically synthesized
attgcactccagccaggcaa

SEQ ID NO: 57137 - DNA, 20 bp, Artificial Sequence
  chemically synthesized
ctccagccaggcaacagtgc

SEQ ID NO: 57138 - DNA, 20 bp, Artificial Sequence
  chemically synthesized
catctcaaacaaacaaacaa

SEQ ID NO: 57139 - DNA, 20 bp, Artificial Sequence
  chemically synthesized
tcaaacaaacaaacaaaaga

SEQ ID NO: 57140 - DNA, 20 bp, Artificial Sequence
  chemically synthesized
acaaacaaacaaaagaaaga

SEQ ID NO: 57141 - DNA, 20 bp, Artificial Sequence
  chemically synthesized
acaaacaaaagaaagaaaga

SEQ ID NO: 57142 - DNA, 20 bp, Artificial Sequence
  chemically synthesized
acaaaagaaagaaagaaaga

SEQ ID NO: 57143 - DNA, 20 bp, Artificial Sequence
  chemically synthesized
aaagaaagaaagaaagaaag

SEQ ID NO: 57144 - DNA, 20 bp, Artificial Sequence
  chemically synthesized
aaagaaagaaagaaagtggc

SEQ ID NO: 57145 - DNA, 20 bp, Artificial Sequence
  chemically synthesized
aagaaagaaagtggccagaa

SEQ ID NO: 57146 - DNA, 20 bp, Artificial Sequence
  chemically synthesized
agaaagaaagtggccagaat

SEQ ID NO: 57147 - DNA, 20 bp, Artificial Sequence
  chemically synthesized
gaatgggaatgtttacgtga

SEQ ID NO: 57148 - DNA, 20 bp, Artificial Sequence
  chemically synthesized
aatgtttacgtgatagaaat

SEQ ID NO: 57149 - DNA, 20 bp, Artificial Sequence
  chemically synthesized
aaattggcaaatgctaaact

SEQ ID NO: 57150 - DNA, 20 bp, Artificial Sequence
  chemically synthesized
aattggcaaatgctaaactc

SEQ ID NO: 57151 - DNA, 20 bp, Artificial Sequence
  chemically synthesized
attggcaaatgctaaactca

SEQ ID NO: 57152 - DNA, 20 bp, Artificial Sequence
  chemically synthesized
cagggctttcccctgctccc

SEQ ID NO: 57153 - DNA, 20 bp, Artificial Sequence
  chemically synthesized
gggctttcccctgctcccca

SEQ ID NO: 57154 - DNA, 20 bp, Artificial Sequence
  chemically synthesized
gctttcccctgctccccaga

SEQ ID NO: 57155 - DNA, 20 bp, Artificial Sequence
  chemically synthesized
tcccctgctccccagagagt

SEQ ID NO: 57156 - DNA, 20 bp, Artificial Sequence
  chemically synthesized
tccccagagagtcagtttat

SEQ ID NO: 57157 - DNA, 20 bp, Artificial Sequence
  chemically synthesized
gagagtcagtttatcagcac

SEQ ID NO: 57158 - DNA, 20 bp, Artificial Sequence
  chemically synthesized
tatcagcactggacgtaaca

SEQ ID NO: 57159 - DNA, 20 bp, Artificial Sequence
  chemically synthesized
ctggacgtaacatagttcat

SEQ ID NO: 57160 - DNA, 20 bp, Artificial Sequence
  chemically synthesized
ggacgtaacatagttcataa

SEQ ID NO: 57161 - DNA, 20 bp, Artificial Sequence
  chemically synthesized
agttcataagagcattgccg

SEQ ID NO: 57162 - DNA, 20 bp, Artificial Sequence
  chemically synthesized
tcataagagcattgccgcgg

SEQ ID NO: 57163 - DNA, 20 bp, Artificial Sequence
  chemically synthesized
aagagcattgccgcggaagc

SEQ ID NO: 57164 - DNA, 20 bp, Artificial Sequence
  chemically synthesized
cggaagccagcctgcctacc

SEQ ID NO: 57165 - DNA, 20 bp, Artificial Sequence
  chemically synthesized
ggaagccagcctgcctacct

SEQ ID NO: 57166 - DNA, 20 bp, Artificial Sequence
  chemically synthesized
gcctacctgggcttccatcc

SEQ ID NO: 57167 - DNA, 20 bp, Artificial Sequence
  chemically synthesized
cctgggcttccatcctggct

SEQ ID NO: 57168 - DNA, 20 bp, Artificial Sequence
  chemically synthesized
tcggcatgtactaaccttgt

SEQ ID NO: 57169 - DNA, 20 bp, Artificial Sequence
  chemically synthesized
gttggcctaatcatttaact

SEQ ID NO: 57170 - DNA, 20 bp, Artificial Sequence
  chemically synthesized
aatcatttaactcagcacct

SEQ ID NO: 57171 - DNA, 20 bp, Artificial Sequence
  chemically synthesized
gcatctactgtttctgtaaa

SEQ ID NO: 57172 - DNA, 20 bp, Artificial Sequence
  chemically synthesized
tctactgtttctgtaaatag

SEQ ID NO: 57173 - DNA, 20 bp, Artificial Sequence
  chemically synthesized
aaatagcagtaactacctca

SEQ ID NO: 57174 - DNA, 20 bp, Artificial Sequence
  chemically synthesized
gcagtaactacctcacagaa

SEQ ID NO: 57175 - DNA, 20 bp, Artificial Sequence
  chemically synthesized
ctacctcacagaaaagcaca

SEQ ID NO: 57176 - DNA, 20 bp, Artificial Sequence
  chemically synthesized
acagaaaagcacatagcaca

SEQ ID NO: 57177 - DNA, 20 bp, Artificial Sequence
  chemically synthesized
aaagcacatagcacatggac

SEQ ID NO: 57178 - DNA, 20 bp, Artificial Sequence
  chemically synthesized
tgttaaccctgattattatt

SEQ ID NO: 57179 - DNA, 20 bp, Artificial Sequence
  chemically synthesized
cctgattattattaagctgc

SEQ ID NO: 57180 - DNA, 20 bp, Artificial Sequence
  chemically synthesized
tgattattattaagctgcca

SEQ ID NO: 57181 - DNA, 20 bp, Artificial Sequence
  chemically synthesized
tgccagagataacctatttg

SEQ ID NO: 57182 - DNA, 20 bp, Artificial Sequence
  chemically synthesized
cctatttgtagattataaaa

SEQ ID NO: 57183 - DNA, 20 bp, Artificial Sequence
  chemically synthesized
tagattataaaacagaaact

SEQ ID NO: 57184 - DNA, 20 bp, Artificial Sequence
  chemically synthesized
gataattgatatgacttgcc

SEQ ID NO: 57185 - DNA, 20 bp, Artificial Sequence
  chemically synthesized
ataattgatatgacttgcca

SEQ ID NO: 57186 - DNA, 20 bp, Artificial Sequence
  chemically synthesized
tatgacttgccaaggacatg

SEQ ID NO: 57187 - DNA, 20 bp, Artificial Sequence
  chemically synthesized
acttgccaaggacatgtagt

SEQ ID NO: 57188 - DNA, 20 bp, Artificial Sequence
  chemically synthesized
tgccaaggacatgtagttgg

SEQ ID NO: 57189 - DNA, 20 bp, Artificial Sequence
  chemically synthesized
gccaaggacatgtagttggt

SEQ ID NO: 57190 - DNA, 20 bp, Artificial Sequence
  chemically synthesized
aaggacatgtagttggtggg

SEQ ID NO: 57191 - DNA, 20 bp, Artificial Sequence
  chemically synthesized
gacatgtagttggtgggtgg

SEQ ID NO: 57192 - DNA, 20 bp, Artificial Sequence
  chemically synthesized
tagttggtgggtggcagaac

SEQ ID NO: 57193 - DNA, 20 bp, Artificial Sequence
  chemically synthesized
agttggtgggtggcagaacg

SEQ ID NO: 57194 - DNA, 20 bp, Artificial Sequence
  chemically synthesized
gttggtgggtggcagaacga

SEQ ID NO: 57195 - DNA, 20 bp, Artificial Sequence
  chemically synthesized
gtgggtggcagaacgagggc

SEQ ID NO: 57196 - DNA, 20 bp, Artificial Sequence
  chemically synthesized
gggtggcagaacgagggctg

SEQ ID NO: 57197 - DNA, 20 bp, Artificial Sequence
  chemically synthesized
gcagaacgagggctggagcc

SEQ ID NO: 57198 - DNA, 20 bp, Artificial Sequence
  chemically synthesized
gagggctggagcccagttcc

SEQ ID NO: 57199 - DNA, 20 bp, Artificial Sequence
  chemically synthesized
agggctggagcccagttccc

SEQ ID NO: 57200 - DNA, 20 bp, Artificial Sequence
  chemically synthesized
gggctggagcccagttccca

SEQ ID NO: 57201 - DNA, 20 bp, Artificial Sequence
  chemically synthesized
cttttcattaccccacaaaa

SEQ ID NO: 57202 - DNA, 20 bp, Artificial Sequence
  chemically synthesized
ttttcattaccccacaaaac

SEQ ID NO: 57203 - DNA, 20 bp, Artificial Sequence
  chemically synthesized
gtgtgtttccttttttcata

SEQ ID NO: 57204 - DNA, 20 bp, Artificial Sequence
  chemically synthesized
tctatctttttttttttttt

SEQ ID NO: 57205 - DNA, 20 bp, Artificial Sequence
  chemically synthesized
tcttttttttttttttgaga

SEQ ID NO: 57206 - DNA, 20 bp, Artificial Sequence
  chemically synthesized
cttttttttttttttgagac

SEQ ID NO: 57207 - DNA, 20 bp, Artificial Sequence
  chemically synthesized
ttttttttttttttgagaca

SEQ ID NO: 57208 - DNA, 20 bp, Artificial Sequence
  chemically synthesized
cagggtcttactctgttgcc

SEQ ID NO: 57209 - DNA, 20 bp, Artificial Sequence
  chemically synthesized
agggtcttactctgttgccc

SEQ ID NO: 57210 - DNA, 20 bp, Artificial Sequence
  chemically synthesized
tcttactctgttgcccaggc

SEQ ID NO: 57211 - DNA, 20 bp, Artificial Sequence
  chemically synthesized
ttactctgttgcccaggctg

SEQ ID NO: 57212 - DNA, 20 bp, Artificial Sequence
  chemically synthesized
ctgttgcccaggctggagtg

SEQ ID NO: 57213 - DNA, 20 bp, Artificial Sequence
  chemically synthesized
ttgcccaggctggagtgcag

SEQ ID NO: 57214 - DNA, 20 bp, Artificial Sequence
  chemically synthesized
acctcctccgcctctcacct

SEQ ID NO: 57215 - DNA, 20 bp, Artificial Sequence
  chemically synthesized
gcctctcacctcagcctcct

SEQ ID NO: 57216 - DNA, 20 bp, Artificial Sequence
  chemically synthesized
tctcacctcagcctcctgag

SEQ ID NO: 57217 - DNA, 20 bp, Artificial Sequence
  chemically synthesized
acctcagcctcctgagtagc

SEQ ID NO: 57218 - DNA, 20 bp, Artificial Sequence
  chemically synthesized
cctcagcctcctgagtagct

SEQ ID NO: 57219 - DNA, 20 bp, Artificial Sequence
  chemically synthesized
ctcctgagtagctgggacta

SEQ ID NO: 57220 - DNA, 20 bp, Artificial Sequence
  chemically synthesized
gactacagcaccaacacgcc

SEQ ID NO: 57221 - DNA, 20 bp, Artificial Sequence
  chemically synthesized
taattttcgtaatgtttttg

SEQ ID NO: 57222 - DNA, 20 bp, Artificial Sequence
  chemically synthesized
attttcgtaatgtttttgta

SEQ ID NO: 57223 - DNA, 20 bp, Artificial Sequence
  chemically synthesized
tcgtaatgtttttgtagaga

SEQ ID NO: 57224 - DNA, 20 bp, Artificial Sequence
  chemically synthesized
gtaatgtttttgtagagatg

SEQ ID NO: 57225 - DNA, 20 bp, Artificial Sequence
  chemically synthesized
tggagtttcgccatgttgcc

SEQ ID NO: 57226 - DNA, 20 bp, Artificial Sequence
  chemically synthesized
ggagtttcgccatgttgccc

SEQ ID NO: 57227 - DNA, 20 bp, Artificial Sequence
  chemically synthesized
tttcgccatgttgcccaggc

SEQ ID NO: 57228 - DNA, 20 bp, Artificial Sequence
  chemically synthesized
caggctggtcttgaactcct

SEQ ID NO: 57229 - DNA, 20 bp, Artificial Sequence
  chemically synthesized
cttgaactcctgagttcacc

SEQ ID NO: 57230 - DNA, 20 bp, Artificial Sequence
  chemically synthesized
ttgaactcctgagttcaccc

SEQ ID NO: 57231 - DNA, 20 bp, Artificial Sequence
  chemically synthesized
gaactcctgagttcacccag

SEQ ID NO: 57232 - DNA, 20 bp, Artificial Sequence
  chemically synthesized
caggagtgattcgcccacct

SEQ ID NO: 57233 - DNA, 20 bp, Artificial Sequence
  chemically synthesized
tcgcccacctcggcctccca

SEQ ID NO: 57234 - DNA, 20 bp, Artificial Sequence
  chemically synthesized
acctcggcctcccaaagtgc

SEQ ID NO: 57235 - DNA, 20 bp, Artificial Sequence
  chemically synthesized
cctcggcctcccaaagtgct

SEQ ID NO: 57236 - DNA, 20 bp, Artificial Sequence
  chemically synthesized
ctcccaaagtgctgggatta

SEQ ID NO: 57237 - DNA, 20 bp, Artificial Sequence
  chemically synthesized
tcccaaagtgctgggattac

SEQ ID NO: 57238 - DNA, 20 bp, Artificial Sequence
  chemically synthesized
agtgctgggattacaggtgt

SEQ ID NO: 57239 - DNA, 20 bp, Artificial Sequence
  chemically synthesized
caggtgtgagccaccatgcc

SEQ ID NO: 57240 - DNA, 20 bp, Artificial Sequence
  chemically synthesized
ctaataaaactctttgctca

SEQ ID NO: 57241 - DNA, 20 bp, Artificial Sequence
  chemically synthesized
tgctcaaagcctatataact

SEQ ID NO: 57242 - DNA, 20 bp, Artificial Sequence
  chemically synthesized
accctttaacccatatgaaa

SEQ ID NO: 57243 - DNA, 20 bp, Artificial Sequence
  chemically synthesized
ccctttaacccatatgaaat

SEQ ID NO: 57244 - DNA, 20 bp, Artificial Sequence
  chemically synthesized
ttcctgtattttcaactcac

SEQ ID NO: 57245 - DNA, 20 bp, Artificial Sequence
  chemically synthesized
ctgtattttcaactcactgg

SEQ ID NO: 57246 - DNA, 20 bp, Artificial Sequence
  chemically synthesized
tgtattttcaactcactggt

SEQ ID NO: 57247 - DNA, 20 bp, Artificial Sequence
  chemically synthesized
ttctgtcttccccctttatg

SEQ ID NO: 57248 - DNA, 20 bp, Artificial Sequence
  chemically synthesized
ccctttatgtagatgatcca

SEQ ID NO: 57249 - DNA, 20 bp, Artificial Sequence
  chemically synthesized
ttatgtagatgatccaaagt

SEQ ID NO: 57250 - DNA, 20 bp, Artificial Sequence
  chemically synthesized
atgtagatgatccaaagtca

SEQ ID NO: 57251 - DNA, 20 bp, Artificial Sequence
  chemically synthesized
gtagatgatccaaagtcaga

SEQ ID NO: 57252 - DNA, 20 bp, Artificial Sequence
  chemically synthesized
agatgatccaaagtcagaga

SEQ ID NO: 57253 - DNA, 20 bp, Artificial Sequence
  chemically synthesized
gatgatccaaagtcagagag

SEQ ID NO: 57254 - DNA, 20 bp, Artificial Sequence
  chemically synthesized
atgatccaaagtcagagaga

SEQ ID NO: 57255 - DNA, 20 bp, Artificial Sequence
  chemically synthesized
tgatccaaagtcagagagag

SEQ ID NO: 57256 - DNA, 20 bp, Artificial Sequence
  chemically synthesized
ccaaagtcagagagaggggt

SEQ ID NO: 57257 - DNA, 20 bp, Artificial Sequence
  chemically synthesized
aagtcagagagaggggttgg

SEQ ID NO: 57258 - DNA, 20 bp, Artificial Sequence
  chemically synthesized
gagagaggggttggaagcat

SEQ ID NO: 57259 - DNA, 20 bp, Artificial Sequence
  chemically synthesized
agaggggttggaagcatgag

SEQ ID NO: 57260 - DNA, 20 bp, Artificial Sequence
  chemically synthesized
ttggaagcatgagtagcccg

SEQ ID NO: 57261 - DNA, 20 bp, Artificial Sequence
  chemically synthesized
gtagcccgtggcttcctgaa

SEQ ID NO: 57262 - DNA, 20 bp, Artificial Sequence
  chemically synthesized
ccgtggcttcctgaatagcc

SEQ ID NO: 57263 - DNA, 20 bp, Artificial Sequence
  chemically synthesized
cgtggcttcctgaatagcct

SEQ ID NO: 57264 - DNA, 20 bp, Artificial Sequence
  chemically synthesized
gtggcttcctgaatagcctg

SEQ ID NO: 57265 - DNA, 20 bp, Artificial Sequence
  chemically synthesized
cttcctgaatagcctgggga

SEQ ID NO: 57266 - DNA, 20 bp, Artificial Sequence
  chemically synthesized
ctggggaaagcaacttctga

SEQ ID NO: 57267 - DNA, 20 bp, Artificial Sequence
  chemically synthesized
ggaaagcaacttctgatgga

SEQ ID NO: 57268 - DNA, 20 bp, Artificial Sequence
  chemically synthesized
ttctgatggacagacattgc

SEQ ID NO: 57269 - DNA, 20 bp, Artificial Sequence
  chemically synthesized
ctgatggacagacattgcga

SEQ ID NO: 57270 - DNA, 20 bp, Artificial Sequence
  chemically synthesized
gacattgcgagagcgaatgc

SEQ ID NO: 57271 - DNA, 20 bp, Artificial Sequence
  chemically synthesized
ttgctgatctcctctctata

SEQ ID NO: 57272 - DNA, 20 bp, Artificial Sequence
  chemically synthesized
tatatggttcttaccactta

SEQ ID NO: 57273 - DNA, 20 bp, Artificial Sequence
  chemically synthesized
ggttcttaccacttaaagac

SEQ ID NO: 57274 - DNA, 20 bp, Artificial Sequence
  chemically synthesized
gttcttaccacttaaagacg

SEQ ID NO: 57275 - DNA, 20 bp, Artificial Sequence
  chemically synthesized
taccacttaaagacgaggtt

SEQ ID NO: 57276 - DNA, 20 bp, Artificial Sequence
  chemically synthesized
acttaaagacgaggttgagc

SEQ ID NO: 57277 - DNA, 20 bp, Artificial Sequence
  chemically synthesized
gttgagccagtctccaatca

SEQ ID NO: 57278 - DNA, 20 bp, Artificial Sequence
  chemically synthesized
tctccaatcacagctaccca

SEQ ID NO: 57279 - DNA, 20 bp, Artificial Sequence
  chemically synthesized
ctccaatcacagctacccaa

SEQ ID NO: 57280 - DNA, 20 bp, Artificial Sequence
  chemically synthesized
ccaatcacagctacccaaag

SEQ ID NO: 57281 - DNA, 20 bp, Artificial Sequence
  chemically synthesized
ccaaaggagtttaatgccca

SEQ ID NO: 57282 - DNA, 20 bp, Artificial Sequence
  chemically synthesized
ttaatgcccacagcttcctg

SEQ ID NO: 57283 - DNA, 20 bp, Artificial Sequence
  chemically synthesized
tgcccacagcttcctgaaga

SEQ ID NO: 57284 - DNA, 20 bp, Artificial Sequence
  chemically synthesized
cagcttcctgaagatggaac

SEQ ID NO: 57285 - DNA, 20 bp, Artificial Sequence
  chemically synthesized
ttcctgaagatggaaccaga

SEQ ID NO: 57286 - DNA, 20 bp, Artificial Sequence
  chemically synthesized
tcctgaagatggaaccagat

SEQ ID NO: 57287 - DNA, 20 bp, Artificial Sequence
  chemically synthesized
cctgaagatggaaccagatg

SEQ ID NO: 57288 - DNA, 20 bp, Artificial Sequence
  chemically synthesized
gaagatggaaccagatgggg

SEQ ID NO: 57289 - DNA, 20 bp, Artificial Sequence
  chemically synthesized
agatggaaccagatggggaa

SEQ ID NO: 57290 - DNA, 20 bp, Artificial Sequence
  chemically synthesized
gatggaaccagatggggaag

SEQ ID NO: 57291 - DNA, 20 bp, Artificial Sequence
  chemically synthesized
accagatggggaagaggacg

SEQ ID NO: 57292 - DNA, 20 bp, Artificial Sequence
  chemically synthesized
agatggggaagaggacgtag

SEQ ID NO: 57293 - DNA, 20 bp, Artificial Sequence
  chemically synthesized
gatggggaagaggacgtaga

SEQ ID NO: 57294 - DNA, 20 bp, Artificial Sequence
  chemically synthesized
aggacgtagaaggcattcct

SEQ ID NO: 57295 - DNA, 20 bp, Artificial Sequence
  chemically synthesized
ggacgtagaaggcattcctg

SEQ ID NO: 57296 - DNA, 20 bp, Artificial Sequence
  chemically synthesized
attcctgaggtctgcgatca

SEQ ID NO: 57297 - DNA, 20 bp, Artificial Sequence
  chemically synthesized
ggtctgcgatcacggacacc

SEQ ID NO: 57298 - DNA, 20 bp, Artificial Sequence
  chemically synthesized
tcacggacaccaagatgaac

SEQ ID NO: 57299 - DNA, 20 bp, Artificial Sequence
  chemically synthesized
acaccaagatgaaccagtcc

SEQ ID NO: 57300 - DNA, 20 bp, Artificial Sequence
  chemically synthesized
caccaagatgaaccagtcct

SEQ ID NO: 57301 - DNA, 20 bp, Artificial Sequence
  chemically synthesized
ccaagatgaaccagtcctgg

SEQ ID NO: 57302 - DNA, 20 bp, Artificial Sequence
  chemically synthesized
tgaaccagtcctgggagtct

SEQ ID NO: 57303 - DNA, 20 bp, Artificial Sequence
  chemically synthesized
gggagtcttggtaattcacc

SEQ ID NO: 57304 - DNA, 20 bp, Artificial Sequence
  chemically synthesized
gagtcttggtaattcacctg

SEQ ID NO: 57305 - DNA, 20 bp, Artificial Sequence
  chemically synthesized
agtcttggtaattcacctgg

SEQ ID NO: 57306 - DNA, 20 bp, Artificial Sequence
  chemically synthesized
cctggaggtaatgtgttgac

SEQ ID NO: 57307 - DNA, 20 bp, Artificial Sequence
  chemically synthesized
aatgtgttgactggatccca

SEQ ID NO: 57308 - DNA, 20 bp, Artificial Sequence
  chemically synthesized
ttgactggatcccaaagtca

SEQ ID NO: 57309 - DNA, 20 bp, Artificial Sequence
  chemically synthesized
gactggatcccaaagtcatg

SEQ ID NO: 57310 - DNA, 20 bp, Artificial Sequence
  chemically synthesized
ttcctccatcctcatttcct

SEQ ID NO: 57311 - DNA, 20 bp, Artificial Sequence
  chemically synthesized
tcctcatttccttggcacct

SEQ ID NO: 57312 - DNA, 20 bp, Artificial Sequence
  chemically synthesized
cctcatttccttggcacctc

SEQ ID NO: 57313 - DNA, 20 bp, Artificial Sequence
  chemically synthesized
catttccttggcacctcagg

SEQ ID NO: 57314 - DNA, 20 bp, Artificial Sequence
  chemically synthesized
ttggcacctcaggaagatgt

SEQ ID NO: 57315 - DNA, 20 bp, Artificial Sequence
  chemically synthesized
gcacctcaggaagatgtcag

SEQ ID NO: 57316 - DNA, 20 bp, Artificial Sequence
  chemically synthesized
acctcaggaagatgtcagca

SEQ ID NO: 57317 - DNA, 20 bp, Artificial Sequence
  chemically synthesized
agatgtcagcagagcccttg

SEQ ID NO: 57318 - DNA, 20 bp, Artificial Sequence
  chemically synthesized
cagagcccttgcagttattc

SEQ ID NO: 57319 - DNA, 20 bp, Artificial Sequence
  chemically synthesized
agagcccttgcagttattcc

SEQ ID NO: 57320 - DNA, 20 bp, Artificial Sequence
  chemically synthesized
ccttgcagttattccaggct

SEQ ID NO: 57321 - DNA, 20 bp, Artificial Sequence
  chemically synthesized
tgcagttattccaggcttgg

SEQ ID NO: 57322 - DNA, 20 bp, Artificial Sequence
  chemically synthesized
ggtggtgattgctctgctat

SEQ ID NO: 57323 - DNA, 20 bp, Artificial Sequence
  chemically synthesized
tgttttatatgccctgtatc

SEQ ID NO: 57324 - DNA, 20 bp, Artificial Sequence
  chemically synthesized
tatgccctgtatccagtatt

SEQ ID NO: 57325 - DNA, 20 bp, Artificial Sequence
  chemically synthesized
atgccctgtatccagtattc

SEQ ID NO: 57326 - DNA, 20 bp, Artificial Sequence
  chemically synthesized
atccagtattcaggtcaacc

SEQ ID NO: 57327 - DNA, 20 bp, Artificial Sequence
  chemically synthesized
gtcaacccagccctgatctt

SEQ ID NO: 57328 - DNA, 20 bp, Artificial Sequence
  chemically synthesized
tgtctaaaatgtattgatca

SEQ ID NO: 57329 - DNA, 20 bp, Artificial Sequence
  chemically synthesized
gtctaaaatgtattgatcaa

SEQ ID NO: 57330 - DNA, 20 bp, Artificial Sequence
  chemically synthesized
attgatcaaaggtgcatcac

SEQ ID NO: 57331 - DNA, 20 bp, Artificial Sequence
  chemically synthesized
gatcaaaggtgcatcaccag

SEQ ID NO: 57332 - DNA, 20 bp, Artificial Sequence
  chemically synthesized
atcaaaggtgcatcaccagt

SEQ ID NO: 57333 - DNA, 20 bp, Artificial Sequence
  chemically synthesized
taggttgatgcaaacatgtt

SEQ ID NO: 57334 - DNA, 20 bp, Artificial Sequence
  chemically synthesized
aggttgatgcaaacatgttc

SEQ ID NO: 57335 - DNA, 20 bp, Artificial Sequence
  chemically synthesized
ggttgatgcaaacatgttca

SEQ ID NO: 57336 - DNA, 20 bp, Artificial Sequence
  chemically synthesized
tcagggtgatttacgtaaaa

SEQ ID NO: 57337 - DNA, 20 bp, Artificial Sequence
  chemically synthesized
atttacgtaaaatagaaaaa

SEQ ID NO: 57338 - DNA, 20 bp, Artificial Sequence
  chemically synthesized
tttacgtaaaatagaaaaac

SEQ ID NO: 57339 - DNA, 20 bp, Artificial Sequence
  chemically synthesized
gaaaaacaggcacacaaaaa

SEQ ID NO: 57340 - DNA, 20 bp, Artificial Sequence
  chemically synthesized
gcacacaaaaacagcctgat

SEQ ID NO: 57341 - DNA, 20 bp, Artificial Sequence
  chemically synthesized
agcctgatcggccatgtact

SEQ ID NO: 57342 - DNA, 20 bp, Artificial Sequence
  chemically synthesized
ctgatcggccatgtactcag

SEQ ID NO: 57343 - DNA, 20 bp, Artificial Sequence
  chemically synthesized
tgatcggccatgtactcagc

SEQ ID NO: 57344 - DNA, 20 bp, Artificial Sequence
  chemically synthesized
gatcggccatgtactcagca

SEQ ID NO: 57345 - DNA, 20 bp, Artificial Sequence
  chemically synthesized
gcagggccaatgattaactt

SEQ ID NO: 57346 - DNA, 20 bp, Artificial Sequence
  chemically synthesized
attaactttggcatgcttct

SEQ ID NO: 57347 - DNA, 20 bp, Artificial Sequence
  chemically synthesized
aactttggcatgcttcttgg

SEQ ID NO: 57348 - DNA, 20 bp, Artificial Sequence
  chemically synthesized
ggcatgcttcttggcagtgc

SEQ ID NO: 57349 - DNA, 20 bp, Artificial Sequence
  chemically synthesized
gcatgcttcttggcagtgca

SEQ ID NO: 57350 - DNA, 20 bp, Artificial Sequence
  chemically synthesized
catgcttcttggcagtgcaa

SEQ ID NO: 57351 - DNA, 20 bp, Artificial Sequence
  chemically synthesized
agtgcaagggtctgccctcc

SEQ ID NO: 57352 - DNA, 20 bp, Artificial Sequence
  chemically synthesized
gccctcctggtccccgaaac

SEQ ID NO: 57353 - DNA, 20 bp, Artificial Sequence
  chemically synthesized
ccctcctggtccccgaaacc

SEQ ID NO: 57354 - DNA, 20 bp, Artificial Sequence
  chemically synthesized
cctggtccccgaaaccaggc

SEQ ID NO: 57355 - DNA, 20 bp, Artificial Sequence
  chemically synthesized
tggtccccgaaaccaggcca

SEQ ID NO: 57356 - DNA, 20 bp, Artificial Sequence
  chemically synthesized
ccgaaaccaggccagagaca

SEQ ID NO: 57357 - DNA, 20 bp, Artificial Sequence
  chemically synthesized
cgaaaccaggccagagacac

SEQ ID NO: 57358 - DNA, 20 bp, Artificial Sequence
  chemically synthesized
accaggccagagacacagga

SEQ ID NO: 57359 - DNA, 20 bp, Artificial Sequence
  chemically synthesized
caggccagagacacaggaca

SEQ ID NO: 57360 - DNA, 20 bp, Artificial Sequence
  chemically synthesized
catccacgatgattcttgca

SEQ ID NO: 57361 - DNA, 20 bp, Artificial Sequence
  chemically synthesized
gatgattcttgcaaagatgt

SEQ ID NO: 57362 - DNA, 20 bp, Artificial Sequence
  chemically synthesized
tgcctgcaactgcacttatt

SEQ ID NO: 57363 - DNA, 20 bp, Artificial Sequence
  chemically synthesized
gcctgcaactgcacttattt

SEQ ID NO: 57364 - DNA, 20 bp, Artificial Sequence
  chemically synthesized
cctgcaactgcacttatttg

SEQ ID NO: 57365 - DNA, 20 bp, Artificial Sequence
  chemically synthesized
actgcacttatttggggaca

SEQ ID NO: 57366 - DNA, 20 bp, Artificial Sequence
  chemically synthesized
ttggggacaaagaaaaatct

SEQ ID NO: 57367 - DNA, 20 bp, Artificial Sequence
  chemically synthesized
aaagaaaaatcttggtgctc

SEQ ID NO: 57368 - DNA, 20 bp, Artificial Sequence
  chemically synthesized
tcttggtgctctagctattc

SEQ ID NO: 57369 - DNA, 20 bp, Artificial Sequence
  chemically synthesized
gctctagctattcaagtttt

SEQ ID NO: 57370 - DNA, 20 bp, Artificial Sequence
  chemically synthesized
taagttcttaattttaaaat

SEQ ID NO: 57371 - DNA, 20 bp, Artificial Sequence
  chemically synthesized
tcttaattttaaaattagta

SEQ ID NO: 57372 - DNA, 20 bp, Artificial Sequence
  chemically synthesized
ttttaaaattagtaaagttc

SEQ ID NO: 57373 - DNA, 20 bp, Artificial Sequence
  chemically synthesized
aaaattagtaaagttctggc

SEQ ID NO: 57374 - DNA, 20 bp, Artificial Sequence
  chemically synthesized
agtaaagttctggctggttg

SEQ ID NO: 57375 - DNA, 20 bp, Artificial Sequence
  chemically synthesized
aaagttctggctggttgtgg

SEQ ID NO: 57376 - DNA, 20 bp, Artificial Sequence
  chemically synthesized
gtggctcacacctgtaatcc

SEQ ID NO: 57377 - DNA, 20 bp, Artificial Sequence
  chemically synthesized
cacctgtaatcccagcaatt

SEQ ID NO: 57378 - DNA, 20 bp, Artificial Sequence
  chemically synthesized
acctgtaatcccagcaattt

SEQ ID NO: 57379 - DNA, 20 bp, Artificial Sequence
  chemically synthesized
ctgtaatcccagcaatttgg

SEQ ID NO: 57380 - DNA, 20 bp, Artificial Sequence
  chemically synthesized
tgtaatcccagcaatttggg

SEQ ID NO: 57381 - DNA, 20 bp, Artificial Sequence
  chemically synthesized
tcccagcaatttgggaggct

SEQ ID NO: 57382 - DNA, 20 bp, Artificial Sequence
  chemically synthesized
cccagcaatttgggaggctg

SEQ ID NO: 57383 - DNA, 20 bp, Artificial Sequence
  chemically synthesized
agcaatttgggaggctgagg

SEQ ID NO: 57384 - DNA, 20 bp, Artificial Sequence
  chemically synthesized
gcaatttgggaggctgaggt

SEQ ID NO: 57385 - DNA, 20 bp, Artificial Sequence
  chemically synthesized
aatttgggaggctgaggtgg

SEQ ID NO: 57386 - DNA, 20 bp, Artificial Sequence
  chemically synthesized
atttgggaggctgaggtggg

SEQ ID NO: 57387 - DNA, 20 bp, Artificial Sequence
  chemically synthesized
tgaggtgggaggatcccttg

SEQ ID NO: 57388 - DNA, 20 bp, Artificial Sequence
  chemically synthesized
gtgggaggatcccttgaagc

SEQ ID NO: 57389 - DNA, 20 bp, Artificial Sequence
  chemically synthesized
tgggaggatcccttgaagcc

SEQ ID NO: 57390 - DNA, 20 bp, Artificial Sequence
  chemically synthesized
ggaggatcccttgaagccag

SEQ ID NO: 57391 - DNA, 20 bp, Artificial Sequence
  chemically synthesized
gatcccttgaagccaggagt

SEQ ID NO: 57392 - DNA, 20 bp, Artificial Sequence
  chemically synthesized
tcccttgaagccaggagttg

SEQ ID NO: 57393 - DNA, 20 bp, Artificial Sequence
  chemically synthesized
tgaagccaggagttggagac

SEQ ID NO: 57394 - DNA, 20 bp, Artificial Sequence
  chemically synthesized
ccaggagttggagaccagcc

SEQ ID NO: 57395 - DNA, 20 bp, Artificial Sequence
  chemically synthesized
caggagttggagaccagcct

SEQ ID NO: 57396 - DNA, 20 bp, Artificial Sequence
  chemically synthesized
ggagaccagcctgggcaaca

SEQ ID NO: 57397 - DNA, 20 bp, Artificial Sequence
  chemically synthesized
accagcctgggcaacaaagc

SEQ ID NO: 57398 - DNA, 20 bp, Artificial Sequence
  chemically synthesized
aaaaatttaaaaaattgttt

SEQ ID NO: 57399 - DNA, 20 bp, Artificial Sequence
  chemically synthesized
aattgttttggtgtgtgtga

SEQ ID NO: 57400 - DNA, 20 bp, Artificial Sequence
  chemically synthesized
tgtgtgatggtgtacccttg

SEQ ID NO: 57401 - DNA, 20 bp, Artificial Sequence
  chemically synthesized
atggtgtacccttgtagtcc

SEQ ID NO: 57402 - DNA, 20 bp, Artificial Sequence
  chemically synthesized
cccttgtagtcccagctatt

SEQ ID NO: 57403 - DNA, 20 bp, Artificial Sequence
  chemically synthesized
ccttgtagtcccagctattc

SEQ ID NO: 57404 - DNA, 20 bp, Artificial Sequence
  chemically synthesized
ttgtagtcccagctattcag

SEQ ID NO: 57405 - DNA, 20 bp, Artificial Sequence
  chemically synthesized
tgtagtcccagctattcagg

SEQ ID NO: 57406 - DNA, 20 bp, Artificial Sequence
  chemically synthesized
tcccagctattcaggaggct

SEQ ID NO: 57407 - DNA, 20 bp, Artificial Sequence
  chemically synthesized
cccagctattcaggaggctg

SEQ ID NO: 57408 - DNA, 20 bp, Artificial Sequence
  chemically synthesized
agctattcaggaggctgagg

SEQ ID NO: 57409 - DNA, 20 bp, Artificial Sequence
  chemically synthesized
gctattcaggaggctgaggc

SEQ ID NO: 57410 - DNA, 20 bp, Artificial Sequence
  chemically synthesized
tattcaggaggctgaggcag

SEQ ID NO: 57411 - DNA, 20 bp, Artificial Sequence
  chemically synthesized
attcaggaggctgaggcagg

SEQ ID NO: 57412 - DNA, 20 bp, Artificial Sequence
  chemically synthesized
ctgaggcaggaggattgctt

SEQ ID NO: 57413 - DNA, 20 bp, Artificial Sequence
  chemically synthesized
gcaggaggattgcttgagcc

SEQ ID NO: 57414 - DNA, 20 bp, Artificial Sequence
  chemically synthesized
caggaggattgcttgagccc

SEQ ID NO: 57415 - DNA, 20 bp, Artificial Sequence
  chemically synthesized
ggaggattgcttgagcccag

SEQ ID NO: 57416 - DNA, 20 bp, Artificial Sequence
  chemically synthesized
gattgcttgagcccaggagt

SEQ ID NO: 57417 - DNA, 20 bp, Artificial Sequence
  chemically synthesized
ttgcttgagcccaggagttg

SEQ ID NO: 57418 - DNA, 20 bp, Artificial Sequence
  chemically synthesized
agcccaggagttggagtctg

SEQ ID NO: 57419 - DNA, 20 bp, Artificial Sequence
  chemically synthesized
caggagttggagtctgcagt

SEQ ID NO: 57420 - DNA, 20 bp, Artificial Sequence
  chemically synthesized
attgtcccaccgctgcacta

SEQ ID NO: 57421 - DNA, 20 bp, Artificial Sequence
  chemically synthesized
cccaccgctgcactacagcc

SEQ ID NO: 57422 - DNA, 20 bp, Artificial Sequence
  chemically synthesized
ccaccgctgcactacagcct

SEQ ID NO: 57423 - DNA, 20 bp, Artificial Sequence
  chemically synthesized
gcactacagcctgggcaatc

SEQ ID NO: 57424 - DNA, 20 bp, Artificial Sequence
  chemically synthesized
tacagcctgggcaatcgagc

SEQ ID NO: 57425 - DNA, 20 bp, Artificial Sequence
  chemically synthesized
tgggcaatcgagcaagaccc

SEQ ID NO: 57426 - DNA, 20 bp, Artificial Sequence
  chemically synthesized
aacaaaacaaaacaaaacaa

SEQ ID NO: 57427 - DNA, 20 bp, Artificial Sequence
  chemically synthesized
gaaaaacaacaaataaaata

SEQ ID NO: 57428 - DNA, 20 bp, Artificial Sequence
  chemically synthesized
tatagtaacttctattgtat

SEQ ID NO: 57429 - DNA, 20 bp, Artificial Sequence
  chemically synthesized
atagtaacttctattgtatt

SEQ ID NO: 57430 - DNA, 20 bp, Artificial Sequence
  chemically synthesized
tagtaacttctattgtattg

SEQ ID NO: 57431 - DNA, 20 bp, Artificial Sequence
  chemically synthesized
attggggactatcatcttgc

SEQ ID NO: 57432 - DNA, 20 bp, Artificial Sequence
  chemically synthesized
tggtctttccttaactgtat

SEQ ID NO: 57433 - DNA, 20 bp, Artificial Sequence
  chemically synthesized
gtctttccttaactgtatta

SEQ ID NO: 57434 - DNA, 20 bp, Artificial Sequence
  chemically synthesized
tccttaactgtattagagtc

SEQ ID NO: 57435 - DNA, 20 bp, Artificial Sequence
  chemically synthesized
ccttaactgtattagagtct

SEQ ID NO: 57436 - DNA, 20 bp, Artificial Sequence
  chemically synthesized
cttaactgtattagagtcta

SEQ ID NO: 57437 - DNA, 20 bp, Artificial Sequence
  chemically synthesized
tagagtctagggtctgcctc

SEQ ID NO: 57438 - DNA, 20 bp, Artificial Sequence
  chemically synthesized
tctagggtctgcctctggtt

SEQ ID NO: 57439 - DNA, 20 bp, Artificial Sequence
  chemically synthesized
ctagggtctgcctctggttt

SEQ ID NO: 57440 - DNA, 20 bp, Artificial Sequence
  chemically synthesized
agggtctgcctctggtttgg

SEQ ID NO: 57441 - DNA, 20 bp, Artificial Sequence
  chemically synthesized
tgggagatcaacccccttcc

SEQ ID NO: 57442 - DNA, 20 bp, Artificial Sequence
  chemically synthesized
atcaacccccttcctggtat

SEQ ID NO: 57443 - DNA, 20 bp, Artificial Sequence
  chemically synthesized
ggtattggcctcatgtctct

SEQ ID NO: 57444 - DNA, 20 bp, Artificial Sequence
  chemically synthesized
gtattggcctcatgtctctt

SEQ ID NO: 57445 - DNA, 20 bp, Artificial Sequence
  chemically synthesized
tattggcctcatgtctctta

SEQ ID NO: 57446 - DNA, 20 bp, Artificial Sequence
  chemically synthesized
ggcctcatgtctcttagggc

SEQ ID NO: 57447 - DNA, 20 bp, Artificial Sequence
  chemically synthesized
tcatgtctcttagggccaga

SEQ ID NO: 57448 - DNA, 20 bp, Artificial Sequence
  chemically synthesized
aaagtaatcgtttttgaatg

SEQ ID NO: 57449 - DNA, 20 bp, Artificial Sequence
  chemically synthesized
taattcatttaatgacctta

SEQ ID NO: 57450 - DNA, 20 bp, Artificial Sequence
  chemically synthesized
atttaatgaccttaaagtta

SEQ ID NO: 57451 - DNA, 20 bp, Artificial Sequence
  chemically synthesized
gaccttaaagttacagccct

SEQ ID NO: 57452 - DNA, 20 bp, Artificial Sequence
  chemically synthesized
tctctctcttttttttgaaa

SEQ ID NO: 57453 - DNA, 20 bp, Artificial Sequence
  chemically synthesized
ctctctcttttttttgaaac

SEQ ID NO: 57454 - DNA, 20 bp, Artificial Sequence
  chemically synthesized
tctctcttttttttgaaaca

SEQ ID NO: 57455 - DNA, 20 bp, Artificial Sequence
  chemically synthesized
cagggtctcactctgtctcc

SEQ ID NO: 57456 - DNA, 20 bp, Artificial Sequence
  chemically synthesized
agggtctcactctgtctccc

SEQ ID NO: 57457 - DNA, 20 bp, Artificial Sequence
  chemically synthesized
tctcactctgtctcccaggc

SEQ ID NO: 57458 - DNA, 20 bp, Artificial Sequence
  chemically synthesized
tcactctgtctcccaggctg

SEQ ID NO: 57459 - DNA, 20 bp, Artificial Sequence
  chemically synthesized
ctgtctcccaggctggagtg

SEQ ID NO: 57460 - DNA, 20 bp, Artificial Sequence
  chemically synthesized
tctcccaggctggagtgcag

SEQ ID NO: 57461 - DNA, 20 bp, Artificial Sequence
  chemically synthesized
ggagtgcagtggcataatca

SEQ ID NO: 57462 - DNA, 20 bp, Artificial Sequence
  chemically synthesized
ggcataatcacggctcactg

SEQ ID NO: 57463 - DNA, 20 bp, Artificial Sequence
  chemically synthesized
tcactgcagcctcaacctcc

SEQ ID NO: 57464 - DNA, 20 bp, Artificial Sequence
  chemically synthesized
cactgcagcctcaacctcct

SEQ ID NO: 57465 - DNA, 20 bp, Artificial Sequence
  chemically synthesized
ctaatgtgatcctcccacct

SEQ ID NO: 57466 - DNA, 20 bp, Artificial Sequence
  chemically synthesized
tcctcccacctcagcctcct

SEQ ID NO: 57467 - DNA, 20 bp, Artificial Sequence
  chemically synthesized
tcccacctcagcctcctgag

SEQ ID NO: 57468 - DNA, 20 bp, Artificial Sequence
  chemically synthesized
acctcagcctcctgagtagc

SEQ ID NO: 57469 - DNA, 20 bp, Artificial Sequence
  chemically synthesized
cctcagcctcctgagtagct

SEQ ID NO: 57470 - DNA, 20 bp, Artificial Sequence
  chemically synthesized
ctcctgagtagctgggacca

SEQ ID NO: 57471 - DNA, 20 bp, Artificial Sequence
  chemically synthesized
tcctgagtagctgggaccac

SEQ ID NO: 57472 - DNA, 20 bp, Artificial Sequence
  chemically synthesized
caggcacacgccaccatgcc

SEQ ID NO: 57473 - DNA, 20 bp, Artificial Sequence
  chemically synthesized
gctaatttttctatcttttg

SEQ ID NO: 57474 - DNA, 20 bp, Artificial Sequence
  chemically synthesized
taatttttctatcttttgta

SEQ ID NO: 57475 - DNA, 20 bp, Artificial Sequence
  chemically synthesized
ttttctatcttttgtagaga

SEQ ID NO: 57476 - DNA, 20 bp, Artificial Sequence
  chemically synthesized
tttctatcttttgtagagat

SEQ ID NO: 57477 - DNA, 20 bp, Artificial Sequence
  chemically synthesized
ttctatcttttgtagagatg

SEQ ID NO: 57478 - DNA, 20 bp, Artificial Sequence
  chemically synthesized
tggggtttttccatgttgcc

SEQ ID NO: 57479 - DNA, 20 bp, Artificial Sequence
  chemically synthesized
ggggtttttccatgttgccc

SEQ ID NO: 57480 - DNA, 20 bp, Artificial Sequence
  chemically synthesized
tttttccatgttgcccaggc

SEQ ID NO: 57481 - DNA, 20 bp, Artificial Sequence
  chemically synthesized
caggctggtcttgaattcct

SEQ ID NO: 57482 - DNA, 20 bp, Artificial Sequence
  chemically synthesized
ggtcttgaattcctgagctc

SEQ ID NO: 57483 - DNA, 20 bp, Artificial Sequence
  chemically synthesized
tcttgaattcctgagctcaa

SEQ ID NO: 57484 - DNA, 20 bp, Artificial Sequence
  chemically synthesized
cctgagctcaagagatctgc

SEQ ID NO: 57485 - DNA, 20 bp, Artificial Sequence
  chemically synthesized
ctcaagagatctgccagtct

SEQ ID NO: 57486 - DNA, 20 bp, Artificial Sequence
  chemically synthesized
ctgccagtcttggcttccca

SEQ ID NO: 57487 - DNA, 20 bp, Artificial Sequence
  chemically synthesized
gtcttggcttcccaaagctc

SEQ ID NO: 57488 - DNA, 20 bp, Artificial Sequence
  chemically synthesized
tcttggcttcccaaagctct

SEQ ID NO: 57489 - DNA, 20 bp, Artificial Sequence
  chemically synthesized
ttcccaaagctctgggatta

SEQ ID NO: 57490 - DNA, 20 bp, Artificial Sequence
  chemically synthesized
tcccaaagctctgggattac

SEQ ID NO: 57491 - DNA, 20 bp, Artificial Sequence
  chemically synthesized
caggtgtgaaccaccatgcc

SEQ ID NO: 57492 - DNA, 20 bp, Artificial Sequence
  chemically synthesized
gtgaaccaccatgcctggcc

SEQ ID NO: 57493 - DNA, 20 bp, Artificial Sequence
  chemically synthesized
gtgttttaactcatacgttt

SEQ ID NO: 57494 - DNA, 20 bp, Artificial Sequence
  chemically synthesized
taagcaaaataatgaatgta

SEQ ID NO: 57495 - DNA, 20 bp, Artificial Sequence
  chemically synthesized
gcaacaatatgatgaatgta

SEQ ID NO: 57496 - DNA, 20 bp, Artificial Sequence
  chemically synthesized
atgaatgtatggttccaaat

SEQ ID NO: 57497 - DNA, 20 bp, Artificial Sequence
  chemically synthesized
atggttccaaataagaatac

SEQ ID NO: 57498 - DNA, 20 bp, Artificial Sequence
  chemically synthesized
aaataagaataccagcaaaa

SEQ ID NO: 57499 - DNA, 20 bp, Artificial Sequence
  chemically synthesized
aataccagcaaaatggtaac

SEQ ID NO: 57500 - DNA, 20 bp, Artificial Sequence
  chemically synthesized
taccagcaaaatggtaactg

SEQ ID NO: 57501 - DNA, 20 bp, Artificial Sequence
  chemically synthesized
aaatggtaactggagactta

SEQ ID NO: 57502 - DNA, 20 bp, Artificial Sequence
  chemically synthesized
atggtaactggagacttaaa

SEQ ID NO: 57503 - DNA, 20 bp, Artificial Sequence
  chemically synthesized
cttaaagagtttgaaacttt

SEQ ID NO: 57504 - DNA, 20 bp, Artificial Sequence
  chemically synthesized
actttcagttatttttgaaa

SEQ ID NO: 57505 - DNA, 20 bp, Artificial Sequence
  chemically synthesized
ctttcagttatttttgaaaa

SEQ ID NO: 57506 - DNA, 20 bp, Artificial Sequence
  chemically synthesized
tttcagttatttttgaaaaa

SEQ ID NO: 57507 - DNA, 20 bp, Artificial Sequence
  chemically synthesized
aaaaagggcttctatatctt

SEQ ID NO: 57508 - DNA, 20 bp, Artificial Sequence
  chemically synthesized
ctttcttatacatatgtgtg

SEQ ID NO: 57509 - DNA, 20 bp, Artificial Sequence
  chemically synthesized
atatgtgtgtagatatacaa

SEQ ID NO: 57510 - DNA, 20 bp, Artificial Sequence
  chemically synthesized
gtgtgtagatatacaaaaga

SEQ ID NO: 57511 - DNA, 20 bp, Artificial Sequence
  chemically synthesized
agatatacaaaagaaagctc

SEQ ID NO: 57512 - DNA, 20 bp, Artificial Sequence
  chemically synthesized
tgtgtgtgtatactatatat

SEQ ID NO: 57513 - DNA, 20 bp, Artificial Sequence
  chemically synthesized
actatatatcagcctacaaa

SEQ ID NO: 57514 - DNA, 20 bp, Artificial Sequence
  chemically synthesized
atatatcagcctacaaatag

SEQ ID NO: 57515 - DNA, 20 bp, Artificial Sequence
  chemically synthesized
atatcagcctacaaatagta

SEQ ID NO: 57516 - DNA, 20 bp, Artificial Sequence
  chemically synthesized
atcagcctacaaatagtaga

SEQ ID NO: 57517 - DNA, 20 bp, Artificial Sequence
  chemically synthesized
gagaccaaaaccctaacact

SEQ ID NO: 57518 - DNA, 20 bp, Artificial Sequence
  chemically synthesized
agaccaaaaccctaacactt

SEQ ID NO: 57519 - DNA, 20 bp, Artificial Sequence
  chemically synthesized
aaaccctaacacttgggtca

SEQ ID NO: 57520 - DNA, 20 bp, Artificial Sequence
  chemically synthesized
accctaacacttgggtcacg

SEQ ID NO: 57521 - DNA, 20 bp, Artificial Sequence
  chemically synthesized
ccctaacacttgggtcacgg

SEQ ID NO: 57522 - DNA, 20 bp, Artificial Sequence
  chemically synthesized
tgggtcacggaggactgtga

SEQ ID NO: 57523 - DNA, 20 bp, Artificial Sequence
  chemically synthesized
gggtcacggaggactgtgaa

SEQ ID NO: 57524 - DNA, 20 bp, Artificial Sequence
  chemically synthesized
cggaggactgtgaaaggaac

SEQ ID NO: 57525 - DNA, 20 bp, Artificial Sequence
  chemically synthesized
ggaggactgtgaaaggaacc

SEQ ID NO: 57526 - DNA, 20 bp, Artificial Sequence
  chemically synthesized
gaggactgtgaaaggaacca

SEQ ID NO: 57527 - DNA, 20 bp, Artificial Sequence
  chemically synthesized
aaaggaaccagggaatgaat

SEQ ID NO: 57528 - DNA, 20 bp, Artificial Sequence
  chemically synthesized
aaggaaccagggaatgaatc

SEQ ID NO: 57529 - DNA, 20 bp, Artificial Sequence
  chemically synthesized
aactcatgcattttaaaaaa

SEQ ID NO: 57530 - DNA, 20 bp, Artificial Sequence
  chemically synthesized
actcatgcattttaaaaaat

SEQ ID NO: 57531 - DNA, 20 bp, Artificial Sequence
  chemically synthesized
ctcatgcattttaaaaaata

SEQ ID NO: 57532 - DNA, 20 bp, Artificial Sequence
  chemically synthesized
tatttatttatttatttttg

SEQ ID NO: 57533 - DNA, 20 bp, Artificial Sequence
  chemically synthesized
tttatttatttttgtagaaa

SEQ ID NO: 57534 - DNA, 20 bp, Artificial Sequence
  chemically synthesized
ttatttatttttgtagaaac

SEQ ID NO: 57535 - DNA, 20 bp, Artificial Sequence
  chemically synthesized
tatttatttttgtagaaacg

SEQ ID NO: 57536 - DNA, 20 bp, Artificial Sequence
  chemically synthesized
agaaacggggtctcactatg

SEQ ID NO: 57537 - DNA, 20 bp, Artificial Sequence
  chemically synthesized
cggggtctcactatgcggcc

SEQ ID NO: 57538 - DNA, 20 bp, Artificial Sequence
  chemically synthesized
ggggtctcactatgcggccc

SEQ ID NO: 57539 - DNA, 20 bp, Artificial Sequence
  chemically synthesized
tctcactatgcggcccaggc

SEQ ID NO: 57540 - DNA, 20 bp, Artificial Sequence
  chemically synthesized
ccaggctggtctcaaattcc

SEQ ID NO: 57541 - DNA, 20 bp, Artificial Sequence
  chemically synthesized
ggtctcaaattcctggcttc

SEQ ID NO: 57542 - DNA, 20 bp, Artificial Sequence
  chemically synthesized
gtgatcctcccgcctcaacc

SEQ ID NO: 57543 - DNA, 20 bp, Artificial Sequence
  chemically synthesized
cctcccgcctcaacctagca

SEQ ID NO: 57544 - DNA, 20 bp, Artificial Sequence
  chemically synthesized
gcctcaacctagcaaagcat

SEQ ID NO: 57545 - DNA, 20 bp, Artificial Sequence
  chemically synthesized
cctcaacctagcaaagcatt

SEQ ID NO: 57546 - DNA, 20 bp, Artificial Sequence
  chemically synthesized
ctagcaaagcattgggatta

SEQ ID NO: 57547 - DNA, 20 bp, Artificial Sequence
  chemically synthesized
tagcaaagcattgggattac

SEQ ID NO: 57548 - DNA, 20 bp, Artificial Sequence
  chemically synthesized
agcattgggattacaggcat

SEQ ID NO: 57549 - DNA, 20 bp, Artificial Sequence
  chemically synthesized
tccaaattcatgcatttttt

SEQ ID NO: 57550 - DNA, 20 bp, Artificial Sequence
  chemically synthesized
ccaaattcatgcattttttg

SEQ ID NO: 57551 - DNA, 20 bp, Artificial Sequence
  chemically synthesized
ttcatgcattttttgaggat

SEQ ID NO: 57552 - DNA, 20 bp, Artificial Sequence
  chemically synthesized
catgcattttttgaggataa

SEQ ID NO: 57553 - DNA, 20 bp, Artificial Sequence
  chemically synthesized
cattttttgaggataagagc

SEQ ID NO: 57554 - DNA, 20 bp, Artificial Sequence
  chemically synthesized
attttttgaggataagagcc

SEQ ID NO: 57555 - DNA, 20 bp, Artificial Sequence
  chemically synthesized
ttttttgaggataagagcca

SEQ ID NO: 57556 - DNA, 20 bp, Artificial Sequence
  chemically synthesized
tttttgaggataagagccag

SEQ ID NO: 57557 - DNA, 20 bp, Artificial Sequence
  chemically synthesized
ttttgaggataagagccagg

SEQ ID NO: 57558 - DNA, 20 bp, Artificial Sequence
  chemically synthesized
tgcctgaatttcccatcatt

SEQ ID NO: 57559 - DNA, 20 bp, Artificial Sequence
  chemically synthesized
ttaagtccatattgacatgt

SEQ ID NO: 57560 - DNA, 20 bp, Artificial Sequence
  chemically synthesized
taagtccatattgacatgta

SEQ ID NO: 57561 - DNA, 20 bp, Artificial Sequence
  chemically synthesized
aagtccatattgacatgtaa

SEQ ID NO: 57562 - DNA, 20 bp, Artificial Sequence
  chemically synthesized
agtccatattgacatgtaag

SEQ ID NO: 57563 - DNA, 20 bp, Artificial Sequence
  chemically synthesized
ccatattgacatgtaagggg

SEQ ID NO: 57564 - DNA, 20 bp, Artificial Sequence
  chemically synthesized
attgacatgtaaggggtagc

SEQ ID NO: 57565 - DNA, 20 bp, Artificial Sequence
  chemically synthesized
ttgacatgtaaggggtagct

SEQ ID NO: 57566 - DNA, 20 bp, Artificial Sequence
  chemically synthesized
tgacatgtaaggggtagctg

SEQ ID NO: 57567 - DNA, 20 bp, Artificial Sequence
  chemically synthesized
atgtaaggggtagctgggga

SEQ ID NO: 57568 - DNA, 20 bp, Artificial Sequence
  chemically synthesized
gggtagctggggacagaaaa

SEQ ID NO: 57569 - DNA, 20 bp, Artificial Sequence
  chemically synthesized
ggggacagaaaaaagaaact

SEQ ID NO: 57570 - DNA, 20 bp, Artificial Sequence
  chemically synthesized
ggacagaaaaaagaaactca

SEQ ID NO: 57571 - DNA, 20 bp, Artificial Sequence
  chemically synthesized
actcagagctaatgaatctg

SEQ ID NO: 57572 - DNA, 20 bp, Artificial Sequence
  chemically synthesized
agctaatgaatctgtggcaa

SEQ ID NO: 57573 - DNA, 20 bp, Artificial Sequence
  chemically synthesized
gaatctgtggcaaaagttga

SEQ ID NO: 57574 - DNA, 20 bp, Artificial Sequence
  chemically synthesized
aagttgacagcattccatgc

SEQ ID NO: 57575 - DNA, 20 bp, Artificial Sequence
  chemically synthesized
gaaatgattaaaacatcctc

SEQ ID NO: 57576 - DNA, 20 bp, Artificial Sequence
  chemically synthesized
aaatgattaaaacatcctcc

SEQ ID NO: 57577 - DNA, 20 bp, Artificial Sequence
  chemically synthesized
atgattaaaacatcctccag

SEQ ID NO: 57578 - DNA, 20 bp, Artificial Sequence
  chemically synthesized
tgattaaaacatcctccagg

SEQ ID NO: 57579 - DNA, 20 bp, Artificial Sequence
  chemically synthesized
atcctccaggaggtatgacc

SEQ ID NO: 57580 - DNA, 20 bp, Artificial Sequence
  chemically synthesized
cctccaggaggtatgacctg

SEQ ID NO: 57581 - DNA, 20 bp, Artificial Sequence
  chemically synthesized
agtctcctccccaccccacc

SEQ ID NO: 57582 - DNA, 20 bp, Artificial Sequence
  chemically synthesized
gtctcctccccaccccacca

SEQ ID NO: 57583 - DNA, 20 bp, Artificial Sequence
  chemically synthesized
tctcctccccaccccaccaa

SEQ ID NO: 57584 - DNA, 20 bp, Artificial Sequence
  chemically synthesized
ccccaccaagggctcgcacc

SEQ ID NO: 57585 - DNA, 20 bp, Artificial Sequence
  chemically synthesized
cacccagcccatgctgactc

SEQ ID NO: 57586 - DNA, 20 bp, Artificial Sequence
  chemically synthesized
tccagttgtccttgactgca

SEQ ID NO: 57587 - DNA, 20 bp, Artificial Sequence
  chemically synthesized
cttgactgcatggtttctgc

SEQ ID NO: 57588 - DNA, 20 bp, Artificial Sequence
  chemically synthesized
tgcatggtttctgctggtcc

SEQ ID NO: 57589 - DNA, 20 bp, Artificial Sequence
  chemically synthesized
tctcctgccacgcctaacct

SEQ ID NO: 57590 - DNA, 20 bp, Artificial Sequence
  chemically synthesized
tcctgccacgcctaaccttg

SEQ ID NO: 57591 - DNA, 20 bp, Artificial Sequence
  chemically synthesized
ctgccacgcctaaccttgga

SEQ ID NO: 57592 - DNA, 20 bp, Artificial Sequence
  chemically synthesized
ccacgcctaaccttggagag

SEQ ID NO: 57593 - DNA, 20 bp, Artificial Sequence
  chemically synthesized
cacgcctaaccttggagagc

SEQ ID NO: 57594 - DNA, 20 bp, Artificial Sequence
  chemically synthesized
ttggagagcaggtaatgtgt

SEQ ID NO: 57595 - DNA, 20 bp, Artificial Sequence
  chemically synthesized
aggtaatgtgttggtgactg

SEQ ID NO: 57596 - DNA, 20 bp, Artificial Sequence
  chemically synthesized
ggtaatgtgttggtgactgt

SEQ ID NO: 57597 - DNA, 20 bp, Artificial Sequence
  chemically synthesized
aatgtgttggtgactgtggg

SEQ ID NO: 57598 - DNA, 20 bp, Artificial Sequence
  chemically synthesized
atgtgttggtgactgtgggt

SEQ ID NO: 57599 - DNA, 20 bp, Artificial Sequence
  chemically synthesized
ggtgactgtgggtgggtgta

SEQ ID NO: 57600 - DNA, 20 bp, Artificial Sequence
  chemically synthesized
actgtgggtgggtgtaaagt

SEQ ID NO: 57601 - DNA, 20 bp, Artificial Sequence
  chemically synthesized
gtgtaaagtaagcccatgcg

SEQ ID NO: 57602 - DNA, 20 bp, Artificial Sequence
  chemically synthesized
taaagtaagcccatgcgtgg

SEQ ID NO: 57603 - DNA, 20 bp, Artificial Sequence
  chemically synthesized
aaagtaagcccatgcgtggc

SEQ ID NO: 57604 - DNA, 20 bp, Artificial Sequence
  chemically synthesized
gtaagcccatgcgtggcagg

SEQ ID NO: 57605 - DNA, 20 bp, Artificial Sequence
  chemically synthesized
ccatgcgtggcaggcagtgc

SEQ ID NO: 57606 - DNA, 20 bp, Artificial Sequence
  chemically synthesized
catgcgtggcaggcagtgct

SEQ ID NO: 57607 - DNA, 20 bp, Artificial Sequence
  chemically synthesized
atgcgtggcaggcagtgctg

SEQ ID NO: 57608 - DNA, 20 bp, Artificial Sequence
  chemically synthesized
tggcaggcagtgctggggcg

SEQ ID NO: 57609 - DNA, 20 bp, Artificial Sequence
  chemically synthesized
ggcaggcagtgctggggcgt

SEQ ID NO: 57610 - DNA, 20 bp, Artificial Sequence
  chemically synthesized
gcaggcagtgctggggcgtg

SEQ ID NO: 57611 - DNA, 20 bp, Artificial Sequence
  chemically synthesized
gtatatgtgatctgcactgt

SEQ ID NO: 57612 - DNA, 20 bp, Artificial Sequence
  chemically synthesized
tatatgtgatctgcactgtc

SEQ ID NO: 57613 - DNA, 20 bp, Artificial Sequence
  chemically synthesized
atatgtgatctgcactgtca

SEQ ID NO: 57614 - DNA, 20 bp, Artificial Sequence
  chemically synthesized
atctgcactgtcagggctgc

SEQ ID NO: 57615 - DNA, 20 bp, Artificial Sequence
  chemically synthesized
tctgcactgtcagggctgct

SEQ ID NO: 57616 - DNA, 20 bp, Artificial Sequence
  chemically synthesized
ctgtcagggctgctgggcca

SEQ ID NO: 57617 - DNA, 20 bp, Artificial Sequence
  chemically synthesized
tgtcagggctgctgggccat

SEQ ID NO: 57618 - DNA, 20 bp, Artificial Sequence
  chemically synthesized
cagggctgctgggccatagg

SEQ ID NO: 57619 - DNA, 20 bp, Artificial Sequence
  chemically synthesized
agggctgctgggccataggt

SEQ ID NO: 57620 - DNA, 20 bp, Artificial Sequence
  chemically synthesized
gggctgctgggccataggta

SEQ ID NO: 57621 - DNA, 20 bp, Artificial Sequence
  chemically synthesized
gctgctgggccataggtagg

SEQ ID NO: 57622 - DNA, 20 bp, Artificial Sequence
  chemically synthesized
gtagggagcctccctctacc

SEQ ID NO: 57623 - DNA, 20 bp, Artificial Sequence
  chemically synthesized
gagcctccctctacccagat

SEQ ID NO: 57624 - DNA, 20 bp, Artificial Sequence
  chemically synthesized
acccagataagcctctgttg

SEQ ID NO: 57625 - DNA, 20 bp, Artificial Sequence
  chemically synthesized
ccagataagcctctgttgtg

SEQ ID NO: 57626 - DNA, 20 bp, Artificial Sequence
  chemically synthesized
ctgttgtggagtaactattg

SEQ ID NO: 57627 - DNA, 20 bp, Artificial Sequence
  chemically synthesized
gtaactattgcagtgacctc

SEQ ID NO: 57628 - DNA, 20 bp, Artificial Sequence
  chemically synthesized
taactattgcagtgacctct

SEQ ID NO: 57629 - DNA, 20 bp, Artificial Sequence
  chemically synthesized
attgcagtgacctctgggat

SEQ ID NO: 57630 - DNA, 20 bp, Artificial Sequence
  chemically synthesized
tgcagtgacctctgggatga

SEQ ID NO: 57631 - DNA, 20 bp, Artificial Sequence
  chemically synthesized
ctctgggatgagagtttcta

SEQ ID NO: 57632 - DNA, 20 bp, Artificial Sequence
  chemically synthesized
gggatgagagtttctatggt

SEQ ID NO: 57633 - DNA, 20 bp, Artificial Sequence
  chemically synthesized
gatgagagtttctatggtca

SEQ ID NO: 57634 - DNA, 20 bp, Artificial Sequence
  chemically synthesized
atgagagtttctatggtcag

SEQ ID NO: 57635 - DNA, 20 bp, Artificial Sequence
  chemically synthesized
gagtttctatggtcagaggt

SEQ ID NO: 57636 - DNA, 20 bp, Artificial Sequence
  chemically synthesized
tctatggtcagaggtgagtc

SEQ ID NO: 57637 - DNA, 20 bp, Artificial Sequence
  chemically synthesized
ctatggtcagaggtgagtca

SEQ ID NO: 57638 - DNA, 20 bp, Artificial Sequence
  chemically synthesized
ggtcagaggtgagtcaaggt

SEQ ID NO: 57639 - DNA, 20 bp, Artificial Sequence
  chemically synthesized
tgagtctaaaaacatataca

SEQ ID NO: 57640 - DNA, 20 bp, Artificial Sequence
  chemically synthesized
gagtctaaaaacatatacaa

SEQ ID NO: 57641 - DNA, 20 bp, Artificial Sequence
  chemically synthesized
catatacaaaggccactgtc

SEQ ID NO: 57642 - DNA, 20 bp, Artificial Sequence
  chemically synthesized
atatacaaaggccactgtct

SEQ ID NO: 57643 - DNA, 20 bp, Artificial Sequence
  chemically synthesized
ggccactgtctgggtcatgc

SEQ ID NO: 57644 - DNA, 20 bp, Artificial Sequence
  chemically synthesized
gccactgtctgggtcatgcc

SEQ ID NO: 57645 - DNA, 20 bp, Artificial Sequence
  chemically synthesized
ccactgtctgggtcatgcca

SEQ ID NO: 57646 - DNA, 20 bp, Artificial Sequence
  chemically synthesized
ctgtctgggtcatgccaggg

SEQ ID NO: 57647 - DNA, 20 bp, Artificial Sequence
  chemically synthesized
ctgggtcatgccagggcagc

SEQ ID NO: 57648 - DNA, 20 bp, Artificial Sequence
  chemically synthesized
ggtcatgccagggcagctag

SEQ ID NO: 57649 - DNA, 20 bp, Artificial Sequence
  chemically synthesized
atgccagggcagctagcagc

SEQ ID NO: 57650 - DNA, 20 bp, Artificial Sequence
  chemically synthesized
tgccagggcagctagcagcc

SEQ ID NO: 57651 - DNA, 20 bp, Artificial Sequence
  chemically synthesized
gccagggcagctagcagcca

SEQ ID NO: 57652 - DNA, 20 bp, Artificial Sequence
  chemically synthesized
agctagcagccagggtctct

SEQ ID NO: 57653 - DNA, 20 bp, Artificial Sequence
  chemically synthesized
agcagccagggtctctgagt

SEQ ID NO: 57654 - DNA, 20 bp, Artificial Sequence
  chemically synthesized
gcagccagggtctctgagtt

SEQ ID NO: 57655 - DNA, 20 bp, Artificial Sequence
  chemically synthesized
agccagggtctctgagttgg

SEQ ID NO: 57656 - DNA, 20 bp, Artificial Sequence
  chemically synthesized
gccagggtctctgagttggg

SEQ ID NO: 57657 - DNA, 20 bp, Artificial Sequence
  chemically synthesized
ccagggtctctgagttggga

SEQ ID NO: 57658 - DNA, 20 bp, Artificial Sequence
  chemically synthesized
cagggtctctgagttgggag

SEQ ID NO: 57659 - DNA, 20 bp, Artificial Sequence
  chemically synthesized
ttgggaggggttctattatg

SEQ ID NO: 57660 - DNA, 20 bp, Artificial Sequence
  chemically synthesized
gaggggttctattatgtggt

SEQ ID NO: 57661 - DNA, 20 bp, Artificial Sequence
  chemically synthesized
tctattatgtggtcagcata

SEQ ID NO: 57662 - DNA, 20 bp, Artificial Sequence
  chemically synthesized
ctattatgtggtcagcatat

SEQ ID NO: 57663 - DNA, 20 bp, Artificial Sequence
  chemically synthesized
tattatgtggtcagcatatg

SEQ ID NO: 57664 - DNA, 20 bp, Artificial Sequence
  chemically synthesized
ttatgtggtcagcatatggg

SEQ ID NO: 57665 - DNA, 20 bp, Artificial Sequence
  chemically synthesized
tatgtggtcagcatatgggg

SEQ ID NO: 57666 - DNA, 20 bp, Artificial Sequence
  chemically synthesized
atgtggtcagcatatgggga

SEQ ID NO: 57667 - DNA, 20 bp, Artificial Sequence
  chemically synthesized
tggggagggccctgttttct

SEQ ID NO: 57668 - DNA, 20 bp, Artificial Sequence
  chemically synthesized
ccctgttttctgagacgcct

SEQ ID NO: 57669 - DNA, 20 bp, Artificial Sequence
  chemically synthesized
cctgttttctgagacgcctc

SEQ ID NO: 57670 - DNA, 20 bp, Artificial Sequence
  chemically synthesized
gttttctgagacgcctcagg

SEQ ID NO: 57671 - DNA, 20 bp, Artificial Sequence
  chemically synthesized
cctcaggaagaataccccta

SEQ ID NO: 57672 - DNA, 20 bp, Artificial Sequence
  chemically synthesized
ggaagaatacccctatggat

SEQ ID NO: 57673 - DNA, 20 bp, Artificial Sequence
  chemically synthesized
gaagaatacccctatggata

SEQ ID NO: 57674 - DNA, 20 bp, Artificial Sequence
  chemically synthesized
agaatacccctatggataag

SEQ ID NO: 57675 - DNA, 20 bp, Artificial Sequence
  chemically synthesized
cctatggataaggagttgat

SEQ ID NO: 57676 - DNA, 20 bp, Artificial Sequence
  chemically synthesized
gataaggagttgataagtga

SEQ ID NO: 57677 - DNA, 20 bp, Artificial Sequence
  chemically synthesized
taaggagttgataagtgatg

SEQ ID NO: 57678 - DNA, 20 bp, Artificial Sequence
  chemically synthesized
atggagttgacatcccactc

SEQ ID NO: 57679 - DNA, 20 bp, Artificial Sequence
  chemically synthesized
tggagttgacatcccactct

SEQ ID NO: 57680 - DNA, 20 bp, Artificial Sequence
  chemically synthesized
gacatcccactctgggcatc

SEQ ID NO: 57681 - DNA, 20 bp, Artificial Sequence
  chemically synthesized
acatcccactctgggcatcc

SEQ ID NO: 57682 - DNA, 20 bp, Artificial Sequence
  chemically synthesized
catcccactctgggcatcca

SEQ ID NO: 57683 - DNA, 20 bp, Artificial Sequence
  chemically synthesized
ccactctgggcatccaggga

SEQ ID NO: 57684 - DNA, 20 bp, Artificial Sequence
  chemically synthesized
ctctgggcatccagggacag

SEQ ID NO: 57685 - DNA, 20 bp, Artificial Sequence
  chemically synthesized
tctgggcatccagggacagt

SEQ ID NO: 57686 - DNA, 20 bp, Artificial Sequence
  chemically synthesized
tgggcatccagggacagtgg

SEQ ID NO: 57687 - DNA, 20 bp, Artificial Sequence
  chemically synthesized
agggacagtgggagtcttcc

SEQ ID NO: 57688 - DNA, 20 bp, Artificial Sequence
  chemically synthesized
gacagtgggagtcttcctgg

SEQ ID NO: 57689 - DNA, 20 bp, Artificial Sequence
  chemically synthesized
agtgggagtcttcctggcgg

SEQ ID NO: 57690 - DNA, 20 bp, Artificial Sequence
  chemically synthesized
gtgggagtcttcctggcggt

SEQ ID NO: 57691 - DNA, 20 bp, Artificial Sequence
  chemically synthesized
tcttcctggcggtgggccac

SEQ ID NO: 57692 - DNA, 20 bp, Artificial Sequence
  chemically synthesized
cttcctggcggtgggccacc

SEQ ID NO: 57693 - DNA, 20 bp, Artificial Sequence
  chemically synthesized
cctggcggtgggccaccagg

SEQ ID NO: 57694 - DNA, 20 bp, Artificial Sequence
  chemically synthesized
ctggcggtgggccaccaggc

SEQ ID NO: 57695 - DNA, 20 bp, Artificial Sequence
  chemically synthesized
tggcggtgggccaccaggca

SEQ ID NO: 57696 - DNA, 20 bp, Artificial Sequence
  chemically synthesized
ggcggtgggccaccaggcag

SEQ ID NO: 57697 - DNA, 20 bp, Artificial Sequence
  chemically synthesized
gcggtgggccaccaggcagg

SEQ ID NO: 57698 - DNA, 20 bp, Artificial Sequence
  chemically synthesized
caccaggcagggggaccctc

SEQ ID NO: 57699 - DNA, 20 bp, Artificial Sequence
  chemically synthesized
ggcagggggaccctctggat

SEQ ID NO: 57700 - DNA, 20 bp, Artificial Sequence
  chemically synthesized
cagggggaccctctggatca

SEQ ID NO: 57701 - DNA, 20 bp, Artificial Sequence
  chemically synthesized
tctggatcagagcaacctca

SEQ ID NO: 57702 - DNA, 20 bp, Artificial Sequence
  chemically synthesized
cagagcaacctcatagtcat

SEQ ID NO: 57703 - DNA, 20 bp, Artificial Sequence
  chemically synthesized
cctcatagtcatgagacgat

SEQ ID NO: 57704 - DNA, 20 bp, Artificial Sequence
  chemically synthesized
atagtcatgagacgatgagc

SEQ ID NO: 57705 - DNA, 20 bp, Artificial Sequence
  chemically synthesized
gtcctcatctttccacctgc

SEQ ID NO: 57706 - DNA, 20 bp, Artificial Sequence
  chemically synthesized
cagcccctttctgcttcctc

SEQ ID NO: 57707 - DNA, 20 bp, Artificial Sequence
  chemically synthesized
ctccagcacgtttttatccg

SEQ ID NO: 57708 - DNA, 20 bp, Artificial Sequence
  chemically synthesized
tccagcacgtttttatccgt

SEQ ID NO: 57709 - DNA, 20 bp, Artificial Sequence
  chemically synthesized
cgtttttatccgtgggaaaa

SEQ ID NO: 57710 - DNA, 20 bp, Artificial Sequence
  chemically synthesized
gtttttatccgtgggaaaac

SEQ ID NO: 57711 - DNA, 20 bp, Artificial Sequence
  chemically synthesized
ttatccgtgggaaaacaggt

SEQ ID NO: 57712 - DNA, 20 bp, Artificial Sequence
  chemically synthesized
tatccgtgggaaaacaggtg

SEQ ID NO: 57713 - DNA, 20 bp, Artificial Sequence
  chemically synthesized
tgggaaaacaggtgaggccc

SEQ ID NO: 57714 - DNA, 20 bp, Artificial Sequence
  chemically synthesized
caggtgaggccccagcttgt

SEQ ID NO: 57715 - DNA, 20 bp, Artificial Sequence
  chemically synthesized
tgaggccccagcttgttaga

SEQ ID NO: 57716 - DNA, 20 bp, Artificial Sequence
  chemically synthesized
gttagaaagctgactgcatc

SEQ ID NO: 57717 - DNA, 20 bp, Artificial Sequence
  chemically synthesized
ctgactgcatcgagacaccg

SEQ ID NO: 57718 - DNA, 20 bp, Artificial Sequence
  chemically synthesized
cgagacaccgtggattctca

SEQ ID NO: 57719 - DNA, 20 bp, Artificial Sequence
  chemically synthesized
gagacaccgtggattctcaa

SEQ ID NO: 57720 - DNA, 20 bp, Artificial Sequence
  chemically synthesized
gtggattctcaaaggtcttg

SEQ ID NO: 57721 - DNA, 20 bp, Artificial Sequence
  chemically synthesized
caaaggtcttgtggatatat

SEQ ID NO: 57722 - DNA, 20 bp, Artificial Sequence
  chemically synthesized
aaaggtcttgtggatatatg

SEQ ID NO: 57723 - DNA, 20 bp, Artificial Sequence
  chemically synthesized
gtcttgtggatatatgaggc

SEQ ID NO: 57724 - DNA, 20 bp, Artificial Sequence
  chemically synthesized
ttgtggatatatgaggcgag

SEQ ID NO: 57725 - DNA, 20 bp, Artificial Sequence
  chemically synthesized
ggatatatgaggcgagtggc

SEQ ID NO: 57726 - DNA, 20 bp, Artificial Sequence
  chemically synthesized
tatatgaggcgagtggctag

SEQ ID NO: 57727 - DNA, 20 bp, Artificial Sequence
  chemically synthesized
gagtggctagaagttttgct

SEQ ID NO: 57728 - DNA, 20 bp, Artificial Sequence
  chemically synthesized
actcatttatctgtttattt

SEQ ID NO: 57729 - DNA, 20 bp, Artificial Sequence
  chemically synthesized
atttatctgtttatttgaga

SEQ ID NO: 57730 - DNA, 20 bp, Artificial Sequence
  chemically synthesized
tttatctgtttatttgagac

SEQ ID NO: 57731 - DNA, 20 bp, Artificial Sequence
  chemically synthesized
ttatctgtttatttgagacg

SEQ ID NO: 57732 - DNA, 20 bp, Artificial Sequence
  chemically synthesized
cggggtctcactctgttacc

SEQ ID NO: 57733 - DNA, 20 bp, Artificial Sequence
  chemically synthesized
ggggtctcactctgttaccc

SEQ ID NO: 57734 - DNA, 20 bp, Artificial Sequence
  chemically synthesized
tctcactctgttacccaggc

SEQ ID NO: 57735 - DNA, 20 bp, Artificial Sequence
  chemically synthesized
tcactctgttacccaggctg

SEQ ID NO: 57736 - DNA, 20 bp, Artificial Sequence
  chemically synthesized
ctgttacccaggctggagtg

SEQ ID NO: 57737 - DNA, 20 bp, Artificial Sequence
  chemically synthesized
ttacccaggctggagtgcgg

SEQ ID NO: 57738 - DNA, 20 bp, Artificial Sequence
  chemically synthesized
ggagtgcggtggcaccatca

SEQ ID NO: 57739 - DNA, 20 bp, Artificial Sequence
  chemically synthesized
ggcaccatcacagctcactg

SEQ ID NO: 57740 - DNA, 20 bp, Artificial Sequence
  chemically synthesized
atcacagctcactgcagcct

SEQ ID NO: 57741 - DNA, 20 bp, Artificial Sequence
  chemically synthesized
tcactgcagcctcagtctcc

SEQ ID NO: 57742 - DNA, 20 bp, Artificial Sequence
  chemically synthesized
cactgcagcctcagtctcct

SEQ ID NO: 57743 - DNA, 20 bp, Artificial Sequence
  chemically synthesized
agcctcagtctcctgggctt

SEQ ID NO: 57744 - DNA, 20 bp, Artificial Sequence
  chemically synthesized
gcctcagtctcctgggctta

SEQ ID NO: 57745 - DNA, 20 bp, Artificial Sequence
  chemically synthesized
cctcagtctcctgggcttaa

SEQ ID NO: 57746 - DNA, 20 bp, Artificial Sequence
  chemically synthesized
cttaagggatcgttttgcat

SEQ ID NO: 57747 - DNA, 20 bp, Artificial Sequence
  chemically synthesized
gatcgttttgcatcagtctc

SEQ ID NO: 57748 - DNA, 20 bp, Artificial Sequence
  chemically synthesized
atcgttttgcatcagtctct

SEQ ID NO: 57749 - DNA, 20 bp, Artificial Sequence
  chemically synthesized
gttttgcatcagtctctggg

SEQ ID NO: 57750 - DNA, 20 bp, Artificial Sequence
  chemically synthesized
tgcatcagtctctgggtagc

SEQ ID NO: 57751 - DNA, 20 bp, Artificial Sequence
  chemically synthesized
gcatcagtctctgggtagct

SEQ ID NO: 57752 - DNA, 20 bp, Artificial Sequence
  chemically synthesized
tctctgggtagctgggccta

SEQ ID NO: 57753 - DNA, 20 bp, Artificial Sequence
  chemically synthesized
ctctgggtagctgggcctac

SEQ ID NO: 57754 - DNA, 20 bp, Artificial Sequence
  chemically synthesized
caggcgcacaccaccaaacc

SEQ ID NO: 57755 - DNA, 20 bp, Artificial Sequence
  chemically synthesized
tggtgccaccgcactccagc

SEQ ID NO: 57756 - DNA, 20 bp, Artificial Sequence
  chemically synthesized
ccgcactccagcctgggtaa

SEQ ID NO: 57757 - DNA, 20 bp, Artificial Sequence
  chemically synthesized
cgtctcaaataaacagataa

SEQ ID NO: 57758 - DNA, 20 bp, Artificial Sequence
  chemically synthesized
tcaaataaacagataaatga

SEQ ID NO: 57759 - DNA, 20 bp, Artificial Sequence
  chemically synthesized
catatatccacaagaccttt

SEQ ID NO: 57760 - DNA, 20 bp, Artificial Sequence
  chemically synthesized
ggggcctcacctgttttccc

SEQ ID NO: 57761 - DNA, 20 bp, Artificial Sequence
  chemically synthesized
tatgaggttgctctgatcca

SEQ ID NO: 57762 - DNA, 20 bp, Artificial Sequence
  chemically synthesized
caggaagactcccactgtcc

SEQ ID NO: 57763 - DNA, 20 bp, Artificial Sequence
  chemically synthesized
tcccactgtccctggatgcc

SEQ ID NO: 57764 - DNA, 20 bp, Artificial Sequence
  chemically synthesized
ctgtccctggatgcccagag

SEQ ID NO: 57765 - DNA, 20 bp, Artificial Sequence
  chemically synthesized
cttatcaactccttatccat

SEQ ID NO: 57766 - DNA, 20 bp, Artificial Sequence
  chemically synthesized
actccacaacagaggcttat

SEQ ID NO: 57767 - DNA, 20 bp, Artificial Sequence
  chemically synthesized
accatgcagtcaaggacaac

SEQ ID NO: 57768 - DNA, 20 bp, Artificial Sequence
  chemically synthesized
acaactggagtcagcatggg

SEQ ID NO: 57769 - DNA, 20 bp, Artificial Sequence
  chemically synthesized
ggctgggtgcgagcccttgg

SEQ ID NO: 57770 - DNA, 20 bp, Artificial Sequence
  chemically synthesized
actccaggtcatacctcctg

SEQ ID NO: 57771 - DNA, 20 bp, Artificial Sequence
  chemically synthesized
tgttttaatcatttccagca

SEQ ID NO: 57772 - DNA, 20 bp, Artificial Sequence
  chemically synthesized
ttgccacagattcattagct

SEQ ID NO: 57773 - DNA, 20 bp, Artificial Sequence
  chemically synthesized
ctcttatcctcaaaaaatgc

SEQ ID NO: 57774 - DNA, 20 bp, Artificial Sequence
  chemically synthesized
gctttgctaggttgaggcgg

SEQ ID NO: 57775 - DNA, 20 bp, Artificial Sequence
  chemically synthesized
cgggaggatcacttgaagcc

SEQ ID NO: 57776 - DNA, 20 bp, Artificial Sequence
  chemically synthesized
agccctattttttaaaatgc

SEQ ID NO: 57777 - DNA, 20 bp, Artificial Sequence
  chemically synthesized
gtcctccgtgacccaagtgt

SEQ ID NO: 57778 - DNA, 20 bp, Artificial Sequence
  chemically synthesized
tcattattttgcttaaacgt

SEQ ID NO: 57779 - DNA, 20 bp, Artificial Sequence
  chemically synthesized
ctggcagatctcttgagctc

SEQ ID NO: 57780 - DNA, 20 bp, Artificial Sequence
  chemically synthesized
tactcaggaggctgaggtgg

SEQ ID NO: 57781 - DNA, 20 bp, Artificial Sequence
  chemically synthesized
ctgcactccagcctgggaga

SEQ ID NO: 57782 - DNA, 20 bp, Artificial Sequence
  chemically synthesized
tgtaactttaaggtcattaa

SEQ ID NO: 57783 - DNA, 20 bp, Artificial Sequence
  chemically synthesized
catgaggccaataccaggaa

SEQ ID NO: 57784 - DNA, 20 bp, Artificial Sequence
  chemically synthesized
ttttgttttgttttagagac

SEQ ID NO: 57785 - DNA, 20 bp, Artificial Sequence
  chemically synthesized
aatcctcctgcctcagcctc

SEQ ID NO: 57786 - DNA, 20 bp, Artificial Sequence
  chemically synthesized
tcctgaatagctgggactac

SEQ ID NO: 57787 - DNA, 20 bp, Artificial Sequence
  chemically synthesized
ttaaatttttgtgtagaaac

SEQ ID NO: 57788 - DNA, 20 bp, Artificial Sequence
  chemically synthesized
gtctccaactcctggcttca

SEQ ID NO: 57789 - DNA, 20 bp, Artificial Sequence
  chemically synthesized
acctcagcctcccaaattgc

SEQ ID NO: 57790 - DNA, 20 bp, Artificial Sequence
  chemically synthesized
taaaattaagaacttaaaac

SEQ ID NO: 57791 - DNA, 20 bp, Artificial Sequence
  chemically synthesized
agaaaatctgacatctttgc

SEQ ID NO: 57792 - DNA, 20 bp, Artificial Sequence
  chemically synthesized
acatctttgcaagaatcatc

SEQ ID NO: 57793 - DNA, 20 bp, Artificial Sequence
  chemically synthesized
aaagttaatcattggccctg

SEQ ID NO: 57794 - DNA, 20 bp, Artificial Sequence
  chemically synthesized
attttagacaaacgtggttt

SEQ ID NO: 57795 - DNA, 20 bp, Artificial Sequence
  chemically synthesized
tttgagtccaaagatcaggg

SEQ ID NO: 57796 - DNA, 20 bp, Artificial Sequence
  chemically synthesized
aagatcagggctgggttgac

SEQ ID NO: 57797 - DNA, 20 bp, Artificial Sequence
  chemically synthesized
gggctgggttgacctgaata

SEQ ID NO: 57798 - DNA, 20 bp, Artificial Sequence
  chemically synthesized
agagcaatcaccaccaagcc

SEQ ID NO: 57799 - DNA, 20 bp, Artificial Sequence
  chemically synthesized
tcctgaggtgccaaggaaat

SEQ ID NO: 57800 - DNA, 20 bp, Artificial Sequence
  chemically synthesized
aaggaaatgaggatggagga

SEQ ID NO: 57801 - DNA, 20 bp, Artificial Sequence
  chemically synthesized
aaatgaggatggaggaagga

SEQ ID NO: 57802 - DNA, 20 bp, Artificial Sequence
  chemically synthesized
atgaatgttctccatgactt

SEQ ID NO: 57803 - DNA, 20 bp, Artificial Sequence
  chemically synthesized
agtcaacacattacctccag

SEQ ID NO: 57804 - DNA, 20 bp, Artificial Sequence
  chemically synthesized
tgtccgtgatcgcagacctc

SEQ ID NO: 57805 - DNA, 20 bp, Artificial Sequence
  chemically synthesized
gctgtgggcattaaactcct

SEQ ID NO: 57806 - DNA, 20 bp, Artificial Sequence
  chemically synthesized
tccaacccctctctctgact

SEQ ID NO: 57807 - DNA, 20 bp, Artificial Sequence
  chemically synthesized
agacagaaaaaatcctacca

SEQ ID NO: 57808 - DNA, 20 bp, Artificial Sequence
  chemically synthesized
tacaggaaagcctatttcat

SEQ ID NO: 57809 - DNA, 20 bp, Artificial Sequence
  chemically synthesized
agcctatttcatatgggtta

SEQ ID NO: 57810 - DNA, 20 bp, Artificial Sequence
  chemically synthesized
tgggttaaagggtaggacag

SEQ ID NO: 57811 - DNA, 20 bp, Artificial Sequence
  chemically synthesized
agttgaatttcgtgaaaagt

SEQ ID NO: 57812 - DNA, 20 bp, Artificial Sequence
  chemically synthesized
agttatataggctttgagca

SEQ ID NO: 57813 - DNA, 20 bp, Artificial Sequence
  chemically synthesized
actttgggaggccgaggtgg

SEQ ID NO: 57814 - DNA, 20 bp, Artificial Sequence
  chemically synthesized
ccgaggtgggcgaatcactc

SEQ ID NO: 57815 - DNA, 20 bp, Artificial Sequence
  chemically synthesized
aatcactcctgggtgaactc

SEQ ID NO: 57816 - DNA, 20 bp, Artificial Sequence
  chemically synthesized
gagaggcggaggaggttgca

SEQ ID NO: 57817 - DNA, 20 bp, Artificial Sequence
  chemically synthesized
ctgcactccagcctgggcaa

SEQ ID NO: 57818 - DNA, 20 bp, Artificial Sequence
  chemically synthesized
tgattcaacagcctgttttg

SEQ ID NO: 57819 - DNA, 20 bp, Artificial Sequence
  chemically synthesized
tggcaagtcatatcaattat

SEQ ID NO: 57820 - DNA, 20 bp, Artificial Sequence
  chemically synthesized
tctggcagcttaataataat

SEQ ID NO: 57821 - DNA, 20 bp, Artificial Sequence
  chemically synthesized
tagatgcagagaccaaggtg

SEQ ID NO: 57822 - DNA, 20 bp, Artificial Sequence
  chemically synthesized
aaggttagtacatgccgagc

SEQ ID NO: 57823 - DNA, 20 bp, Artificial Sequence
  chemically synthesized
ctggggagcaggggaaagcc

SEQ ID NO: 57824 - DNA, 20 bp, Artificial Sequence
  chemically synthesized
ttttgtttgtttgtttgaga

SEQ ID NO: 57825 - DNA, 20 bp, Artificial Sequence
  chemically synthesized
gtctcgcactgttgcctggc

SEQ ID NO: 57826 - DNA, 20 bp, Artificial Sequence
  chemically synthesized
gcctcagcctcccaagtagc

SEQ ID NO: 57827 - DNA, 20 bp, Artificial Sequence
  chemically synthesized
gccttggcctccctaagtgc

SEQ ID NO: 57828 - DNA, 20 bp, Artificial Sequence
  chemically synthesized
tgaagaaccatgcaatctct

SEQ ID NO: 57829 - DNA, 20 bp, Artificial Sequence
  chemically synthesized
ctctctgggttgatagaggc

SEQ ID NO: 57830 - DNA, 20 bp, Artificial Sequence
  chemically synthesized
aaatcactattccaccatca

SEQ ID NO: 57831 - DNA, 20 bp, Artificial Sequence
  chemically synthesized
atactctgtttcaaagtaga

SEQ ID NO: 57832 - DNA, 20 bp, Artificial Sequence
  chemically synthesized
ggggggctcgtcctaggggc

SEQ ID NO: 57833 - DNA, 20 bp, Artificial Sequence
  chemically synthesized
agtcacatagctgccatttt

SEQ ID NO: 57834 - DNA, 20 bp, Artificial Sequence
  chemically synthesized
agctgccattttatggattt

SEQ ID NO: 57835 - DNA, 20 bp, Artificial Sequence
  chemically synthesized
ttttttttttttttttgaga

SEQ ID NO: 57836 - DNA, 20 bp, Artificial Sequence
  chemically synthesized
gattctcttgccttagcctc

SEQ ID NO: 57837 - DNA, 20 bp, Artificial Sequence
  chemically synthesized
gccttagcctcccgagtagc

SEQ ID NO: 57838 - DNA, 20 bp, Artificial Sequence
  chemically synthesized
tgtgagccaccgcgcctgcc

SEQ ID NO: 57839 - DNA, 20 bp, Artificial Sequence
  chemically synthesized
caccgcgcctgcctggagtt

SEQ ID NO: 57840 - DNA, 20 bp, Artificial Sequence
  chemically synthesized
actttgggaggctgaggtgg

SEQ ID NO: 57841 - DNA, 20 bp, Artificial Sequence
  chemically synthesized
ggctgaggtgggaggattgc

SEQ ID NO: 57842 - DNA, 20 bp, Artificial Sequence
  chemically synthesized
actaaaaatacaaaaactag

SEQ ID NO: 57843 - DNA, 20 bp, Artificial Sequence
  chemically synthesized
tattcaggaggctgaggtgg

SEQ ID NO: 57844 - DNA, 20 bp, Artificial Sequence
  chemically synthesized
ttgcgccactgcactccagg

SEQ ID NO: 57845 - DNA, 20 bp, Artificial Sequence
  chemically synthesized
aaacttgttctgtttttcca

SEQ ID NO: 57846 - DNA, 20 bp, Artificial Sequence
  chemically synthesized
tttggacagcgtccatactg

SEQ ID NO: 57847 - DNA, 20 bp, Artificial Sequence
  chemically synthesized
agcgtccatactggtgggtt

SEQ ID NO: 57848 - DNA, 20 bp, Artificial Sequence
  chemically synthesized
ccagcccctgcagacagaag

SEQ ID NO: 57849 - DNA, 20 bp, Artificial Sequence
  chemically synthesized
gtggacctcgtttacctgtt

SEQ ID NO: 57850 - DNA, 20 bp, Artificial Sequence
  chemically synthesized
ttcacttctgcaatactttc

SEQ ID NO: 57851 - DNA, 20 bp, Artificial Sequence
  chemically synthesized
aaatctgcctattacagaac

SEQ ID NO: 57852 - DNA, 20 bp, Artificial Sequence
  chemically synthesized
tgcctattacagaacctgga

SEQ ID NO: 57853 - DNA, 20 bp, Artificial Sequence
  chemically synthesized
tccatgggcaaagggctcgt

SEQ ID NO: 57854 - DNA, 20 bp, Artificial Sequence
  chemically synthesized
gggcagaagcctgagcttct

SEQ ID NO: 57855 - DNA, 20 bp, Artificial Sequence
  chemically synthesized
cttcccaatggcctggccca

SEQ ID NO: 57856 - DNA, 20 bp, Artificial Sequence
  chemically synthesized
tatacactgttctatgtgct

SEQ ID NO: 57857 - DNA, 20 bp, Artificial Sequence
  chemically synthesized
tgcccttgtggagctgaaat

SEQ ID NO: 57858 - DNA, 20 bp, Artificial Sequence
  chemically synthesized
taggtagatcacctgaggtc

SEQ ID NO: 57859 - DNA, 20 bp, Artificial Sequence
  chemically synthesized
tacctgggaggctgaggcag

SEQ ID NO: 57860 - DNA, 20 bp, Artificial Sequence
  chemically synthesized
tcggaccactgcactccagc

SEQ ID NO: 57861 - DNA, 20 bp, Artificial Sequence
  chemically synthesized
aaaagtaaactattaatatg

SEQ ID NO: 57862 - DNA, 20 bp, Artificial Sequence
  chemically synthesized
cagcactttgggaggctgag

SEQ ID NO: 57863 - DNA, 20 bp, Artificial Sequence
  chemically synthesized
actttgggaggctgaggcgg

SEQ ID NO: 57864 - DNA, 20 bp, Artificial Sequence
  chemically synthesized
cgggtggatcacctgaggtg

SEQ ID NO: 57865 - DNA, 20 bp, Artificial Sequence
  chemically synthesized
actaaaaatacaaaaattag

SEQ ID NO: 57866 - DNA, 20 bp, Artificial Sequence
  chemically synthesized
tactcaggaggctaaggcag

SEQ ID NO: 57867 - DNA, 20 bp, Artificial Sequence
  chemically synthesized
catcataacagcttgttatc

SEQ ID NO: 57868 - DNA, 20 bp, Artificial Sequence
  chemically synthesized
ataacagcttgttatcaagg

SEQ ID NO: 57869 - DNA, 20 bp, Artificial Sequence
  chemically synthesized
tattatctctgctccttagg

SEQ ID NO: 57870 - DNA, 20 bp, Artificial Sequence
  chemically synthesized
actttgggaggccaacgcag

SEQ ID NO: 57871 - DNA, 20 bp, Artificial Sequence
  chemically synthesized
caggtggatcacctgaggtc

SEQ ID NO: 57872 - DNA, 20 bp, Artificial Sequence
  chemically synthesized
tacccaggaggctgcggcag

SEQ ID NO: 57873 - DNA, 20 bp, Artificial Sequence
  chemically synthesized
aaaaaaaaaaaaaagtttaa

SEQ ID NO: 57874 - DNA, 20 bp, Artificial Sequence
  chemically synthesized
agaaagcctttatttatcta

SEQ ID NO: 57875 - DNA, 20 bp, Artificial Sequence
  chemically synthesized
tgaaatggagattcacgtgc

SEQ ID NO: 57876 - DNA, 20 bp, Artificial Sequence
  chemically synthesized
ccacagcgagctctgaagct

SEQ ID NO: 57877 - DNA, 20 bp, Artificial Sequence
  chemically synthesized
tgaagctggggatggctcct

SEQ ID NO: 57878 - DNA, 20 bp, Artificial Sequence
  chemically synthesized
gttggtccaagttgggacaa

SEQ ID NO: 57879 - DNA, 20 bp, Artificial Sequence
  chemically synthesized
tctcaggaccctctatctct

SEQ ID NO: 57880 - DNA, 20 bp, Artificial Sequence
  chemically synthesized
ccctctatctctcagggtag

SEQ ID NO: 57881 - DNA, 20 bp, Artificial Sequence
  chemically synthesized
tctctcagggtagaggaatt

SEQ ID NO: 57882 - DNA, 20 bp, Artificial Sequence
  chemically synthesized
cagggtagaggaattaagaa

SEQ ID NO: 57883 - DNA, 20 bp, Artificial Sequence
  chemically synthesized
tcccaacactttgggaggcc

SEQ ID NO: 57884 - DNA, 20 bp, Artificial Sequence
  chemically synthesized
ctttgggaggccaagggtag

SEQ ID NO: 57885 - DNA, 20 bp, Artificial Sequence
  chemically synthesized
taggaggattgcttgagccc

SEQ ID NO: 57886 - DNA, 20 bp, Artificial Sequence
  chemically synthesized
tactcagggggctgaggtgg

SEQ ID NO: 57887 - DNA, 20 bp, Artificial Sequence
  chemically synthesized
ggctgaggtgggaggattgc

SEQ ID NO: 57888 - DNA, 20 bp, Artificial Sequence
  chemically synthesized
aaaacggaaccggttgcaag

SEQ ID NO: 57889 - DNA, 20 bp, Artificial Sequence
  chemically synthesized
gcagggttaaatagcgtggt

SEQ ID NO: 57890 - DNA, 20 bp, Artificial Sequence
  chemically synthesized
tggtcagagtaggactcact

SEQ ID NO: 57891 - DNA, 20 bp, Artificial Sequence
  chemically synthesized
actcactgagaatatgagat

SEQ ID NO: 57892 - DNA, 20 bp, Artificial Sequence
  chemically synthesized
gagatctgagtcaagtcttc

SEQ ID NO: 57893 - DNA, 20 bp, Artificial Sequence
  chemically synthesized
tgaggccagtgtagccagaa

SEQ ID NO: 57894 - DNA, 20 bp, Artificial Sequence
  chemically synthesized
gatggaaatttgttaaataa

SEQ ID NO: 57895 - DNA, 20 bp, Artificial Sequence
  chemically synthesized
atttgttaaataaatgaatt

SEQ ID NO: 57896 - DNA, 20 bp, Artificial Sequence
  chemically synthesized
aaataaatgaattatggata

SEQ ID NO: 57897 - DNA, 20 bp, Artificial Sequence
  chemically synthesized
aaatgaattatggataacga

SEQ ID NO: 57898 - DNA, 20 bp, Artificial Sequence
  chemically synthesized
gataacgaatggatggtaag

SEQ ID NO: 57899 - DNA, 20 bp, Artificial Sequence
  chemically synthesized
acgaatggatggtaagatgg

SEQ ID NO: 57900 - DNA, 20 bp, Artificial Sequence
  chemically synthesized
atggatggtaagatgggtgg

SEQ ID NO: 57901 - DNA, 20 bp, Artificial Sequence
  chemically synthesized
gtaagatgggtggatggatg

SEQ ID NO: 57902 - DNA, 20 bp, Artificial Sequence
  chemically synthesized
ggtggatggatggggggtga

SEQ ID NO: 57903 - DNA, 20 bp, Artificial Sequence
  chemically synthesized
gatggatggggggtgaacgg

SEQ ID NO: 57904 - DNA, 20 bp, Artificial Sequence
  chemically synthesized
ggggggtgaacggatggatg

SEQ ID NO: 57905 - DNA, 20 bp, Artificial Sequence
  chemically synthesized
ggtgaacggatggatggggg

SEQ ID NO: 57906 - DNA, 20 bp, Artificial Sequence
  chemically synthesized
aacggatggatggggggtga

SEQ ID NO: 57907 - DNA, 20 bp, Artificial Sequence
  chemically synthesized
gatggatggggggtgaatgg

SEQ ID NO: 57908 - DNA, 20 bp, Artificial Sequence
  chemically synthesized
gatggggggtgaatggatgg

SEQ ID NO: 57909 - DNA, 20 bp, Artificial Sequence
  chemically synthesized
gggggtgaatggatggatga

SEQ ID NO: 57910 - DNA, 20 bp, Artificial Sequence
  chemically synthesized
atggatggatgaatgggtag

SEQ ID NO: 57911 - DNA, 20 bp, Artificial Sequence
  chemically synthesized
atggatgaatgggtagatgg

SEQ ID NO: 57912 - DNA, 20 bp, Artificial Sequence
  chemically synthesized
atgggtagatgggtggatag

SEQ ID NO: 57913 - DNA, 20 bp, Artificial Sequence
  chemically synthesized
atgggtggatagggggatgg

SEQ ID NO: 57914 - DNA, 20 bp, Artificial Sequence
  chemically synthesized
atagggggatggctgggtgg

SEQ ID NO: 57915 - DNA, 20 bp, Artificial Sequence
  chemically synthesized
tttcggtaagaactcaccac

SEQ ID NO: 57916 - DNA, 20 bp, Artificial Sequence
  chemically synthesized
cacctgggcagccgctgatt

SEQ ID NO: 57917 - DNA, 20 bp, Artificial Sequence
  chemically synthesized
tgattaagagttgtggcact

SEQ ID NO: 57918 - DNA, 20 bp, Artificial Sequence
  chemically synthesized
agagttgtggcactttggat

SEQ ID NO: 57919 - DNA, 20 bp, Artificial Sequence
  chemically synthesized
ctttggatagggataaacct

SEQ ID NO: 57920 - DNA, 20 bp, Artificial Sequence
  chemically synthesized
agggataaacctcagagtca

SEQ ID NO: 57921 - DNA, 20 bp, Artificial Sequence
  chemically synthesized
cagggaatgtttgggctgaa

SEQ ID NO: 57922 - DNA, 20 bp, Artificial Sequence
  chemically synthesized
acccatgtctgtaccaacca

SEQ ID NO: 57923 - DNA, 20 bp, Artificial Sequence
  chemically synthesized
cagaagatattcctactaca

SEQ ID NO: 57924 - DNA, 20 bp, Artificial Sequence
  chemically synthesized
tattcctactacagagaatt

SEQ ID NO: 57925 - DNA, 20 bp, Artificial Sequence
  chemically synthesized
gatcctcccacctcagccat

SEQ ID NO: 57926 - DNA, 20 bp, Artificial Sequence
  chemically synthesized
ctcgtatctttttgtagaga

SEQ ID NO: 57927 - DNA, 20 bp, Artificial Sequence
  chemically synthesized
gcctcagcctcctaaaatat

SEQ ID NO: 57928 - DNA, 20 bp, Artificial Sequence
  chemically synthesized
aagttaaaattcatatacac

SEQ ID NO: 57929 - DNA, 20 bp, Artificial Sequence
  chemically synthesized
ttttttttttttttttgaga

SEQ ID NO: 57930 - DNA, 20 bp, Artificial Sequence
  chemically synthesized
tctcgctctgttgcccaggc

SEQ ID NO: 57931 - DNA, 20 bp, Artificial Sequence
  chemically synthesized
ctcactgcaacctccgcttc

SEQ ID NO: 57932 - DNA, 20 bp, Artificial Sequence
  chemically synthesized
tattcttctgcctcagccta

SEQ ID NO: 57933 - DNA, 20 bp, Artificial Sequence
  chemically synthesized
ttttttatttttagtagaga

SEQ ID NO: 57934 - DNA, 20 bp, Artificial Sequence
  chemically synthesized
gcctcagcctcccaaagtgc

SEQ ID NO: 57935 - DNA, 20 bp, Artificial Sequence
  chemically synthesized
ttttttttttttttttgaga

SEQ ID NO: 57936 - DNA, 20 bp, Artificial Sequence
  chemically synthesized
tttgctcttgttgcccaggc

SEQ ID NO: 57937 - DNA, 20 bp, Artificial Sequence
  chemically synthesized
ctcactgtaacctccacctc

SEQ ID NO: 57938 - DNA, 20 bp, Artificial Sequence
  chemically synthesized
gcctcagcctctcaaatagc

SEQ ID NO: 57939 - DNA, 20 bp, Artificial Sequence
  chemically synthesized
aattttttttttagtagaga

SEQ ID NO: 57940 - DNA, 20 bp, Artificial Sequence
  chemically synthesized
acctcggcctcccaaagtgc

SEQ ID NO: 57941 - DNA, 20 bp, Artificial Sequence
  chemically synthesized
ttgatcttttttaaagagac

SEQ ID NO: 57942 - DNA, 20 bp, Artificial Sequence
  chemically synthesized
acctcggcctcccaaagtat

SEQ ID NO: 57943 - DNA, 20 bp, Artificial Sequence
  chemically synthesized
caacaggcatctttggactt

SEQ ID NO: 57944 - DNA, 20 bp, Artificial Sequence
  chemically synthesized
aggggctgttttctttgctg

SEQ ID NO: 57945 - DNA, 20 bp, Artificial Sequence
  chemically synthesized
gcctcttctgttgcaggtgc

SEQ ID NO: 57946 - DNA, 20 bp, Artificial Sequence
  chemically synthesized
cttgaatgtcattttgtggt

SEQ ID NO: 57947 - DNA, 20 bp, Artificial Sequence
  chemically synthesized
tgggattctgggctgtgcag

SEQ ID NO: 57948 - DNA, 20 bp, Artificial Sequence
  chemically synthesized
cagctgaatgtctgtctgtc

SEQ ID NO: 57949 - DNA, 20 bp, Artificial Sequence
  chemically synthesized
tttcctcatcaagttgttgc

SEQ ID NO: 57950 - DNA, 20 bp, Artificial Sequence
  chemically synthesized
tcagtactgttagcatttct

SEQ ID NO: 57951 - DNA, 20 bp, Artificial Sequence
  chemically synthesized
atttctgtgggttgaaagtc

SEQ ID NO: 57952 - DNA, 20 bp, Artificial Sequence
  chemically synthesized
ttgaaatgattaatttctat

SEQ ID NO: 57953 - DNA, 20 bp, Artificial Sequence
  chemically synthesized
tataagagtgcccagatcta

SEQ ID NO: 57954 - DNA, 20 bp, Artificial Sequence
  chemically synthesized
agagtgcccagatctataga

SEQ ID NO: 57955 - DNA, 20 bp, Artificial Sequence
  chemically synthesized
catcaaattaacgcaccaaa

SEQ ID NO: 57956 - DNA, 20 bp, Artificial Sequence
  chemically synthesized
aggccctaatttacttttca

SEQ ID NO: 57957 - DNA, 20 bp, Artificial Sequence
  chemically synthesized
gttgatctcttttataggtt

SEQ ID NO: 57958 - DNA, 20 bp, Artificial Sequence
  chemically synthesized
tcttttataggttcagagtt

SEQ ID NO: 57959 - DNA, 20 bp, Artificial Sequence
  chemically synthesized
tttgttttttttttttgaga

SEQ ID NO: 57960 - DNA, 20 bp, Artificial Sequence
  chemically synthesized
tctcgctctgtgacccaggc

SEQ ID NO: 57961 - DNA, 20 bp, Artificial Sequence
  chemically synthesized
ctcactgcaagctccacctc

SEQ ID NO: 57962 - DNA, 20 bp, Artificial Sequence
  chemically synthesized
attctcctgcctcagcctct

SEQ ID NO: 57963 - DNA, 20 bp, Artificial Sequence
  chemically synthesized
ttttgtatttttagcagaga

SEQ ID NO: 57964 - DNA, 20 bp, Artificial Sequence
  chemically synthesized
gcctcggcctcccaaagcgc

SEQ ID NO: 57965 - DNA, 20 bp, Artificial Sequence
  chemically synthesized
tcccaaagcgctgggattac

SEQ ID NO: 57966 - DNA, 20 bp, Artificial Sequence
  chemically synthesized
ggtgagccaccgcaccctgc

SEQ ID NO: 57967 - DNA, 20 bp, Artificial Sequence
  chemically synthesized
ttttcttagatccaattaac

SEQ ID NO: 57968 - DNA, 20 bp, Artificial Sequence
  chemically synthesized
aaagattttgtgggaggcac

SEQ ID NO: 57969 - DNA, 20 bp, Artificial Sequence
  chemically synthesized
ataagaccttaacaaaactg

SEQ ID NO: 57970 - DNA, 20 bp, Artificial Sequence
  chemically synthesized
gaacatagcagcattcaaag

SEQ ID NO: 57971 - DNA, 20 bp, Artificial Sequence
  chemically synthesized
aagtaacacagcatttagta

SEQ ID NO: 57972 - DNA, 20 bp, Artificial Sequence
  chemically synthesized
ccatatcacatgaaaaacct

SEQ ID NO: 57973 - DNA, 20 bp, Artificial Sequence
  chemically synthesized
ctgggaatgtttaggttaga

SEQ ID NO: 57974 - DNA, 20 bp, Artificial Sequence
  chemically synthesized
ataaaatggactgttatagt

SEQ ID NO: 57975 - DNA, 20 bp, Artificial Sequence
  chemically synthesized
ggggtgagctccctacctct

SEQ ID NO: 57976 - DNA, 20 bp, Artificial Sequence
  chemically synthesized
gatatggcacctccatctga

SEQ ID NO: 57977 - DNA, 20 bp, Artificial Sequence
  chemically synthesized
agtctatattgagggcaggc

SEQ ID NO: 57978 - DNA, 20 bp, Artificial Sequence
  chemically synthesized
ggcaggctggagtcacacat

SEQ ID NO: 57979 - DNA, 20 bp, Artificial Sequence
  chemically synthesized
tttaattccacagtcgcaga

SEQ ID NO: 57980 - DNA, 20 bp, Artificial Sequence
  chemically synthesized
cttcctgttcagcttcgcca

SEQ ID NO: 57981 - DNA, 20 bp, Artificial Sequence
  chemically synthesized
tttatctgctgctcaaggga

SEQ ID NO: 57982 - DNA, 20 bp, Artificial Sequence
  chemically synthesized
ccagaggtggtgcgagcagc

SEQ ID NO: 57983 - DNA, 20 bp, Artificial Sequence
  chemically synthesized
aggtggtgcgagcagccaga

SEQ ID NO: 57984 - DNA, 20 bp, Artificial Sequence
  chemically synthesized
tctacgtcttgtccttctgc

SEQ ID NO: 57985 - DNA, 20 bp, Artificial Sequence
  chemically synthesized
agaagtcgttgtaagagatg

SEQ ID NO: 57986 - DNA, 20 bp, Artificial Sequence
  chemically synthesized
ttaaagtcaacaaccatgcc

SEQ ID NO: 57987 - DNA, 20 bp, Artificial Sequence
  chemically synthesized
tgccatccattctgccgtcg

SEQ ID NO: 57988 - DNA, 20 bp, Artificial Sequence
  chemically synthesized
tgccgtcgtggaattaaatc

SEQ ID NO: 57989 - DNA, 20 bp, Artificial Sequence
  chemically synthesized
aaatcacggatggcagattg

SEQ ID NO: 57990 - DNA, 20 bp, Artificial Sequence
  chemically synthesized
ggaggtcctcctctctctac

SEQ ID NO: 57991 - DNA, 20 bp, Artificial Sequence
  chemically synthesized
tggaacagcccattttatct

SEQ ID NO: 57992 - DNA, 20 bp, Artificial Sequence
  chemically synthesized
cttttacaatcctaatcata

SEQ ID NO: 57993 - DNA, 20 bp, Artificial Sequence
  chemically synthesized
gaaagacctgttgctagaag

SEQ ID NO: 57994 - DNA, 20 bp, Artificial Sequence
  chemically synthesized
ttgctagaagttgggttgtt

SEQ ID NO: 57995 - DNA, 20 bp, Artificial Sequence
  chemically synthesized
ccaggctggagatcctaact

SEQ ID NO: 57996 - DNA, 20 bp, Artificial Sequence
  chemically synthesized
gagaaaaggagaaaggagct

SEQ ID NO: 57997 - DNA, 20 bp, Artificial Sequence
  chemically synthesized
gaaaagaaggctgcctaagg

SEQ ID NO: 57998 - DNA, 20 bp, Artificial Sequence
  chemically synthesized
tataattaatagatggttag

SEQ ID NO: 57999 - DNA, 20 bp, Artificial Sequence
  chemically synthesized
tacatgttcatcgtatttcc

SEQ ID NO: 58000 - DNA, 20 bp, Artificial Sequence
  chemically synthesized
catcgtatttccttggattt

SEQ ID NO: 58001 - DNA, 20 bp, Artificial Sequence
  chemically synthesized
ctggctccacatccacccca

SEQ ID NO: 58002 - DNA, 20 bp, Artificial Sequence
  chemically synthesized
caaaatgacaaggggagggc

SEQ ID NO: 58003 - DNA, 20 bp, Artificial Sequence
  chemically synthesized
agtgttacttttaattccta

SEQ ID NO: 58004 - DNA, 20 bp, Artificial Sequence
  chemically synthesized
ctttttttttttttttgaga

SEQ ID NO: 58005 - DNA, 20 bp, Artificial Sequence
  chemically synthesized
ctatgttgcccaggctgctc

SEQ ID NO: 58006 - DNA, 20 bp, Artificial Sequence
  chemically synthesized
ggcgcacctatcacccaggc

SEQ ID NO: 58007 - DNA, 20 bp, Artificial Sequence
  chemically synthesized
acctatcacccaggctggag

SEQ ID NO: 58008 - DNA, 20 bp, Artificial Sequence
  chemically synthesized
caggctaatttttatatttt

SEQ ID NO: 58009 - DNA, 20 bp, Artificial Sequence
  chemically synthesized
ttttagaattttagaagaga

SEQ ID NO: 58010 - DNA, 20 bp, Artificial Sequence
  chemically synthesized
gccttggcctcccaaggtgc

SEQ ID NO: 58011 - DNA, 20 bp, Artificial Sequence
  chemically synthesized
tttcaatctcatctgatatg

SEQ ID NO: 58012 - DNA, 20 bp, Artificial Sequence
  chemically synthesized
attaaagcaacattttattt

SEQ ID NO: 58013 - DNA, 20 bp, Artificial Sequence
  chemically synthesized
gagaagaaaagtgctctctc

SEQ ID NO: 58014 - DNA, 20 bp, Artificial Sequence
  chemically synthesized
tgctctctcttgagttgacc

SEQ ID NO: 58015 - DNA, 20 bp, Artificial Sequence
  chemically synthesized
agttgaccgagagtcccatt

SEQ ID NO: 58016 - DNA, 20 bp, Artificial Sequence
  chemically synthesized
tgcatccacaggggcacagg

SEQ ID NO: 58017 - DNA, 20 bp, Artificial Sequence
  chemically synthesized
agcatagaaccagaaagatt

SEQ ID NO: 58018 - DNA, 20 bp, Artificial Sequence
  chemically synthesized
agaaagattcagagttggcc

SEQ ID NO: 58019 - DNA, 20 bp, Artificial Sequence
  chemically synthesized
ctaccagaccacaagtcagc

SEQ ID NO: 58020 - DNA, 20 bp, Artificial Sequence
  chemically synthesized
atggcatcaaattgcaactt

SEQ ID NO: 58021 - DNA, 20 bp, Artificial Sequence
  chemically synthesized
gcaacttgagagtagatggg

SEQ ID NO: 58022 - DNA, 20 bp, Artificial Sequence
  chemically synthesized
caacaagactaggccagctc

SEQ ID NO: 58023 - DNA, 20 bp, Artificial Sequence
  chemically synthesized
aactcagtgtcagcaaggtt

SEQ ID NO: 58024 - DNA, 20 bp, Artificial Sequence
  chemically synthesized
cagagccagtcacagcacca

SEQ ID NO: 58025 - DNA, 20 bp, Artificial Sequence
  chemically synthesized
gctaagagatttatttcatc

SEQ ID NO: 58026 - DNA, 20 bp, Artificial Sequence
  chemically synthesized
gatttatttcatcctgggtg

SEQ ID NO: 58027 - DNA, 20 bp, Artificial Sequence
  chemically synthesized
ctcaaatcatcaccgtatca

SEQ ID NO: 58028 - DNA, 20 bp, Artificial Sequence
  chemically synthesized
accgtatcaatggatttcct

SEQ ID NO: 58029 - DNA, 20 bp, Artificial Sequence
  chemically synthesized
gctatttcacacctgaactc

SEQ ID NO: 58030 - DNA, 20 bp, Artificial Sequence
  chemically synthesized
gggaagattgcattctccta

SEQ ID NO: 58031 - DNA, 20 bp, Artificial Sequence
  chemically synthesized
tgtgggaaccaggcccctca

SEQ ID NO: 58032 - DNA, 20 bp, Artificial Sequence
  chemically synthesized
tttttttttttaatagagat

SEQ ID NO: 58033 - DNA, 20 bp, Artificial Sequence
  chemically synthesized
cccaggctggtcttgaactc

SEQ ID NO: 58034 - DNA, 20 bp, Artificial Sequence
  chemically synthesized
gcctcagcctcccaaagtgc

SEQ ID NO: 58035 - DNA, 20 bp, Artificial Sequence
  chemically synthesized
aacataacagataaagttta

SEQ ID NO: 58036 - DNA, 20 bp, Artificial Sequence
  chemically synthesized
ttagttctcccaacatctct

SEQ ID NO: 58037 - DNA, 20 bp, Artificial Sequence
  chemically synthesized
tatattacaaataggtccag

SEQ ID NO: 58038 - DNA, 20 bp, Artificial Sequence
  chemically synthesized
gaggggttagtcatcttgtc

SEQ ID NO: 58039 - DNA, 20 bp, Artificial Sequence
  chemically synthesized
cagaatggtggaaccaggtt

SEQ ID NO: 58040 - DNA, 20 bp, Artificial Sequence
  chemically synthesized
gtggcagattgcctgagctc

SEQ ID NO: 58041 - DNA, 20 bp, Artificial Sequence
  chemically synthesized
tactcaggtggctgaggtgg

SEQ ID NO: 58042 - DNA, 20 bp, Artificial Sequence
  chemically synthesized
ttatgccactgcactccagc

SEQ ID NO: 58043 - DNA, 20 bp, Artificial Sequence
  chemically synthesized
ctgcactccagcctgggtga

SEQ ID NO: 58044 - DNA, 20 bp, Artificial Sequence
  chemically synthesized
aaagaagcaagcagtctggg

SEQ ID NO: 58045 - DNA, 20 bp, Artificial Sequence
  chemically synthesized
catgttatggcataatttgg

SEQ ID NO: 58046 - DNA, 20 bp, Artificial Sequence
  chemically synthesized
agttttcaggtggtaggctt

SEQ ID NO: 58047 - DNA, 20 bp, Artificial Sequence
  chemically synthesized
ttttattttattatttgaga

SEQ ID NO: 58048 - DNA, 20 bp, Artificial Sequence
  chemically synthesized
tctcactctgtcacccaggc

SEQ ID NO: 58049 - DNA, 20 bp, Artificial Sequence
  chemically synthesized
gatcctccagcctcagcctc

SEQ ID NO: 58050 - DNA, 20 bp, Artificial Sequence
  chemically synthesized
ttttttattttttgtagaga

SEQ ID NO: 58051 - DNA, 20 bp, Artificial Sequence
  chemically synthesized
gccttagcctcccaaagtgc

SEQ ID NO: 58052 - DNA, 20 bp, Artificial Sequence
  chemically synthesized
caggcagatcacctgagatc

SEQ ID NO: 58053 - DNA, 20 bp, Artificial Sequence
  chemically synthesized
tgcactccaacctgggcaac

SEQ ID NO: 58054 - DNA, 20 bp, Artificial Sequence
  chemically synthesized
tcatttaaagtgtacaattc

SEQ ID NO: 58055 - DNA, 20 bp, Artificial Sequence
  chemically synthesized
gacaagtaatattccattgt

SEQ ID NO: 58056 - DNA, 20 bp, Artificial Sequence
  chemically synthesized
gtatgaatatataacattgt

SEQ ID NO: 58057 - DNA, 20 bp, Artificial Sequence
  chemically synthesized
actttgggaggctgaggcag

SEQ ID NO: 58058 - DNA, 20 bp, Artificial Sequence
  chemically synthesized
gcctcagcctcccaaagtgc

SEQ ID NO: 58059 - DNA, 20 bp, Artificial Sequence
  chemically synthesized
aatgttatatattcatacaa

SEQ ID NO: 58060 - DNA, 20 bp, Artificial Sequence
  chemically synthesized
cacaaaaggccacatattgt

SEQ ID NO: 58061 - DNA, 20 bp, Artificial Sequence
  chemically synthesized
agattagtggttgcctaggc

SEQ ID NO: 58062 - DNA, 20 bp, Artificial Sequence
  chemically synthesized
tagtggttgcctaggcttga

SEQ ID NO: 58063 - DNA, 20 bp, Artificial Sequence
  chemically synthesized
ttgcctaggcttgagtgggt

SEQ ID NO: 58064 - DNA, 20 bp, Artificial Sequence
  chemically synthesized
taggcttgagtgggttggag

SEQ ID NO: 58065 - DNA, 20 bp, Artificial Sequence
  chemically synthesized
ttggagtggaatgaaaaccc

SEQ ID NO: 58066 - DNA, 20 bp, Artificial Sequence
  chemically synthesized
ccctgaattgtacactttaa

SEQ ID NO: 58067 - DNA, 20 bp, Artificial Sequence
  chemically synthesized
gaattgtacactttaaatga

SEQ ID NO: 58068 - DNA, 20 bp, Artificial Sequence
  chemically synthesized
tgagtgaattgtatggtatt

SEQ ID NO: 58069 - DNA, 20 bp, Artificial Sequence
  chemically synthesized
agctttttttttttttgaga

SEQ ID NO: 58070 - DNA, 20 bp, Artificial Sequence
  chemically synthesized
ttcactcttgttgcccaggt

SEQ ID NO: 58071 - DNA, 20 bp, Artificial Sequence
  chemically synthesized
gtctcagcctctcaagtagc

SEQ ID NO: 58072 - DNA, 20 bp, Artificial Sequence
  chemically synthesized
gccttggcttcccaaagtgc

SEQ ID NO: 58073 - DNA, 20 bp, Artificial Sequence
  chemically synthesized
gttaaaaatcaaaaacatgg

SEQ ID NO: 58074 - DNA, 20 bp, Artificial Sequence
  chemically synthesized
actttgggaggctaaggcgg

SEQ ID NO: 58075 - DNA, 20 bp, Artificial Sequence
  chemically synthesized
tattcgggaggctgaggctg

SEQ ID NO: 58076 - DNA, 20 bp, Artificial Sequence
  chemically synthesized
tggaggatcatttgagcccc

SEQ ID NO: 58077 - DNA, 20 bp, Artificial Sequence
  chemically synthesized
ttgcgccattgcaccccagc

SEQ ID NO: 58078 - DNA, 20 bp, Artificial Sequence
  chemically synthesized
ttgcaccccagcctgggtga

SEQ ID NO: 58079 - DNA, 20 bp, Artificial Sequence
  chemically synthesized
gcagaagttggacttcctta

SEQ ID NO: 58080 - DNA, 20 bp, Artificial Sequence
  chemically synthesized
ctattttctttgggcaataa

SEQ ID NO: 58081 - DNA, 20 bp, Artificial Sequence
  chemically synthesized
atctataacttagggaacag

SEQ ID NO: 58082 - DNA, 20 bp, Artificial Sequence
  chemically synthesized
aaaatgttctgtctaataag

SEQ ID NO: 58083 - DNA, 20 bp, Artificial Sequence
  chemically synthesized
caaaatgattattttgtatc

SEQ ID NO: 58084 - DNA, 20 bp, Artificial Sequence
  chemically synthesized
ttttttttttttttctgaga

SEQ ID NO: 58085 - DNA, 20 bp, Artificial Sequence
  chemically synthesized
tctcactctgtcacccaggc

SEQ ID NO: 58086 - DNA, 20 bp, Artificial Sequence
  chemically synthesized
cactgcaacctctgagctca

SEQ ID NO: 58087 - DNA, 20 bp, Artificial Sequence
  chemically synthesized
gattctcccacctcagccac

SEQ ID NO: 58088 - DNA, 20 bp, Artificial Sequence
  chemically synthesized
tttgtatttttggtatagac

SEQ ID NO: 58089 - DNA, 20 bp, Artificial Sequence
  chemically synthesized
acctcagcctcccaaagtgc

SEQ ID NO: 58090 - DNA, 20 bp, Artificial Sequence
  chemically synthesized
tctggacctatttgtaatat

SEQ ID NO: 58091 - DNA, 20 bp, Artificial Sequence
  chemically synthesized
agagatgttgggagaactaa

SEQ ID NO: 58092 - DNA, 20 bp, Artificial Sequence
  chemically synthesized
tataaataaagtacatagaa

SEQ ID NO: 58093 - DNA, 20 bp, Artificial Sequence
  chemically synthesized
tatcaacctcataaacttca

SEQ ID NO: 58094 - DNA, 20 bp, Artificial Sequence
  chemically synthesized
ttctggcagacctttcttgt

SEQ ID NO: 58095 - DNA, 20 bp, Artificial Sequence
  chemically synthesized
ttgggagcaaatagattatc

SEQ ID NO: 58096 - DNA, 20 bp, Artificial Sequence
  chemically synthesized
atggggctatgcctaagcag

SEQ ID NO: 58097 - DNA, 20 bp, Artificial Sequence
  chemically synthesized
actttgggaggctgaggcag

SEQ ID NO: 58098 - DNA, 20 bp, Artificial Sequence
  chemically synthesized
caggaggatcacttgaaccc

SEQ ID NO: 58099 - DNA, 20 bp, Artificial Sequence
  chemically synthesized
tgagagcccaaatccagtag

SEQ ID NO: 58100 - DNA, 20 bp, Artificial Sequence
  chemically synthesized
gtaggagaatgcaatcttcc

SEQ ID NO: 58101 - DNA, 20 bp, Artificial Sequence
  chemically synthesized
ttccctgaatatacagactc

SEQ ID NO: 58102 - DNA, 20 bp, Artificial Sequence
  chemically synthesized
tggaggtcgaaccctgcacc

SEQ ID NO: 58103 - DNA, 20 bp, Artificial Sequence
  chemically synthesized
aacccaaaaccttgctgaca

SEQ ID NO: 58104 - DNA, 20 bp, Artificial Sequence
  chemically synthesized
accttgctgacactgagtta

SEQ ID NO: 58105 - DNA, 20 bp, Artificial Sequence
  chemically synthesized
atgttcattcttggccaact

SEQ ID NO: 58106 - DNA, 20 bp, Artificial Sequence
  chemically synthesized
tcaactctgcctgtgcccct

SEQ ID NO: 58107 - DNA, 20 bp, Artificial Sequence
  chemically synthesized
agctagaaatttagttgggc

SEQ ID NO: 58108 - DNA, 20 bp, Artificial Sequence
  chemically synthesized
cttttcaaagatgttatgag

SEQ ID NO: 58109 - DNA, 20 bp, Artificial Sequence
  chemically synthesized
ttatgagcaggatggttgtt

SEQ ID NO: 58110 - DNA, 20 bp, Artificial Sequence
  chemically synthesized
ataggcttcagctttttttg

SEQ ID NO: 58111 - DNA, 20 bp, Artificial Sequence
  chemically synthesized
cagctttttttggggggtag

SEQ ID NO: 58112 - DNA, 20 bp, Artificial Sequence
  chemically synthesized
accttgggaggccaaggcag

SEQ ID NO: 58113 - DNA, 20 bp, Artificial Sequence
  chemically synthesized
caggtggatcacttgaggtc

SEQ ID NO: 58114 - DNA, 20 bp, Artificial Sequence
  chemically synthesized
tactgaggaggctgagacat

SEQ ID NO: 58115 - DNA, 20 bp, Artificial Sequence
  chemically synthesized
tcgtgccactccactccagc

SEQ ID NO: 58116 - DNA, 20 bp, Artificial Sequence
  chemically synthesized
aaaaagaaaagcaggcaagg

SEQ ID NO: 58117 - DNA, 20 bp, Artificial Sequence
  chemically synthesized
agctacgcgggacgctgtgg

SEQ ID NO: 58118 - DNA, 20 bp, Artificial Sequence
  chemically synthesized
tgggaggactgcttgagccc

SEQ ID NO: 58119 - DNA, 20 bp, Artificial Sequence
  chemically synthesized
aagatgttgacttttccttt

SEQ ID NO: 58120 - DNA, 20 bp, Artificial Sequence
  chemically synthesized
gaatgtgctcttggttggct

SEQ ID NO: 58121 - DNA, 20 bp, Artificial Sequence
  chemically synthesized
ggttggcttgggatagagaa

SEQ ID NO: 58122 - DNA, 20 bp, Artificial Sequence
  chemically synthesized
aggagtcatatttaccctct

SEQ ID NO: 58123 - DNA, 20 bp, Artificial Sequence
  chemically synthesized
ctaggaattaaaagtaacac

SEQ ID NO: 58124 - DNA, 20 bp, Artificial Sequence
  chemically synthesized
acactggagtgacctgagag

SEQ ID NO: 58125 - DNA, 20 bp, Artificial Sequence
  chemically synthesized
gaaacatacaaaagcaccac

SEQ ID NO: 58126 - DNA, 20 bp, Artificial Sequence
  chemically synthesized
ctagccttctgaagatccag

SEQ ID NO: 58127 - DNA, 20 bp, Artificial Sequence
  chemically synthesized
ccttctgaagatccagtggg

SEQ ID NO: 58128 - DNA, 20 bp, Artificial Sequence
  chemically synthesized
ggtggatgtggagccagtgg

SEQ ID NO: 58129 - DNA, 20 bp, Artificial Sequence
  chemically synthesized
agcagagctgggcttataag

SEQ ID NO: 58130 - DNA, 20 bp, Artificial Sequence
  chemically synthesized
agaggagatgtcagctatac

SEQ ID NO: 58131 - DNA, 20 bp, Artificial Sequence
  chemically synthesized
gttttgacctagtgcaatat

SEQ ID NO: 58132 - DNA, 20 bp, Artificial Sequence
  chemically synthesized
agtaaaaaaaatactagaag

SEQ ID NO: 58133 - DNA, 20 bp, Artificial Sequence
  chemically synthesized
taagctggtcccccattact

SEQ ID NO: 58134 - DNA, 20 bp, Artificial Sequence
  chemically synthesized
tcctttctccttttctcggt

SEQ ID NO: 58135 - DNA, 20 bp, Artificial Sequence
  chemically synthesized
acaggtagaaaattctcagt

SEQ ID NO: 58136 - DNA, 20 bp, Artificial Sequence
  chemically synthesized
tgcttttgtatatgtgacgg

SEQ ID NO: 58137 - DNA, 20 bp, Artificial Sequence
  chemically synthesized
aaaacattacccaatatgat

SEQ ID NO: 58138 - DNA, 20 bp, Artificial Sequence
  chemically synthesized
ataaaatgggctgttccagt

SEQ ID NO: 58139 - DNA, 20 bp, Artificial Sequence
  chemically synthesized
ggagtgagctccctacttgt

SEQ ID NO: 58140 - DNA, 20 bp, Artificial Sequence
  chemically synthesized
gatatggcacctccatctga

SEQ ID NO: 58141 - DNA, 20 bp, Artificial Sequence
  chemically synthesized
agtctgtgctgagggcaggc

SEQ ID NO: 58142 - DNA, 20 bp, Artificial Sequence
  chemically synthesized
ggcaggctggagtcacacat

SEQ ID NO: 58143 - DNA, 20 bp, Artificial Sequence
  chemically synthesized
gtgatttaattccacgacgg

SEQ ID NO: 58144 - DNA, 20 bp, Artificial Sequence
  chemically synthesized
tttaattccacgacggcaga

SEQ ID NO: 58145 - DNA, 20 bp, Artificial Sequence
  chemically synthesized
aggacctgggcgaggcagta

SEQ ID NO: 58146 - DNA, 20 bp, Artificial Sequence
  chemically synthesized
ggcagtaggggatgacactg

SEQ ID NO: 58147 - DNA, 20 bp, Artificial Sequence
  chemically synthesized
cgtagaagaccagctcgact

SEQ ID NO: 58148 - DNA, 20 bp, Artificial Sequence
  chemically synthesized
agaccagctcgacttgggat

SEQ ID NO: 58149 - DNA, 20 bp, Artificial Sequence
  chemically synthesized
gacttgggatgggggtttca

SEQ ID NO: 58150 - DNA, 20 bp, Artificial Sequence
  chemically synthesized
aggctacaatagagctgagg

SEQ ID NO: 58151 - DNA, 20 bp, Artificial Sequence
  chemically synthesized
ggcggaatgggagccacttg

SEQ ID NO: 58152 - DNA, 20 bp, Artificial Sequence
  chemically synthesized
gcagctctccctgtacatgc

SEQ ID NO: 58153 - DNA, 20 bp, Artificial Sequence
  chemically synthesized
ggttcttgaggaggctggca

SEQ ID NO: 58154 - DNA, 20 bp, Artificial Sequence
  chemically synthesized
caccacctctgggctttctc

SEQ ID NO: 58155 - DNA, 20 bp, Artificial Sequence
  chemically synthesized
aggctggcattatagatgct

SEQ ID NO: 58156 - DNA, 20 bp, Artificial Sequence
  chemically synthesized
agtttctgcaacagcaatgc

SEQ ID NO: 58157 - DNA, 20 bp, Artificial Sequence
  chemically synthesized
gcatgactgtgagagatagg

SEQ ID NO: 58158 - DNA, 20 bp, Artificial Sequence
  chemically synthesized
atttgggacctttgctagag

SEQ ID NO: 58159 - DNA, 20 bp, Artificial Sequence
  chemically synthesized
tttgctagaggtgggtttgg

SEQ ID NO: 58160 - DNA, 20 bp, Artificial Sequence
  chemically synthesized
ctagaggtgggtttggagga

SEQ ID NO: 58161 - DNA, 20 bp, Artificial Sequence
  chemically synthesized
tgccatccgttctgcgactg

SEQ ID NO: 58162 - DNA, 20 bp, Artificial Sequence
  chemically synthesized
aaatcacagatggcagatgg

SEQ ID NO: 58163 - DNA, 20 bp, Artificial Sequence
  chemically synthesized
cagtccattttatctttgaa

SEQ ID NO: 58164 - DNA, 20 bp, Artificial Sequence
  chemically synthesized
tctttgaacggaattgattg

SEQ ID NO: 58165 - DNA, 20 bp, Artificial Sequence
  chemically synthesized
tttttctcagttctttctgc

SEQ ID NO: 58166 - DNA, 20 bp, Artificial Sequence
  chemically synthesized
tctgcaggagttagtaagtg

SEQ ID NO: 58167 - DNA, 20 bp, Artificial Sequence
  chemically synthesized
cttgttctcaacattcttct

SEQ ID NO: 58168 - DNA, 20 bp, Artificial Sequence
  chemically synthesized
tcttgtcttacccttgttaa

SEQ ID NO: 58169 - DNA, 20 bp, Artificial Sequence
  chemically synthesized
taagaaaacacatattcagg

SEQ ID NO: 58170 - DNA, 20 bp, Artificial Sequence
  chemically synthesized
gctttgggaggccgaggcgg

SEQ ID NO: 58171 - DNA, 20 bp, Artificial Sequence
  chemically synthesized
actcggagaggctgaggcag

SEQ ID NO: 58172 - DNA, 20 bp, Artificial Sequence
  chemically synthesized
tcgcaccactgcactctagc

SEQ ID NO: 58173 - DNA, 20 bp, Artificial Sequence
  chemically synthesized
gttatctattaggtttgcaa

SEQ ID NO: 58174 - DNA, 20 bp, Artificial Sequence
  chemically synthesized
ctaacagtactgattacaca

SEQ ID NO: 58175 - DNA, 20 bp, Artificial Sequence
  chemically synthesized
gattacacacaggatgtggc

SEQ ID NO: 58176 - DNA, 20 bp, Artificial Sequence
  chemically synthesized
acaggatgtggctggaatgc

SEQ ID NO: 58177 - DNA, 20 bp, Artificial Sequence
  chemically synthesized
gtcctgattagggagagaaa

SEQ ID NO: 58178 - DNA, 20 bp, Artificial Sequence
  chemically synthesized
gattagggagagaaacggaa

SEQ ID NO: 58179 - DNA, 20 bp, Artificial Sequence
  chemically synthesized
ggggtttgggggagaaggaa

SEQ ID NO: 58180 - DNA, 20 bp, Artificial Sequence
  chemically synthesized
agacattcagctgcacagcc

SEQ ID NO: 58181 - DNA, 20 bp, Artificial Sequence
  chemically synthesized
gcaaacttaggtgctctcag

SEQ ID NO: 58182 - DNA, 20 bp, Artificial Sequence
  chemically synthesized
ccaaagatgcctgttggggg

SEQ ID NO: 58183 - DNA, 20 bp, Artificial Sequence
  chemically synthesized
actttgggaggccgaggtga

SEQ ID NO: 58184 - DNA, 20 bp, Artificial Sequence
  chemically synthesized
tgagaggatcacttgaggcc

SEQ ID NO: 58185 - DNA, 20 bp, Artificial Sequence
  chemically synthesized
cagcactttgggaggccgag

SEQ ID NO: 58186 - DNA, 20 bp, Artificial Sequence
  chemically synthesized
actttgggaggccgaggtgg

SEQ ID NO: 58187 - DNA, 20 bp, Artificial Sequence
  chemically synthesized
tgggtggatcacttgaggtc

SEQ ID NO: 58188 - DNA, 20 bp, Artificial Sequence
  chemically synthesized
aaattacaaaattagccagg

SEQ ID NO: 58189 - DNA, 20 bp, Artificial Sequence
  chemically synthesized
tatttgagaggctgaggcag

SEQ ID NO: 58190 - DNA, 20 bp, Artificial Sequence
  chemically synthesized
cagcactttgggaggctgag

SEQ ID NO: 58191 - DNA, 20 bp, Artificial Sequence
  chemically synthesized
actttgggaggctgaggcgg

SEQ ID NO: 58192 - DNA, 20 bp, Artificial Sequence
  chemically synthesized
ggcggatggatcactaggtc

SEQ ID NO: 58193 - DNA, 20 bp, Artificial Sequence
  chemically synthesized
tactcggtaggctgaggcag

SEQ ID NO: 58194 - DNA, 20 bp, Artificial Sequence
  chemically synthesized
agtggttaacccttgtgtat

SEQ ID NO: 58195 - DNA, 20 bp, Artificial Sequence
  chemically synthesized
attttatctgtttgataatt

SEQ ID NO: 58196 - DNA, 20 bp, Artificial Sequence
  chemically synthesized
aaaaagatacgagaaattag

SEQ ID NO: 58197 - DNA, 20 bp, Artificial Sequence
  chemically synthesized
tactcagatggctgaggtgg

SEQ ID NO: 58198 - DNA, 20 bp, Artificial Sequence
  chemically synthesized
tcgtgccactgcacttcagc

SEQ ID NO: 58199 - DNA, 20 bp, Artificial Sequence
  chemically synthesized
atctcaaaaataaaaataaa

SEQ ID NO: 58200 - DNA, 20 bp, Artificial Sequence
  chemically synthesized
ttgcactgtggctgcacacc

SEQ ID NO: 58201 - DNA, 20 bp, Artificial Sequence
  chemically synthesized
cacccggaattctctgtagt

SEQ ID NO: 58202 - DNA, 20 bp, Artificial Sequence
  chemically synthesized
gtttctctggttattttaac

SEQ ID NO: 58203 - DNA, 20 bp, Artificial Sequence
  chemically synthesized
ctctggttattttaacctgg

SEQ ID NO: 58204 - DNA, 20 bp, Artificial Sequence
  chemically synthesized
actctgtggttggtacagac

SEQ ID NO: 58205 - DNA, 20 bp, Artificial Sequence
  chemically synthesized
gtttccttatctgtaaaaca

SEQ ID NO: 58206 - DNA, 20 bp, Artificial Sequence
  chemically synthesized
taaaacaacggattgcacta

SEQ ID NO: 58207 - DNA, 20 bp, Artificial Sequence
  chemically synthesized
caggtgtgggagcgggctag

SEQ ID NO: 58208 - DNA, 20 bp, Artificial Sequence
  chemically synthesized
cgggctagggggatgtgagg

SEQ ID NO: 58209 - DNA, 20 bp, Artificial Sequence
  chemically synthesized
ccaccacctacaccccagtg

SEQ ID NO: 58210 - DNA, 20 bp, Artificial Sequence
  chemically synthesized
atctttccctgaaagatgga

SEQ ID NO: 58211 - DNA, 20 bp, Artificial Sequence
  chemically synthesized
gctccctaaagggcaggaaa

SEQ ID NO: 58212 - DNA, 20 bp, Artificial Sequence
  chemically synthesized
ctaaagggcaggaaagagaa

SEQ ID NO: 58213 - DNA, 20 bp, Artificial Sequence
  chemically synthesized
caagcattgtgcaaggctct

SEQ ID NO: 58214 - DNA, 20 bp, Artificial Sequence
  chemically synthesized
tacagtctggagattacaca

SEQ ID NO: 58215 - DNA, 20 bp, Artificial Sequence
  chemically synthesized
actcagatctcatattctca

SEQ ID NO: 58216 - DNA, 20 bp, Artificial Sequence
  chemically synthesized
aatcctcccacctcagcccc

SEQ ID NO: 58217 - DNA, 20 bp, Artificial Sequence
  chemically synthesized
cccttggcctcccaaagtgt

SEQ ID NO: 58218 - DNA, 20 bp, Artificial Sequence
  chemically synthesized
ttcctctaccctgagagata

SEQ ID NO: 58219 - DNA, 20 bp, Artificial Sequence
  chemically synthesized
ggacttatttcgtagctgtt

SEQ ID NO: 58220 - DNA, 20 bp, Artificial Sequence
  chemically synthesized
tggcattgccctgggctaaa

SEQ ID NO: 58221 - DNA, 20 bp, Artificial Sequence
  chemically synthesized
gatcaaggttacgctctccc

SEQ ID NO: 58222 - DNA, 20 bp, Artificial Sequence
  chemically synthesized
cccagcttcagagctcgctg

SEQ ID NO: 58223 - DNA, 20 bp, Artificial Sequence
  chemically synthesized
cttcagagctcgctgtgggg

SEQ ID NO: 58224 - DNA, 20 bp, Artificial Sequence
  chemically synthesized
cgctgtggggttggatgagg

SEQ ID NO: 58225 - DNA, 20 bp, Artificial Sequence
  chemically synthesized
cttctacaagtatagttccc

SEQ ID NO: 58226 - DNA, 20 bp, Artificial Sequence
  chemically synthesized
gagtatctaaactcctgcac

SEQ ID NO: 58227 - DNA, 20 bp, Artificial Sequence
  chemically synthesized
aacactaacaattatatacc

SEQ ID NO: 58228 - DNA, 20 bp, Artificial Sequence
  chemically synthesized
cttttttttttttttcctga

SEQ ID NO: 58229 - DNA, 20 bp, Artificial Sequence
  chemically synthesized
tctttctctgtcaccaaggc

SEQ ID NO: 58230 - DNA, 20 bp, Artificial Sequence
  chemically synthesized
ctcactgcaacctctgcctc

SEQ ID NO: 58231 - DNA, 20 bp, Artificial Sequence
  chemically synthesized
gattctcctgccgcagcctc

SEQ ID NO: 58232 - DNA, 20 bp, Artificial Sequence
  chemically synthesized
gccgcagcctcctgggtagc

SEQ ID NO: 58233 - DNA, 20 bp, Artificial Sequence
  chemically synthesized
gcgttggcctcccaaagtgc

SEQ ID NO: 58234 - DNA, 20 bp, Artificial Sequence
  chemically synthesized
tctcattttgtcgcccaggc

SEQ ID NO: 58235 - DNA, 20 bp, Artificial Sequence
  chemically synthesized
gattctcctgccttagcctc

SEQ ID NO: 58236 - DNA, 20 bp, Artificial Sequence
  chemically synthesized
ttttgtatttttagtagaga

SEQ ID NO: 58237 - DNA, 20 bp, Artificial Sequence
  chemically synthesized
gcctcagcctcccaaagtgc

SEQ ID NO: 58238 - DNA, 20 bp, Artificial Sequence
  chemically synthesized
ctcccaaagtgctgggatta

SEQ ID NO: 58239 - DNA, 20 bp, Artificial Sequence
  chemically synthesized
agtttactttttttttgaga

SEQ ID NO: 58240 - DNA, 20 bp, Artificial Sequence
  chemically synthesized
tctcgttctgtcattcaggc

SEQ ID NO: 58241 - DNA, 20 bp, Artificial Sequence
  chemically synthesized
ttttccatttttagtaaaga

SEQ ID NO: 58242 - DNA, 20 bp, Artificial Sequence
  chemically synthesized
accttggcttcccaaagtgc

SEQ ID NO: 58243 - DNA, 20 bp, Artificial Sequence
  chemically synthesized
gatttcagctccacaagggc

SEQ ID NO: 58244 - DNA, 20 bp, Artificial Sequence
  chemically synthesized
aggtgcttggtaagtaacag

SEQ ID NO: 58245 - DNA, 20 bp, Artificial Sequence
  chemically synthesized
gcttggtaagtaacagctga

SEQ ID NO: 58246 - DNA, 20 bp, Artificial Sequence
  chemically synthesized
ggtaagtaacagctgaatga

SEQ ID NO: 58247 - DNA, 20 bp, Artificial Sequence
  chemically synthesized
taagggaccttccctagttt

SEQ ID NO: 58248 - DNA, 20 bp, Artificial Sequence
  chemically synthesized
cctagttttggggtcaggga

SEQ ID NO: 58249 - DNA, 20 bp, Artificial Sequence
  chemically synthesized
agggaaagggtctctgagga

SEQ ID NO: 58250 - DNA, 20 bp, Artificial Sequence
  chemically synthesized
gaagggatactagtacctta

SEQ ID NO: 58251 - DNA, 20 bp, Artificial Sequence
  chemically synthesized
ttagagggcagctgagactt

SEQ ID NO: 58252 - DNA, 20 bp, Artificial Sequence
  chemically synthesized
acgtaggcacagagagggca

SEQ ID NO: 58253 - DNA, 20 bp, Artificial Sequence
  chemically synthesized
ctctcacgagccctttgccc

SEQ ID NO: 58254 - DNA, 20 bp, Artificial Sequence
  chemically synthesized
ttcaggaaagtattgcagaa

SEQ ID NO: 58255 - DNA, 20 bp, Artificial Sequence
  chemically synthesized
agagcatgacaaaagtacaa

SEQ ID NO: 58256 - DNA, 20 bp, Artificial Sequence
  chemically synthesized
cagtatggacgctgtccaaa

SEQ ID NO: 58257 - DNA, 20 bp, Artificial Sequence
  chemically synthesized
ggaaaaacagaacaagtttc

SEQ ID NO: 58258 - DNA, 20 bp, Artificial Sequence
  chemically synthesized
agaacaagtttctggggtta

SEQ ID NO: 58259 - DNA, 20 bp, Artificial Sequence
  chemically synthesized
caagtttctggggttactga

SEQ ID NO: 58260 - DNA, 20 bp, Artificial Sequence
  chemically synthesized
ccaaagcctacaccttcaag

SEQ ID NO: 58261 - DNA, 20 bp, Artificial Sequence
  chemically synthesized
caagaagagtgtagcctgag

SEQ ID NO: 58262 - DNA, 20 bp, Artificial Sequence
  chemically synthesized
gttgcctctagaagggagaa

SEQ ID NO: 58263 - DNA, 20 bp, Artificial Sequence
  chemically synthesized
acttttgcattttgaactgt

SEQ ID NO: 58264 - DNA, 20 bp, Artificial Sequence
  chemically synthesized
tatcttttttttttttgaga

SEQ ID NO: 58265 - DNA, 20 bp, Artificial Sequence
  chemically synthesized
tctggctcagtaacccagcc

SEQ ID NO: 58266 - DNA, 20 bp, Artificial Sequence
  chemically synthesized
tcattgtgacctctacctcc

SEQ ID NO: 58267 - DNA, 20 bp, Artificial Sequence
  chemically synthesized
gatcctcccacctcagcctc

SEQ ID NO: 58268 - DNA, 20 bp, Artificial Sequence
  chemically synthesized
ttttgtatttttagtagaga

SEQ ID NO: 58269 - DNA, 20 bp, Artificial Sequence
  chemically synthesized
acctcagcctcccaaagtgc

SEQ ID NO: 58270 - DNA, 20 bp, Artificial Sequence
  chemically synthesized
caggcagatcacatgaggtc

SEQ ID NO: 58271 - DNA, 20 bp, Artificial Sequence
  chemically synthesized
cgtttctaccaaaaaatata

SEQ ID NO: 58272 - DNA, 20 bp, Artificial Sequence
  chemically synthesized
tactcgggaggctaaggcaa

SEQ ID NO: 58273 - DNA, 20 bp, Artificial Sequence
  chemically synthesized
ttatgccactgcactacagg

SEQ ID NO: 58274 - DNA, 20 bp, Artificial Sequence
  chemically synthesized
tcaagaagtatttgtcctgg

SEQ ID NO: 58275 - DNA, 20 bp, Artificial Sequence
  chemically synthesized
aacttggacttgcatatacc

SEQ ID NO: 58276 - DNA, 20 bp, Artificial Sequence
  chemically synthesized
atgggttccctcaggcctca

SEQ ID NO: 58277 - DNA, 20 bp, Artificial Sequence
  chemically synthesized
ttgcatttcctctgacatca

SEQ ID NO: 58278 - DNA, 20 bp, Artificial Sequence
  chemically synthesized
aacatggcctgcatttccat

SEQ ID NO: 58279 - DNA, 20 bp, Artificial Sequence
  chemically synthesized
ccatcagaattgctctctgt

SEQ ID NO: 58280 - DNA, 20 bp, Artificial Sequence
  chemically synthesized
gtatcctctctactttgaaa

SEQ ID NO: 58281 - DNA, 20 bp, Artificial Sequence
  chemically synthesized
aataggtgtcaaccgccagt

SEQ ID NO: 58282 - DNA, 20 bp, Artificial Sequence
  chemically synthesized
tgccttttatcccgtgatgg

SEQ ID NO: 58283 - DNA, 20 bp, Artificial Sequence
  chemically synthesized
ttcaatggagatcagatgtt

SEQ ID NO: 58284 - DNA, 20 bp, Artificial Sequence
  chemically synthesized
cacttcatctttttattttt

SEQ ID NO: 58285 - DNA, 20 bp, Artificial Sequence
  chemically synthesized
tattttttagaatcatgcgg

SEQ ID NO: 58286 - DNA, 20 bp, Artificial Sequence
  chemically synthesized
ggcaggcagatcatgaggtc

SEQ ID NO: 58287 - DNA, 20 bp, Artificial Sequence
  chemically synthesized
tacttgggaggctgaggcag

SEQ ID NO: 58288 - DNA, 20 bp, Artificial Sequence
  chemically synthesized
aaagaaagaaagaaagtggc

SEQ ID NO: 58289 - DNA, 20 bp, Artificial Sequence
  chemically synthesized
agaaagaaagtggccagaat

SEQ ID NO: 58290 - DNA, 20 bp, Artificial Sequence
  chemically synthesized
gggctttcccctgctcccca

SEQ ID NO: 58291 - DNA, 20 bp, Artificial Sequence
  chemically synthesized
ttgccaaggacatgtagttg

SEQ ID NO: 58292 - DNA, 20 bp, Artificial Sequence
  chemically synthesized
gagggctggagcccagttcc

SEQ ID NO: 58293 - DNA, 20 bp, Artificial Sequence
  chemically synthesized
ttaccccacaaaacaggctg

SEQ ID NO: 58294 - DNA, 20 bp, Artificial Sequence
  chemically synthesized
tcttttttttttttttgaga

SEQ ID NO: 58295 - DNA, 20 bp, Artificial Sequence
  chemically synthesized
tcttactctgttgcccaggc

SEQ ID NO: 58296 - DNA, 20 bp, Artificial Sequence
  chemically synthesized
ccgcctctcacctcagcctc

SEQ ID NO: 58297 - DNA, 20 bp, Artificial Sequence
  chemically synthesized
tcgtaatgtttttgtagaga

SEQ ID NO: 58298 - DNA, 20 bp, Artificial Sequence
  chemically synthesized
cccaggctggtcttgaactc

SEQ ID NO: 58299 - DNA, 20 bp, Artificial Sequence
  chemically synthesized
ttgaactcctgagttcaccc

SEQ ID NO: 58300 - DNA, 20 bp, Artificial Sequence
  chemically synthesized
acctcggcctcccaaagtgc

SEQ ID NO: 58301 - DNA, 20 bp, Artificial Sequence
  chemically synthesized
ctgtattttcaactcactgg

SEQ ID NO: 58302 - DNA, 20 bp, Artificial Sequence
  chemically synthesized
gatgatccaaagtcagagag

SEQ ID NO: 58303 - DNA, 20 bp, Artificial Sequence
  chemically synthesized
cagagagaggggttggaagc

SEQ ID NO: 58304 - DNA, 20 bp, Artificial Sequence
  chemically synthesized
catgagtagcccgtggcttc

SEQ ID NO: 58305 - DNA, 20 bp, Artificial Sequence
  chemically synthesized
gatggacagacattgcgaga

SEQ ID NO: 58306 - DNA, 20 bp, Artificial Sequence
  chemically synthesized
ctccaatcacagctacccaa

SEQ ID NO: 58307 - DNA, 20 bp, Artificial Sequence
  chemically synthesized
caccaagatgaaccagtcct

SEQ ID NO: 58308 - DNA, 20 bp, Artificial Sequence
  chemically synthesized
acctggaggtaatgtgttga

SEQ ID NO: 58309 - DNA, 20 bp, Artificial Sequence
  chemically synthesized
ttggtggtgattgctctgct

SEQ ID NO: 58310 - DNA, 20 bp, Artificial Sequence
  chemically synthesized
taggttgatgcaaacatgtt

SEQ ID NO: 58311 - DNA, 20 bp, Artificial Sequence
  chemically synthesized
ggcatgcttcttggcagtgc

SEQ ID NO: 58312 - DNA, 20 bp, Artificial Sequence
  chemically synthesized
accaggccagagacacagga

SEQ ID NO: 58313 - DNA, 20 bp, Artificial Sequence
  chemically synthesized
aatttgggaggctgaggtgg

SEQ ID NO: 58314 - DNA, 20 bp, Artificial Sequence
  chemically synthesized
tgggaggatcccttgaagcc

SEQ ID NO: 58315 - DNA, 20 bp, Artificial Sequence
  chemically synthesized
tattcaggaggctgaggcag

SEQ ID NO: 58316 - DNA, 20 bp, Artificial Sequence
  chemically synthesized
caggaggattgcttgagccc

SEQ ID NO: 58317 - DNA, 20 bp, Artificial Sequence
  chemically synthesized
gattgcttgagcccaggagt

SEQ ID NO: 58318 - DNA, 20 bp, Artificial Sequence
  chemically synthesized
tggtctttccttaactgtat

SEQ ID NO: 58319 - DNA, 20 bp, Artificial Sequence
  chemically synthesized
tccttaactgtattagagtc

SEQ ID NO: 58320 - DNA, 20 bp, Artificial Sequence
  chemically synthesized
gggccagaaagtaatcgttt

SEQ ID NO: 58321 - DNA, 20 bp, Artificial Sequence
  chemically synthesized
tctctctcttttttttgaaa

SEQ ID NO: 58322 - DNA, 20 bp, Artificial Sequence
  chemically synthesized
tctcactctgtctcccaggc

SEQ ID NO: 58323 - DNA, 20 bp, Artificial Sequence
  chemically synthesized
gatcctcccacctcagcctc

SEQ ID NO: 58324 - DNA, 20 bp, Artificial Sequence
  chemically synthesized
ttttctatcttttgtagaga

SEQ ID NO: 58325 - DNA, 20 bp, Artificial Sequence
  chemically synthesized
ccatgttgcccaggctggtc

SEQ ID NO: 58326 - DNA, 20 bp, Artificial Sequence
  chemically synthesized
gtcttggcttcccaaagctc

SEQ ID NO: 58327 - DNA, 20 bp, Artificial Sequence
  chemically synthesized
tcatacgtttaagcaaaata

SEQ ID NO: 58328 - DNA, 20 bp, Artificial Sequence
  chemically synthesized
tcttactgtgcaacaatatg

SEQ ID NO: 58329 - DNA, 20 bp, Artificial Sequence
  chemically synthesized
atgaatgtatggttccaaat

SEQ ID NO: 58330 - DNA, 20 bp, Artificial Sequence
  chemically synthesized
aaatggtaactggagactta

SEQ ID NO: 58331 - DNA, 20 bp, Artificial Sequence
  chemically synthesized
agagaccaaaaccctaacac

SEQ ID NO: 58332 - DNA, 20 bp, Artificial Sequence
  chemically synthesized
gaggactgtgaaaggaacca

SEQ ID NO: 58333 - DNA, 20 bp, Artificial Sequence
  chemically synthesized
actgtgaaaggaaccaggga

SEQ ID NO: 58334 - DNA, 20 bp, Artificial Sequence
  chemically synthesized
tttatttatttttgtagaaa

SEQ ID NO: 58335 - DNA, 20 bp, Artificial Sequence
  chemically synthesized
gcctcaacctagcaaagcat

SEQ ID NO: 58336 - DNA, 20 bp, Artificial Sequence
  chemically synthesized
tccaaattcatgcatttttt

SEQ ID NO: 58337 - DNA, 20 bp, Artificial Sequence
  chemically synthesized
ttttgaggataagagccagg

SEQ ID NO: 58338 - DNA, 20 bp, Artificial Sequence
  chemically synthesized
taaaatgtttaaaaacttgc

SEQ ID NO: 58339 - DNA, 20 bp, Artificial Sequence
  chemically synthesized
taagtccatattgacatgta

SEQ ID NO: 58340 - DNA, 20 bp, Artificial Sequence
  chemically synthesized
aaaaaagaaactcagagcta

SEQ ID NO: 58341 - DNA, 20 bp, Artificial Sequence
  chemically synthesized
atcctccaggaggtatgacc

SEQ ID NO: 58342 - DNA, 20 bp, Artificial Sequence
  chemically synthesized
caggtaatgtgttggtgact

SEQ ID NO: 58343 - DNA, 20 bp, Artificial Sequence
  chemically synthesized
taatgtgttggtgactgtgg

SEQ ID NO: 58344 - DNA, 20 bp, Artificial Sequence
  chemically synthesized
tggcaggcagtgctggggcg

SEQ ID NO: 58345 - DNA, 20 bp, Artificial Sequence
  chemically synthesized
acccagataagcctctgttg

SEQ ID NO: 58346 - DNA, 20 bp, Artificial Sequence
  chemically synthesized
gtaactattgcagtgacctc

SEQ ID NO: 58347 - DNA, 20 bp, Artificial Sequence
  chemically synthesized
attgcagtgacctctgggat

SEQ ID NO: 58348 - DNA, 20 bp, Artificial Sequence
  chemically synthesized
gagagtttctatggtcagag

SEQ ID NO: 58349 - DNA, 20 bp, Artificial Sequence
  chemically synthesized
atggtcagaggtgagtcaag

SEQ ID NO: 58350 - DNA, 20 bp, Artificial Sequence
  chemically synthesized
acatatacaaaggccactgt

SEQ ID NO: 58351 - DNA, 20 bp, Artificial Sequence
  chemically synthesized
atgccagggcagctagcagc

SEQ ID NO: 58352 - DNA, 20 bp, Artificial Sequence
  chemically synthesized
gcagctagcagccagggtct

SEQ ID NO: 58353 - DNA, 20 bp, Artificial Sequence
  chemically synthesized
gccagggtctctgagttggg

SEQ ID NO: 58354 - DNA, 20 bp, Artificial Sequence
  chemically synthesized
gttttctgagacgcctcagg

SEQ ID NO: 58355 - DNA, 20 bp, Artificial Sequence
  chemically synthesized
gcctcaggaagaatacccct

SEQ ID NO: 58356 - DNA, 20 bp, Artificial Sequence
  chemically synthesized
gaagaatacccctatggata

SEQ ID NO: 58357 - DNA, 20 bp, Artificial Sequence
  chemically synthesized
gataaggagttgataagtga

SEQ ID NO: 58358 - DNA, 20 bp, Artificial Sequence
  chemically synthesized
tctgggcatccagggacagt

SEQ ID NO: 58359 - DNA, 20 bp, Artificial Sequence
  chemically synthesized
ccaccaggcagggggaccct

SEQ ID NO: 58360 - DNA, 20 bp, Artificial Sequence
  chemically synthesized
gctgactgcatcgagacacc

SEQ ID NO: 58361 - DNA, 20 bp, Artificial Sequence
  chemically synthesized
cgtggattctcaaaggtctt

SEQ ID NO: 58362 - DNA, 20 bp, Artificial Sequence
  chemically synthesized
aggtcttgtggatatatgag

SEQ ID NO: 58363 - DNA, 20 bp, Artificial Sequence
  chemically synthesized
gagtggctagaagttttgct

SEQ ID NO: 58364 - DNA, 20 bp, Artificial Sequence
  chemically synthesized
atttatctgtttatttgaga

SEQ ID NO: 58365 - DNA, 20 bp, Artificial Sequence
  chemically synthesized
tctcactctgttacccaggc

SEQ ID NO: 58366 - DNA, 20 bp, Artificial Sequence
  chemically synthesized
gcctcagtctcctgggctta

SEQ ID NO: 58367 - DNA, 20 bp, Artificial Sequence
  chemically synthesized
ggatcgttttgcatcagtct

SEQ ID NO: 58368 - DNA, 20 bp, Artificial Sequence
  chemically synthesized
tcatatatccacaagacctt

SEQ ID NO: 58369 - DNA, 20 bp, Artificial Sequence
  chemically synthesized
ataaaaacgtgctggaggaa

SEQ ID NO: 58370 - DNA, 20 bp, Artificial Sequence
  chemically synthesized
ggtattcttcctgaggcgtc

SEQ ID NO: 58371 - DNA, 20 bp, Artificial Sequence
  chemically synthesized
accttgactcacctctgacc

SEQ ID NO: 58372 - DNA, 20 bp, Artificial Sequence
  chemically synthesized
ggagaagtttgcttggacca

SEQ ID NO: 58373 - DNA, 20 bp, Artificial Sequence
  chemically synthesized
tatatctacacacatatgta

SEQ ID NO: 58374 - DNA, 20 bp, Artificial Sequence
  chemically synthesized
aaaccccatctctacaaaag

SEQ ID NO: 58375 - DNA, 20 bp, Artificial Sequence
  chemically synthesized
ccctgtttcaaaaaaaagag

SEQ ID NO: 58376 - DNA, 20 bp, Artificial Sequence
  chemically synthesized
aaagagagagaaaatttaaa

SEQ ID NO: 58377 - DNA, 20 bp, Artificial Sequence
  chemically synthesized
acaattttttaaatttttgt

SEQ ID NO: 58378 - DNA, 20 bp, Artificial Sequence
  chemically synthesized
aaataagtgcagttgcaggc

SEQ ID NO: 58379 - DNA, 20 bp, Artificial Sequence
  chemically synthesized
tagaaaatctgacatctttg

SEQ ID NO: 58380 - DNA, 20 bp, Artificial Sequence
  chemically synthesized
ccatatagagaggagatcag

SEQ ID NO: 58381 - DNA, 20 bp, Artificial Sequence
  chemically synthesized
catctacataaagggggaag

SEQ ID NO: 58382 - DNA, 20 bp, Artificial Sequence
  chemically synthesized
tgaagcagaagaggtaacat

SEQ ID NO: 58383 - DNA, 20 bp, Artificial Sequence
  chemically synthesized
tgaggtagttactgctattt

SEQ ID NO: 58384 - DNA, 20 bp, Artificial Sequence
  chemically synthesized
gtggctctccctgatttcgg

SEQ ID NO: 58385 - DNA, 20 bp, Artificial Sequence
  chemically synthesized
ctaattctttatattttttg

SEQ ID NO: 58386 - DNA, 20 bp, Artificial Sequence
  chemically synthesized
ccaccgcgcctgcctggagt

SEQ ID NO: 58387 - DNA, 20 bp, Artificial Sequence
  chemically synthesized
aaagcattcattcagtaacc

SEQ ID NO: 58388 - DNA, 20 bp, Artificial Sequence
  chemically synthesized
cgccctgcagcgctgtgtcc

SEQ ID NO: 58389 - DNA, 20 bp, Artificial Sequence
  chemically synthesized
ctacctgggaggctgaggca

SEQ ID NO: 58390 - DNA, 20 bp, Artificial Sequence
  chemically synthesized
ctactcaggaggctaaggca

SEQ ID NO: 58391 - DNA, 20 bp, Artificial Sequence
  chemically synthesized
acacacacacacatataata

SEQ ID NO: 58392 - DNA, 20 bp, Artificial Sequence
  chemically synthesized
aaaaaaaaaaagaagaagaa

SEQ ID NO: 58393 - DNA, 20 bp, Artificial Sequence
  chemically synthesized
agaaggaccaaacatctttt

SEQ ID NO: 58394 - DNA, 20 bp, Artificial Sequence
  chemically synthesized
ttaggtagagtagctaaggc

SEQ ID NO: 58395 - DNA, 20 bp, Artificial Sequence
  chemically synthesized
ctacccaggaggctgcggca

SEQ ID NO: 58396 - DNA, 20 bp, Artificial Sequence
  chemically synthesized
tgcactccagccttggtgac

SEQ ID NO: 58397 - DNA, 20 bp, Artificial Sequence
  chemically synthesized
gaagggagggaggaaggaag

SEQ ID NO: 58398 - DNA, 20 bp, Artificial Sequence
  chemically synthesized
ggagggaggaaggaagggag

SEQ ID NO: 58399 - DNA, 20 bp, Artificial Sequence
  chemically synthesized
gaaggaggaagggagggagg

SEQ ID NO: 58400 - DNA, 20 bp, Artificial Sequence
  chemically synthesized
atgccaggagaaggctgaga

SEQ ID NO: 58401 - DNA, 20 bp, Artificial Sequence
  chemically synthesized
atctctcagggtagaggaat

SEQ ID NO: 58402 - DNA, 20 bp, Artificial Sequence
  chemically synthesized
gtggtcagagtaggactcac

SEQ ID NO: 58403 - DNA, 20 bp, Artificial Sequence
  chemically synthesized
ccatccaggttaaaataacc

SEQ ID NO: 58404 - DNA, 20 bp, Artificial Sequence
  chemically synthesized
acagaagatattcctactac

SEQ ID NO: 58405 - DNA, 20 bp, Artificial Sequence
  chemically synthesized
catttctgtgggttgaaagt

SEQ ID NO: 58406 - DNA, 20 bp, Artificial Sequence
  chemically synthesized
ctataagagtgcccagatct

SEQ ID NO: 58407 - DNA, 20 bp, Artificial Sequence
  chemically synthesized
gacaagatttaagttaagca

SEQ ID NO: 58408 - DNA, 20 bp, Artificial Sequence
  chemically synthesized
ggaacatagcagcattcaaa

SEQ ID NO: 58409 - DNA, 20 bp, Artificial Sequence
  chemically synthesized
cctgggaatgtttaggttag

SEQ ID NO: 58410 - DNA, 20 bp, Artificial Sequence
  chemically synthesized
ttcatcacttactaactcct

SEQ ID NO: 58411 - DNA, 20 bp, Artificial Sequence
  chemically synthesized
ctaactcctgcagaaagaac

SEQ ID NO: 58412 - DNA, 20 bp, Artificial Sequence
  chemically synthesized
tccactcaggcattgctgtt

SEQ ID NO: 58413 - DNA, 20 bp, Artificial Sequence
  chemically synthesized
agcatctataatgccagcct

SEQ ID NO: 58414 - DNA, 20 bp, Artificial Sequence
  chemically synthesized
gtagacctcctgtggactct

SEQ ID NO: 58415 - DNA, 20 bp, Artificial Sequence
  chemically synthesized
cccagaggtggtgcgagcag

SEQ ID NO: 58416 - DNA, 20 bp, Artificial Sequence
  chemically synthesized
tgaaaagctaatgaagctat

SEQ ID NO: 58417 - DNA, 20 bp, Artificial Sequence
  chemically synthesized
cccaggctggagatcctaac

SEQ ID NO: 58418 - DNA, 20 bp, Artificial Sequence
  chemically synthesized
ctacctgtgttcattcttac

SEQ ID NO: 58419 - DNA, 20 bp, Artificial Sequence
  chemically synthesized
gttcattcttaccgagaaaa

SEQ ID NO: 58420 - DNA, 20 bp, Artificial Sequence
  chemically synthesized
ccaggctaatttttatattt

SEQ ID NO: 58421 - DNA, 20 bp, Artificial Sequence
  chemically synthesized
cctgctcataacatctttga

SEQ ID NO: 58422 - DNA, 20 bp, Artificial Sequence
  chemically synthesized
tattaaagcaacattttatt

SEQ ID NO: 58423 - DNA, 20 bp, Artificial Sequence
  chemically synthesized
gcctgcattttccctttgga

SEQ ID NO: 58424 - DNA, 20 bp, Artificial Sequence
  chemically synthesized
ggcccaaaatcagcatagaa

SEQ ID NO: 58425 - DNA, 20 bp, Artificial Sequence
  chemically synthesized
cagaaagattcagagttggc

SEQ ID NO: 58426 - DNA, 20 bp, Artificial Sequence
  chemically synthesized
caaggttttgggttatagtt

SEQ ID NO: 58427 - DNA, 20 bp, Artificial Sequence
  chemically synthesized
ttgtgggaaccaggcccctc

SEQ ID NO: 58428 - DNA, 20 bp, Artificial Sequence
  chemically synthesized
aatcaaatggtcccaaccag

SEQ ID NO: 58429 - DNA, 20 bp, Artificial Sequence
  chemically synthesized
aaatggtcccaaccagggag

SEQ ID NO: 58430 - DNA, 20 bp, Artificial Sequence
  chemically synthesized
gtgtgagccactgcgcttgg

SEQ ID NO: 58431 - DNA, 20 bp, Artificial Sequence
  chemically synthesized
gaccaagtccaagatcctta

SEQ ID NO: 58432 - DNA, 20 bp, Artificial Sequence
  chemically synthesized
atccttacaagaaaggtctg

SEQ ID NO: 58433 - DNA, 20 bp, Artificial Sequence
  chemically synthesized
cctgaagtttatgaggttga

SEQ ID NO: 58434 - DNA, 20 bp, Artificial Sequence
  chemically synthesized
agaggggttagtcatcttgt

SEQ ID NO: 58435 - DNA, 20 bp, Artificial Sequence
  chemically synthesized
ctactcaggtggctgaggtg

SEQ ID NO: 58436 - DNA, 20 bp, Artificial Sequence
  chemically synthesized
tgacagagtgagaccctgtc

SEQ ID NO: 58437 - DNA, 20 bp, Artificial Sequence
  chemically synthesized
gttatagatttacgtccact

SEQ ID NO: 58438 - DNA, 20 bp, Artificial Sequence
  chemically synthesized
tcatgttatggcataatttg

SEQ ID NO: 58439 - DNA, 20 bp, Artificial Sequence
  chemically synthesized
atgcaattctattattgccc

SEQ ID NO: 58440 - DNA, 20 bp, Artificial Sequence
  chemically synthesized
ggaatattacttgtccataa

SEQ ID NO: 58441 - DNA, 20 bp, Artificial Sequence
  chemically synthesized
caaataggcaaatctatgag

SEQ ID NO: 58442 - DNA, 20 bp, Artificial Sequence
  chemically synthesized
tctattttctttgggcaata

SEQ ID NO: 58443 - DNA, 20 bp, Artificial Sequence
  chemically synthesized
gtataaataaagtacataga

SEQ ID NO: 58444 - DNA, 20 bp, Artificial Sequence
  chemically synthesized
ctgagagcccaaatccagta

SEQ ID NO: 58445 - DNA, 20 bp, Artificial Sequence
  chemically synthesized
gatgaaataaatctcttagc

SEQ ID NO: 58446 - DNA, 20 bp, Artificial Sequence
  chemically synthesized
caaagggaaaatgcaggcac

SEQ ID NO: 58447 - DNA, 20 bp, Artificial Sequence
  chemically synthesized
atttgtttagggaaacagag

SEQ ID NO: 58448 - DNA, 20 bp, Artificial Sequence
  chemically synthesized
gagctagaaatttagttggg

SEQ ID NO: 58449 - DNA, 20 bp, Artificial Sequence
  chemically synthesized
gaaatttagttgggccagaa

SEQ ID NO: 58450 - DNA, 20 bp, Artificial Sequence
  chemically synthesized
ttggggggtaggtgggtggg

SEQ ID NO: 58451 - DNA, 20 bp, Artificial Sequence
  chemically synthesized
ctactgaggaggctgagaca

SEQ ID NO: 58452 - DNA, 20 bp, Artificial Sequence
  chemically synthesized
ataggtgcgccgtctcaaaa

SEQ ID NO: 58453 - DNA, 20 bp, Artificial Sequence
  chemically synthesized
cgtctcaaaaaaagaaaaaa

SEQ ID NO: 58454 - DNA, 20 bp, Artificial Sequence
  chemically synthesized
gaagatgttgacttttcctt

SEQ ID NO: 58455 - DNA, 20 bp, Artificial Sequence
  chemically synthesized
gctcttggttggcttgggat

SEQ ID NO: 58456 - DNA, 20 bp, Artificial Sequence
  chemically synthesized
gggtggatgtggagccagtg

SEQ ID NO: 58457 - DNA, 20 bp, Artificial Sequence
  chemically synthesized
atctgggtcactgcagccat

SEQ ID NO: 58458 - DNA, 20 bp, Artificial Sequence
  chemically synthesized
cagtaaaaaaaatactagaa

SEQ ID NO: 58459 - DNA, 20 bp, Artificial Sequence
  chemically synthesized
ctcctttctccttttctcgg

SEQ ID NO: 58460 - DNA, 20 bp, Artificial Sequence
  chemically synthesized
ctcggtaagaatgaacacag

SEQ ID NO: 58461 - DNA, 20 bp, Artificial Sequence
  chemically synthesized
ttgcttttgtatatgtgacg

SEQ ID NO: 58462 - DNA, 20 bp, Artificial Sequence
  chemically synthesized
cgtgatttaattccacgacg

SEQ ID NO: 58463 - DNA, 20 bp, Artificial Sequence
  chemically synthesized
gctgaacaggaagaaggtaa

SEQ ID NO: 58464 - DNA, 20 bp, Artificial Sequence
  chemically synthesized
gcaacagcaatgcctgagtg

SEQ ID NO: 58465 - DNA, 20 bp, Artificial Sequence
  chemically synthesized
cgttcttacaaatctccagg

SEQ ID NO: 58466 - DNA, 20 bp, Artificial Sequence
  chemically synthesized
ttacccttgttaattggatc

SEQ ID NO: 58467 - DNA, 20 bp, Artificial Sequence
  chemically synthesized
tactcggagaggctgaggca

SEQ ID NO: 58468 - DNA, 20 bp, Artificial Sequence
  chemically synthesized
tagggcctgttgaagaccag

SEQ ID NO: 58469 - DNA, 20 bp, Artificial Sequence
  chemically synthesized
ctatagatctgggcactctt

SEQ ID NO: 58470 - DNA, 20 bp, Artificial Sequence
  chemically synthesized
tcattcttgactttcaaccc

SEQ ID NO: 58471 - DNA, 20 bp, Artificial Sequence
  chemically synthesized
ggattttgtcctgattaggg

SEQ ID NO: 58472 - DNA, 20 bp, Artificial Sequence
  chemically synthesized
cagacattcagctgcacagc

SEQ ID NO: 58473 - DNA, 20 bp, Artificial Sequence
  chemically synthesized
acaggtgcagatccttcagc

SEQ ID NO: 58474 - DNA, 20 bp, Artificial Sequence
  chemically synthesized
cagcaaagaaaacagcccct

SEQ ID NO: 58475 - DNA, 20 bp, Artificial Sequence
  chemically synthesized
ctatttgagaggctgaggca

SEQ ID NO: 58476 - DNA, 20 bp, Artificial Sequence
  chemically synthesized
ctactcggtaggctgaggca

SEQ ID NO: 58477 - DNA, 20 bp, Artificial Sequence
  chemically synthesized
tctgtctctacaaaaagata

SEQ ID NO: 58478 - DNA, 20 bp, Artificial Sequence
  chemically synthesized
gcgggctagggggatgtgag

SEQ ID NO: 58479 - DNA, 20 bp, Artificial Sequence
  chemically synthesized
ggctccctaaagggcaggaa

SEQ ID NO: 58480 - DNA, 20 bp, Artificial Sequence
  chemically synthesized
atacagtctggagattacac

SEQ ID NO: 58481 - DNA, 20 bp, Artificial Sequence
  chemically synthesized
agcccttcacagctcttctg

SEQ ID NO: 58482 - DNA, 20 bp, Artificial Sequence
  chemically synthesized
tcgctgtggggttggatgag

SEQ ID NO: 58483 - DNA, 20 bp, Artificial Sequence
  chemically synthesized
acttttttttttttttcctg

SEQ ID NO: 58484 - DNA, 20 bp, Artificial Sequence
  chemically synthesized
tgtgcctccattaatttcag

SEQ ID NO: 58485 - DNA, 20 bp, Artificial Sequence
  chemically synthesized
ccagtatggacgctgtccaa

SEQ ID NO: 58486 - DNA, 20 bp, Artificial Sequence
  chemically synthesized
ccgtttctaccaaaaaatat

SEQ ID NO: 58487 - DNA, 20 bp, Artificial Sequence
  chemically synthesized
ctactcgggaggctaaggca

SEQ ID NO: 58488 - DNA, 20 bp, Artificial Sequence
  chemically synthesized
ctcaagaagtatttgtcctg

SEQ ID NO: 58489 - DNA, 20 bp, Artificial Sequence
  chemically synthesized
cttgcatttcctctgacatc

SEQ ID NO: 58490 - DNA, 20 bp, Artificial Sequence
  chemically synthesized
aaacatggcctgcatttcca

SEQ ID NO: 58491 - DNA, 20 bp, Artificial Sequence
  chemically synthesized
acacttcatctttttatttt

SEQ ID NO: 58492 - DNA, 20 bp, Artificial Sequence
  chemically synthesized
ctacttgggaggctgaggca

SEQ ID NO: 58493 - DNA, 20 bp, Artificial Sequence
  chemically synthesized
ccatctcaaacaaacaaaca

SEQ ID NO: 58494 - DNA, 20 bp, Artificial Sequence
  chemically synthesized
ctcaaacaaacaaacaaaag

SEQ ID NO: 58495 - DNA, 20 bp, Artificial Sequence
  chemically synthesized
aacaaacaaacaaaagaaag

SEQ ID NO: 58496 - DNA, 20 bp, Artificial Sequence
  chemically synthesized
aacaaacaaaagaaagaaag

SEQ ID NO: 58497 - DNA, 20 bp, Artificial Sequence
  chemically synthesized
gaaagaaagaaagaaagtgg

SEQ ID NO: 58498 - DNA, 20 bp, Artificial Sequence
  chemically synthesized
agaatgggaatgtttacgtg

SEQ ID NO: 58499 - DNA, 20 bp, Artificial Sequence
  chemically synthesized
taaatagcagtaactacctc

SEQ ID NO: 58500 - DNA, 20 bp, Artificial Sequence
  chemically synthesized
acctatttgtagattataaa

SEQ ID NO: 58501 - DNA, 20 bp, Artificial Sequence
  chemically synthesized
ttcagggtgatttacgtaaa

SEQ ID NO: 58502 - DNA, 20 bp, Artificial Sequence
  chemically synthesized
aactgcacttatttggggac

SEQ ID NO: 58503 - DNA, 20 bp, Artificial Sequence
  chemically synthesized
aaacaaaacaaaacaaaaca

SEQ ID NO: 58504 - DNA, 20 bp, Artificial Sequence
  chemically synthesized
tggcctcatgtctcttaggg

SEQ ID NO: 58505 - DNA, 20 bp, Artificial Sequence
  chemically synthesized
gatgaatgtatggttccaaa

SEQ ID NO: 58506 - DNA, 20 bp, Artificial Sequence
  chemically synthesized
catatgtgtgtagatataca

SEQ ID NO: 58507 - DNA, 20 bp, Artificial Sequence
  chemically synthesized
ttatttatttatttattttt

SEQ ID NO: 58508 - DNA, 20 bp, Artificial Sequence
  chemically synthesized
catgtaaggggtagctgggg

SEQ ID NO: 58509 - DNA, 20 bp, Artificial Sequence
  chemically synthesized
ggggtagctggggacagaaa

SEQ ID NO: 58510 - DNA, 20 bp, Artificial Sequence
  chemically synthesized
tgttttctgagacgcctcag

SEQ ID NO: 58511 - DNA, 20 bp, Artificial Sequence
  chemically synthesized
acaggtgaggccccagcttg

SEQ ID NO: 58512 - DNA, 20 bp, Artificial Sequence
  chemically synthesized
cgagtggctagaagttttgc

SEQ ID NO: 58513 - DNA, 20 bp, Artificial Sequence
  chemically synthesized
cagctacccagagactgatg

SEQ ID NO: 58514 - DNA, 20 bp, Artificial Sequence
  chemically synthesized
ataaatgagtggattctcag

SEQ ID NO: 58515 - DNA, 20 bp, Artificial Sequence
  chemically synthesized
tcacctgttttcccacggat

SEQ ID NO: 58516 - DNA, 20 bp, Artificial Sequence
  chemically synthesized
attcttcctgaggcgtctca

SEQ ID NO: 58517 - DNA, 20 bp, Artificial Sequence
  chemically synthesized
ttttgcttaaacgtatgagt

SEQ ID NO: 58518 - DNA, 20 bp, Artificial Sequence
  chemically synthesized
gaccagcctgggcaacatgg

SEQ ID NO: 58519 - DNA, 20 bp, Artificial Sequence
  chemically synthesized
gagagagaaaatttaaaaaa

SEQ ID NO: 58520 - DNA, 20 bp, Artificial Sequence
  chemically synthesized
atgaattaatcactgcattc

SEQ ID NO: 58521 - DNA, 20 bp, Artificial Sequence
  chemically synthesized
gggtacaccatcacacacac

SEQ ID NO: 58522 - DNA, 20 bp, Artificial Sequence
  chemically synthesized
taattttaaaattaagaact

SEQ ID NO: 58523 - DNA, 20 bp, Artificial Sequence
  chemically synthesized
aatactggatacagggcata

SEQ ID NO: 58524 - DNA, 20 bp, Artificial Sequence
  chemically synthesized
tggcgaaactccatctctac

SEQ ID NO: 58525 - DNA, 20 bp, Artificial Sequence
  chemically synthesized
cccgtctctactaaaaatac

SEQ ID NO: 58526 - DNA, 20 bp, Artificial Sequence
  chemically synthesized
agagaccctttccctgaccc

SEQ ID NO: 58527 - DNA, 20 bp, Artificial Sequence
  chemically synthesized
atcacctgaggtcaggagtt

SEQ ID NO: 58528 - DNA, 20 bp, Artificial Sequence
  chemically synthesized
gaccagcctggccaacatgg

SEQ ID NO: 58529 - DNA, 20 bp, Artificial Sequence
  chemically synthesized
cgtcactaataaaaaaatac

SEQ ID NO: 58530 - DNA, 20 bp, Artificial Sequence
  chemically synthesized
attgcttgagcccaagagtt

SEQ ID NO: 58531 - DNA, 20 bp, Artificial Sequence
  chemically synthesized
agttcaaaaccagcctgggc

SEQ ID NO: 58532 - DNA, 20 bp, Artificial Sequence
  chemically synthesized
aaaacaatcaaacaaacaaa

SEQ ID NO: 58533 - DNA, 20 bp, Artificial Sequence
  chemically synthesized
aagcaagacactgtctctaa

SEQ ID NO: 58534 - DNA, 20 bp, Artificial Sequence
  chemically synthesized
acactgtctctaaaaaaaca

SEQ ID NO: 58535 - DNA, 20 bp, Artificial Sequence
  chemically synthesized
aacaaaaaacaaacaaataa

SEQ ID NO: 58536 - DNA, 20 bp, Artificial Sequence
  chemically synthesized
agtagcagcagggcttaaat

SEQ ID NO: 58537 - DNA, 20 bp, Artificial Sequence
  chemically synthesized
actggaatataagaccttaa

SEQ ID NO: 58538 - DNA, 20 bp, Artificial Sequence
  chemically synthesized
cctggaagccatatcacatg

SEQ ID NO: 58539 - DNA, 20 bp, Artificial Sequence
  chemically synthesized
acccagatattgcactaggt

SEQ ID NO: 58540 - DNA, 20 bp, Artificial Sequence
  chemically synthesized
gtataccatacattatcatt

SEQ ID NO: 58541 - DNA, 20 bp, Artificial Sequence
  chemically synthesized
gaagtttatgaggttgataa

SEQ ID NO: 58542 - DNA, 20 bp, Artificial Sequence
  chemically synthesized
ccccgtctataccaaaaata

SEQ ID NO: 58543 - DNA, 20 bp, Artificial Sequence
  chemically synthesized
ttataacacagataaacctt

SEQ ID NO: 58544 - DNA, 20 bp, Artificial Sequence
  chemically synthesized
tgagtgggttggagtggaat

SEQ ID NO: 58545 - DNA, 20 bp, Artificial Sequence
  chemically synthesized
ttacaattttgttaaaaatc

SEQ ID NO: 58546 - DNA, 20 bp, Artificial Sequence
  chemically synthesized
aaaaagataaaataaataac

SEQ ID NO: 58547 - DNA, 20 bp, Artificial Sequence
  chemically synthesized
aaataaataaccaaaaccac

SEQ ID NO: 58548 - DNA, 20 bp, Artificial Sequence
  chemically synthesized
catcctcaagcctaccacct

SEQ ID NO: 58549 - DNA, 20 bp, Artificial Sequence
  chemically synthesized
acatgacatggaccttgctt

SEQ ID NO: 58550 - DNA, 20 bp, Artificial Sequence
  chemically synthesized
agggttcagttcagacagat

SEQ ID NO: 58551 - DNA, 20 bp, Artificial Sequence
  chemically synthesized
gactttcttgaactataacc

SEQ ID NO: 58552 - DNA, 20 bp, Artificial Sequence
  chemically synthesized
tatactatataattagtagc

SEQ ID NO: 58553 - DNA, 20 bp, Artificial Sequence
  chemically synthesized
ctgcatatcagatgagattg

SEQ ID NO: 58554 - DNA, 20 bp, Artificial Sequence
  chemically synthesized
tgcatgatacgccacatact

SEQ ID NO: 58555 - DNA, 20 bp, Artificial Sequence
  chemically synthesized
aatagcttcattagcttttc

SEQ ID NO: 58556 - DNA, 20 bp, Artificial Sequence
  chemically synthesized
cccttgttaattggatctaa

SEQ ID NO: 58557 - DNA, 20 bp, Artificial Sequence
  chemically synthesized
gagactccatctcaaaaaaa

SEQ ID NO: 58558 - DNA, 20 bp, Artificial Sequence
  chemically synthesized
ctcaaaaaaaaaaaacaaaa

SEQ ID NO: 58559 - DNA, 20 bp, Artificial Sequence
  chemically synthesized
aaaacaaaaaaaaacatatt

SEQ ID NO: 58560 - DNA, 20 bp, Artificial Sequence
  chemically synthesized
ggtgcagatccttcagcaaa

SEQ ID NO: 58561 - DNA, 20 bp, Artificial Sequence
  chemically synthesized
tctagcctgggcaacaagag

SEQ ID NO: 58562 - DNA, 20 bp, Artificial Sequence
  chemically synthesized
gggctttgtttccttatctg

SEQ ID NO: 58563 - DNA, 20 bp, Artificial Sequence
  chemically synthesized
aaccatctggctgtaactaa

SEQ ID NO: 58564 - DNA, 20 bp, Artificial Sequence
  chemically synthesized
ttgctgtagtagtcagtatc

SEQ ID NO: 58565 - DNA, 20 bp, Artificial Sequence
  chemically synthesized
gtccaaagagaatcctatgg

SEQ ID NO: 58566 - DNA, 20 bp, Artificial Sequence
  chemically synthesized
gataacctatttgtagatta

SEQ ID NO: 58567 - DNA, 20 bp, Artificial Sequence
  chemically synthesized
ggtgacttttcattacccca

SEQ ID NO: 58568 - DNA, 20 bp, Artificial Sequence
  chemically synthesized
cctcttctgcttcatactaa

SEQ ID NO: 58569 - DNA, 20 bp, Artificial Sequence
  chemically synthesized
cagccctgatctttggactc

SEQ ID NO: 58570 - DNA, 20 bp, Artificial Sequence
  chemically synthesized
gggtgatttacgtaaaatag

SEQ ID NO: 58571 - DNA, 20 bp, Artificial Sequence
  chemically synthesized
aaatagaaaaacaggcacac

SEQ ID NO: 58572 - DNA, 20 bp, Artificial Sequence
  chemically synthesized
tcgagcaagaccccagtctc

SEQ ID NO: 58573 - DNA, 20 bp, Artificial Sequence
  chemically synthesized
caagaccccagtctctaaaa

SEQ ID NO: 58574 - DNA, 20 bp, Artificial Sequence
  chemically synthesized
ccccagtctctaaaacaaaa

SEQ ID NO: 58575 - DNA, 20 bp, Artificial Sequence
  chemically synthesized
gtctctaaaacaaaacaaaa

SEQ ID NO: 58576 - DNA, 20 bp, Artificial Sequence
  chemically synthesized
taaaacaaaacaaaacaaaa

SEQ ID NO: 58577 - DNA, 20 bp, Artificial Sequence
  chemically synthesized
caaaacaaaacaaaacaaaa

SEQ ID NO: 58578 - DNA, 20 bp, Artificial Sequence
  chemically synthesized
aaaacaaaacaaaacaaaag

SEQ ID NO: 58579 - DNA, 20 bp, Artificial Sequence
  chemically synthesized
cctacaaatagtagagagac

SEQ ID NO: 58580 - DNA, 20 bp, Artificial Sequence
  chemically synthesized
ccagggggaataaaatgttt

SEQ ID NO: 58581 - DNA, 20 bp, Artificial Sequence
  chemically synthesized
cattccatgctggaaatgat

SEQ ID NO: 58582 - DNA, 20 bp, Artificial Sequence
  chemically synthesized
aggtgagtcaaggtgagtct

SEQ ID NO: 58583 - DNA, 20 bp, Artificial Sequence
  chemically synthesized
cagcacgtttttatccgtgg

SEQ ID NO: 58584 - DNA, 20 bp, Artificial Sequence
  chemically synthesized
ctcaaataaacagataaatg

SEQ ID NO: 58585 - DNA, 20 bp, Artificial Sequence
  chemically synthesized
atccacggtgtctcgatgca

SEQ ID NO: 58586 - DNA, 20 bp, Artificial Sequence
  chemically synthesized
ttctaacaagctggggcctc

SEQ ID NO: 58587 - DNA, 20 bp, Artificial Sequence
  chemically synthesized
acccagacagtggcctttgt

SEQ ID NO: 58588 - DNA, 20 bp, Artificial Sequence
  chemically synthesized
tgcaatagttactccacaac

SEQ ID NO: 58589 - DNA, 20 bp, Artificial Sequence
  chemically synthesized
cccagcactgcctgccacgc

SEQ ID NO: 58590 - DNA, 20 bp, Artificial Sequence
  chemically synthesized
ccaaggttaggcgtggcagg

SEQ ID NO: 58591 - DNA, 20 bp, Artificial Sequence
  chemically synthesized
ggttaggcgtggcaggagaa

SEQ ID NO: 58592 - DNA, 20 bp, Artificial Sequence
  chemically synthesized
tccaggtcatacctcctgga

SEQ ID NO: 58593 - DNA, 20 bp, Artificial Sequence
  chemically synthesized
ggaatgctgtcaacttttgc

SEQ ID NO: 58594 - DNA, 20 bp, Artificial Sequence
  chemically synthesized
ttgccacagattcattagct

SEQ ID NO: 58595 - DNA, 20 bp, Artificial Sequence
  chemically synthesized
cttaatgatgggaaattcag

SEQ ID NO: 58596 - DNA, 20 bp, Artificial Sequence
  chemically synthesized
gtggctcatgcctgtaatcc

SEQ ID NO: 58597 - DNA, 20 bp, Artificial Sequence
  chemically synthesized
gcctgggccgcatagtgaga

SEQ ID NO: 58598 - DNA, 20 bp, Artificial Sequence
  chemically synthesized
ataaataatagtgatatgaa

SEQ ID NO: 58599 - DNA, 20 bp, Artificial Sequence
  chemically synthesized
ttaaaatgcatgagttcgtt

SEQ ID NO: 58600 - DNA, 20 bp, Artificial Sequence
  chemically synthesized
gtcctccgtgacccaagtgt

SEQ ID NO: 58601 - DNA, 20 bp, Artificial Sequence
  chemically synthesized
atacacacacacagtgtatc

SEQ ID NO: 58602 - DNA, 20 bp, Artificial Sequence
  chemically synthesized
gccctttttcaaaaataact

SEQ ID NO: 58603 - DNA, 20 bp, Artificial Sequence
  chemically synthesized
gtaagactatacattcatta

SEQ ID NO: 58604 - DNA, 20 bp, Artificial Sequence
  chemically synthesized
gtggttcacacctgtaatcc

SEQ ID NO: 58605 - DNA, 20 bp, Artificial Sequence
  chemically synthesized
gaggttgaggctgcagtgag

SEQ ID NO: 58606 - DNA, 20 bp, Artificial Sequence
  chemically synthesized
gcctgggagacagagtgaga

SEQ ID NO: 58607 - DNA, 20 bp, Artificial Sequence
  chemically synthesized
gaattaatcactgcattcaa

SEQ ID NO: 58608 - DNA, 20 bp, Artificial Sequence
  chemically synthesized
agaagttactatattttatt

SEQ ID NO: 58609 - DNA, 20 bp, Artificial Sequence
  chemically synthesized
tattttatttgttgtttttc

SEQ ID NO: 58610 - DNA, 20 bp, Artificial Sequence
  chemically synthesized
tatttgttgtttttcttttg

SEQ ID NO: 58611 - DNA, 20 bp, Artificial Sequence
  chemically synthesized
gttgtttttcttttgttttg

SEQ ID NO: 58612 - DNA, 20 bp, Artificial Sequence
  chemically synthesized
ttttcttttgttttgttttg

SEQ ID NO: 58613 - DNA, 20 bp, Artificial Sequence
  chemically synthesized
ttttgttttgttttgttttg

SEQ ID NO: 58614 - DNA, 20 bp, Artificial Sequence
  chemically synthesized
ttttgttttgttttgttttg

SEQ ID NO: 58615 - DNA, 20 bp, Artificial Sequence
  chemically synthesized
gttttagagactggggtctt

SEQ ID NO: 58616 - DNA, 20 bp, Artificial Sequence
  chemically synthesized
tttttgtgtagaaacgaggg

SEQ ID NO: 58617 - DNA, 20 bp, Artificial Sequence
  chemically synthesized
gcccaggctggtctccaact

SEQ ID NO: 58618 - DNA, 20 bp, Artificial Sequence
  chemically synthesized
cacctcagcctcccaaattg

SEQ ID NO: 58619 - DNA, 20 bp, Artificial Sequence
  chemically synthesized
aaacttgaatagctagagca

SEQ ID NO: 58620 - DNA, 20 bp, Artificial Sequence
  chemically synthesized
actctgtcctgtgtctctgg

SEQ ID NO: 58621 - DNA, 20 bp, Artificial Sequence
  chemically synthesized
gctgagtacatggccgatca

SEQ ID NO: 58622 - DNA, 20 bp, Artificial Sequence
  chemically synthesized
cgatcaggctgtttttgtgt

SEQ ID NO: 58623 - DNA, 20 bp, Artificial Sequence
  chemically synthesized
ttttacgtaaatcaccctga

SEQ ID NO: 58624 - DNA, 20 bp, Artificial Sequence
  chemically synthesized
atcaatacattttagacaaa

SEQ ID NO: 58625 - DNA, 20 bp, Artificial Sequence
  chemically synthesized
cattaaactcctttgggtag

SEQ ID NO: 58626 - DNA, 20 bp, Artificial Sequence
  chemically synthesized
cgcaatgtctgtccatcaga

SEQ ID NO: 58627 - DNA, 20 bp, Artificial Sequence
  chemically synthesized
ttcaggaagccacgggctac

SEQ ID NO: 58628 - DNA, 20 bp, Artificial Sequence
  chemically synthesized
tcgtgaaaagtctgagttat

SEQ ID NO: 58629 - DNA, 20 bp, Artificial Sequence
  chemically synthesized
agttatataggctttgagca

SEQ ID NO: 58630 - DNA, 20 bp, Artificial Sequence
  chemically synthesized
tatgaaaaaaggaaacacac

SEQ ID NO: 58631 - DNA, 20 bp, Artificial Sequence
  chemically synthesized
aacacacagatgattcaaca

SEQ ID NO: 58632 - DNA, 20 bp, Artificial Sequence
  chemically synthesized
tggcaagtcatatcaattat

SEQ ID NO: 58633 - DNA, 20 bp, Artificial Sequence
  chemically synthesized
gtcatatcaattatctgagt

SEQ ID NO: 58634 - DNA, 20 bp, Artificial Sequence
  chemically synthesized
tctacaaataggttatctct

SEQ ID NO: 58635 - DNA, 20 bp, Artificial Sequence
  chemically synthesized
tgtgtgccagtccatgtgct

SEQ ID NO: 58636 - DNA, 20 bp, Artificial Sequence
  chemically synthesized
agagaccaaggtgctgagtt

SEQ ID NO: 58637 - DNA, 20 bp, Artificial Sequence
  chemically synthesized
atggaagcccaggtaggcag

SEQ ID NO: 58638 - DNA, 20 bp, Artificial Sequence
  chemically synthesized
ctggggagcaggggaaagcc

SEQ ID NO: 58639 - DNA, 20 bp, Artificial Sequence
  chemically synthesized
ccactttctttctttctttc

SEQ ID NO: 58640 - DNA, 20 bp, Artificial Sequence
  chemically synthesized
tttctttctttctttctttt

SEQ ID NO: 58641 - DNA, 20 bp, Artificial Sequence
  chemically synthesized
tttctttctttcttttgttt

SEQ ID NO: 58642 - DNA, 20 bp, Artificial Sequence
  chemically synthesized
aacctctgcctctccggttc

SEQ ID NO: 58643 - DNA, 20 bp, Artificial Sequence
  chemically synthesized
tgcctcagcctcccaagtag

SEQ ID NO: 58644 - DNA, 20 bp, Artificial Sequence
  chemically synthesized
ttttgtatttttagtagaga

SEQ ID NO: 58645 - DNA, 20 bp, Artificial Sequence
  chemically synthesized
tgccttggcctccctaagtg

SEQ ID NO: 58646 - DNA, 20 bp, Artificial Sequence
  chemically synthesized
gtgagccactacacccagcc

SEQ ID NO: 58647 - DNA, 20 bp, Artificial Sequence
  chemically synthesized
aggccagagttagtggctct

SEQ ID NO: 58648 - DNA, 20 bp, Artificial Sequence
  chemically synthesized
tctagtacttttaaagggga

SEQ ID NO: 58649 - DNA, 20 bp, Artificial Sequence
  chemically synthesized
gaagtggtttgtctgagata

SEQ ID NO: 58650 - DNA, 20 bp, Artificial Sequence
  chemically synthesized
aattctgatggaaatgcagg

SEQ ID NO: 58651 - DNA, 20 bp, Artificial Sequence
  chemically synthesized
tctctgatgtcagaggaaat

SEQ ID NO: 58652 - DNA, 20 bp, Artificial Sequence
  chemically synthesized
aacccatggtatatgcaagt

SEQ ID NO: 58653 - DNA, 20 bp, Artificial Sequence
  chemically synthesized
aagtcacatagctgccattt

SEQ ID NO: 58654 - DNA, 20 bp, Artificial Sequence
  chemically synthesized
tagctgccattttatggatt

SEQ ID NO: 58655 - DNA, 20 bp, Artificial Sequence
  chemically synthesized
aacctccgcctcccaggttc

SEQ ID NO: 58656 - DNA, 20 bp, Artificial Sequence
  chemically synthesized
tgccttagcctcccgagtag

SEQ ID NO: 58657 - DNA, 20 bp, Artificial Sequence
  chemically synthesized
tttatattttttggtagaaa

SEQ ID NO: 58658 - DNA, 20 bp, Artificial Sequence
  chemically synthesized
tgccttggcctcccaaagtg

SEQ ID NO: 58659 - DNA, 20 bp, Artificial Sequence
  chemically synthesized
cctgcctggagttcagaatc

SEQ ID NO: 58660 - DNA, 20 bp, Artificial Sequence
  chemically synthesized
agaatcttgggcttcattat

SEQ ID NO: 58661 - DNA, 20 bp, Artificial Sequence
  chemically synthesized
cactttgggaggctgaggtg

SEQ ID NO: 58662 - DNA, 20 bp, Artificial Sequence
  chemically synthesized
gaggtagaggtcacaatgag

SEQ ID NO: 58663 - DNA, 20 bp, Artificial Sequence
  chemically synthesized
gctacactcttcttgaaggt

SEQ ID NO: 58664 - DNA, 20 bp, Artificial Sequence
  chemically synthesized
tcagtaaccccagaaacttg

SEQ ID NO: 58665 - DNA, 20 bp, Artificial Sequence
  chemically synthesized
gaaacttgttctgtttttcc

SEQ ID NO: 58666 - DNA, 20 bp, Artificial Sequence
  chemically synthesized
tttggacagcgtccatactg

SEQ ID NO: 58667 - DNA, 20 bp, Artificial Sequence
  chemically synthesized
gcagacagaagctgagtgga

SEQ ID NO: 58668 - DNA, 20 bp, Artificial Sequence
  chemically synthesized
agaaaggagggggcagaagc

SEQ ID NO: 58669 - DNA, 20 bp, Artificial Sequence
  chemically synthesized
atcccttgccctctctgtgc

SEQ ID NO: 58670 - DNA, 20 bp, Artificial Sequence
  chemically synthesized
tggttactgtcaaatcaaat

SEQ ID NO: 58671 - DNA, 20 bp, Artificial Sequence
  chemically synthesized
ctgggaggctgaggcaggag

SEQ ID NO: 58672 - DNA, 20 bp, Artificial Sequence
  chemically synthesized
tcaggaggctaaggcaggag

SEQ ID NO: 58673 - DNA, 20 bp, Artificial Sequence
  chemically synthesized
tgaacctgggaggtggtgag

SEQ ID NO: 58674 - DNA, 20 bp, Artificial Sequence
  chemically synthesized
cacacacatataatactaga

SEQ ID NO: 58675 - DNA, 20 bp, Artificial Sequence
  chemically synthesized
cacatataatactagaaaat

SEQ ID NO: 58676 - DNA, 20 bp, Artificial Sequence
  chemically synthesized
accaaacatcttttgtagaa

SEQ ID NO: 58677 - DNA, 20 bp, Artificial Sequence
  chemically synthesized
aacatcttttgtagaaatat

SEQ ID NO: 58678 - DNA, 20 bp, Artificial Sequence
  chemically synthesized
aatatgtttgctttcatcat

SEQ ID NO: 58679 - DNA, 20 bp, Artificial Sequence
  chemically synthesized
attaatggaggcacagactg

SEQ ID NO: 58680 - DNA, 20 bp, Artificial Sequence
  chemically synthesized
gcacagactggaaagtttaa

SEQ ID NO: 58681 - DNA, 20 bp, Artificial Sequence
  chemically synthesized
caggtggatcacctgaggtc

SEQ ID NO: 58682 - DNA, 20 bp, Artificial Sequence
  chemically synthesized
actccagccttggtgacaga

SEQ ID NO: 58683 - DNA, 20 bp, Artificial Sequence
  chemically synthesized
ttctgtcaggaaaaaaaaaa

SEQ ID NO: 58684 - DNA, 20 bp, Artificial Sequence
  chemically synthesized
ccctggaaagcaggctgaaa

SEQ ID NO: 58685 - DNA, 20 bp, Artificial Sequence
  chemically synthesized
tgaaatggagattcacgtgc

SEQ ID NO: 58686 - DNA, 20 bp, Artificial Sequence
  chemically synthesized
gggcagaaggagaggtccgg

SEQ ID NO: 58687 - DNA, 20 bp, Artificial Sequence
  chemically synthesized
actttgggaggccaagggta

SEQ ID NO: 58688 - DNA, 20 bp, Artificial Sequence
  chemically synthesized
tgggaggccaagggtaggag

SEQ ID NO: 58689 - DNA, 20 bp, Artificial Sequence
  chemically synthesized
ctactcagggggctgaggtg

SEQ ID NO: 58690 - DNA, 20 bp, Artificial Sequence
  chemically synthesized
tcagggggctgaggtgggag

SEQ ID NO: 58691 - DNA, 20 bp, Artificial Sequence
  chemically synthesized
gtcttcaaggatgtgaggaa

SEQ ID NO: 58692 - DNA, 20 bp, Artificial Sequence
  chemically synthesized
gtgaagggctgtctggccag

SEQ ID NO: 58693 - DNA, 20 bp, Artificial Sequence
  chemically synthesized
gcaaaagccctgaggtggga

SEQ ID NO: 58694 - DNA, 20 bp, Artificial Sequence
  chemically synthesized
ctgaggtgggaacgtgtttg

SEQ ID NO: 58695 - DNA, 20 bp, Artificial Sequence
  chemically synthesized
acagaagatgtggagggcag

SEQ ID NO: 58696 - DNA, 20 bp, Artificial Sequence
  chemically synthesized
ttgtaattgtacgcccagta

SEQ ID NO: 58697 - DNA, 20 bp, Artificial Sequence
  chemically synthesized
ctgcaagagcagggcccctc

SEQ ID NO: 58698 - DNA, 20 bp, Artificial Sequence
  chemically synthesized
tgtattcccagagccttgca

SEQ ID NO: 58699 - DNA, 20 bp, Artificial Sequence
  chemically synthesized
agggaaagataaagccgacc

SEQ ID NO: 58700 - DNA, 20 bp, Artificial Sequence
  chemically synthesized
cgctcccacacctgggcagc

SEQ ID NO: 58701 - DNA, 20 bp, Artificial Sequence
  chemically synthesized
ggataaacctcagagtcagg

SEQ ID NO: 58702 - DNA, 20 bp, Artificial Sequence
  chemically synthesized
agggatccagtagtgcaatc

SEQ ID NO: 58703 - DNA, 20 bp, Artificial Sequence
  chemically synthesized
ataaggtagtgaagtagcag

SEQ ID NO: 58704 - DNA, 20 bp, Artificial Sequence
  chemically synthesized
gctggtcttgatctcaagca

SEQ ID NO: 58705 - DNA, 20 bp, Artificial Sequence
  chemically synthesized
tgcctcagcctcctaaaata

SEQ ID NO: 58706 - DNA, 20 bp, Artificial Sequence
  chemically synthesized
ccatctcgcctcactgcaac

SEQ ID NO: 58707 - DNA, 20 bp, Artificial Sequence
  chemically synthesized
ttttttatttttagtagaga

SEQ ID NO: 58708 - DNA, 20 bp, Artificial Sequence
  chemically synthesized
cgcctcagcctcccaaagtg

SEQ ID NO: 58709 - DNA, 20 bp, Artificial Sequence
  chemically synthesized
ttttttttttttttttgaga

SEQ ID NO: 58710 - DNA, 20 bp, Artificial Sequence
  chemically synthesized
tgcctcagcctctcaaatag

SEQ ID NO: 58711 - DNA, 20 bp, Artificial Sequence
  chemically synthesized
aattttttttttagtagaga

SEQ ID NO: 58712 - DNA, 20 bp, Artificial Sequence
  chemically synthesized
cacctcggcctcccaaagtg

SEQ ID NO: 58713 - DNA, 20 bp, Artificial Sequence
  chemically synthesized
cacctcggcctcccaaagta

SEQ ID NO: 58714 - DNA, 20 bp, Artificial Sequence
  chemically synthesized
gcatctttggacttttgagt

SEQ ID NO: 58715 - DNA, 20 bp, Artificial Sequence
  chemically synthesized
aaaaattccactgagagcac

SEQ ID NO: 58716 - DNA, 20 bp, Artificial Sequence
  chemically synthesized
ggctccaacatttctgcagg

SEQ ID NO: 58717 - DNA, 20 bp, Artificial Sequence
  chemically synthesized
atggttgcctcttctgttgc

SEQ ID NO: 58718 - DNA, 20 bp, Artificial Sequence
  chemically synthesized
gcttgaatgtcattttgtgg

SEQ ID NO: 58719 - DNA, 20 bp, Artificial Sequence
  chemically synthesized
tccttctcccccaaacccca

SEQ ID NO: 58720 - DNA, 20 bp, Artificial Sequence
  chemically synthesized
agtcaagaatgagcaacttg

SEQ ID NO: 58721 - DNA, 20 bp, Artificial Sequence
  chemically synthesized
aaattaacgcaccaaattga

SEQ ID NO: 58722 - DNA, 20 bp, Artificial Sequence
  chemically synthesized
attgaattagcttgaaatct

SEQ ID NO: 58723 - DNA, 20 bp, Artificial Sequence
  chemically synthesized
gttgatctcttttataggtt

SEQ ID NO: 58724 - DNA, 20 bp, Artificial Sequence
  chemically synthesized
ttataggttcagagttttga

SEQ ID NO: 58725 - DNA, 20 bp, Artificial Sequence
  chemically synthesized
agagttttgaatatgttttt

SEQ ID NO: 58726 - DNA, 20 bp, Artificial Sequence
  chemically synthesized
ttttgtatttttagcagaga

SEQ ID NO: 58727 - DNA, 20 bp, Artificial Sequence
  chemically synthesized
cgcctcggcctcccaaagcg

SEQ ID NO: 58728 - DNA, 20 bp, Artificial Sequence
  chemically synthesized
ccaccgcaccctgcctgaat

SEQ ID NO: 58729 - DNA, 20 bp, Artificial Sequence
  chemically synthesized
atccaattaacaagggtaag

SEQ ID NO: 58730 - DNA, 20 bp, Artificial Sequence
  chemically synthesized
aagatttaagttaagcataa

SEQ ID NO: 58731 - DNA, 20 bp, Artificial Sequence
  chemically synthesized
aaactgtggaatttctcccc

SEQ ID NO: 58732 - DNA, 20 bp, Artificial Sequence
  chemically synthesized
atgttgagaacaagggagat

SEQ ID NO: 58733 - DNA, 20 bp, Artificial Sequence
  chemically synthesized
acagcatttagtactgggtt

SEQ ID NO: 58734 - DNA, 20 bp, Artificial Sequence
  chemically synthesized
atatcacatgaaaaacctgg

SEQ ID NO: 58735 - DNA, 20 bp, Artificial Sequence
  chemically synthesized
ttcaaatgtgtgacagaggg

SEQ ID NO: 58736 - DNA, 20 bp, Artificial Sequence
  chemically synthesized
atagacagtattagaggggg

SEQ ID NO: 58737 - DNA, 20 bp, Artificial Sequence
  chemically synthesized
gtaggaaatttgcatacggt

SEQ ID NO: 58738 - DNA, 20 bp, Artificial Sequence
  chemically synthesized
gcgaccctcccatctgccat

SEQ ID NO: 58739 - DNA, 20 bp, Artificial Sequence
  chemically synthesized
atccttcctatctctcacag

SEQ ID NO: 58740 - DNA, 20 bp, Artificial Sequence
  chemically synthesized
ttctcattaccttcttcctg

SEQ ID NO: 58741 - DNA, 20 bp, Artificial Sequence
  chemically synthesized
tcttcctgttcagcttcgcc

SEQ ID NO: 58742 - DNA, 20 bp, Artificial Sequence
  chemically synthesized
tgtaagagatgtggagtctt

SEQ ID NO: 58743 - DNA, 20 bp, Artificial Sequence
  chemically synthesized
tttaaagtcaacaaccatgc

SEQ ID NO: 58744 - DNA, 20 bp, Artificial Sequence
  chemically synthesized
cgtggaattaaatcacggat

SEQ ID NO: 58745 - DNA, 20 bp, Artificial Sequence
  chemically synthesized
gatggcagattggagggtcg

SEQ ID NO: 58746 - DNA, 20 bp, Artificial Sequence
  chemically synthesized
ccatatcacgtacaccatat

SEQ ID NO: 58747 - DNA, 20 bp, Artificial Sequence
  chemically synthesized
acaatcctaatcatattggg

SEQ ID NO: 58748 - DNA, 20 bp, Artificial Sequence
  chemically synthesized
gttgctagaagttgggttgt

SEQ ID NO: 58749 - DNA, 20 bp, Artificial Sequence
  chemically synthesized
gaaaagaaggctgcctaagg

SEQ ID NO: 58750 - DNA, 20 bp, Artificial Sequence
  chemically synthesized
gctatgccaagccatgtcta

SEQ ID NO: 58751 - DNA, 20 bp, Artificial Sequence
  chemically synthesized
tgcactctcagtaatggggg

SEQ ID NO: 58752 - DNA, 20 bp, Artificial Sequence
  chemically synthesized
atagatggttagtggggtaa

SEQ ID NO: 58753 - DNA, 20 bp, Artificial Sequence
  chemically synthesized
atacatgttcatcgtatttc

SEQ ID NO: 58754 - DNA, 20 bp, Artificial Sequence
  chemically synthesized
catcctccttataagcccag

SEQ ID NO: 58755 - DNA, 20 bp, Artificial Sequence
  chemically synthesized
ataagcccagctctgctttt

SEQ ID NO: 58756 - DNA, 20 bp, Artificial Sequence
  chemically synthesized
aggctagagggcgactctgg

SEQ ID NO: 58757 - DNA, 20 bp, Artificial Sequence
  chemically synthesized
gcgactctggtggtgctttt

SEQ ID NO: 58758 - DNA, 20 bp, Artificial Sequence
  chemically synthesized
gcaaaatgacaaggggaggg

SEQ ID NO: 58759 - DNA, 20 bp, Artificial Sequence
  chemically synthesized
cagctagccaactcctcctt

SEQ ID NO: 58760 - DNA, 20 bp, Artificial Sequence
  chemically synthesized
caacctcttcctcctggttc

SEQ ID NO: 58761 - DNA, 20 bp, Artificial Sequence
  chemically synthesized
tttttagaattttagaagag

SEQ ID NO: 58762 - DNA, 20 bp, Artificial Sequence
  chemically synthesized
tgccttggcctcccaaggtg

SEQ ID NO: 58763 - DNA, 20 bp, Artificial Sequence
  chemically synthesized
caccgcaccgggccctcctt

SEQ ID NO: 58764 - DNA, 20 bp, Artificial Sequence
  chemically synthesized
aagcctatttatttgaaagt

SEQ ID NO: 58765 - DNA, 20 bp, Artificial Sequence
  chemically synthesized
attttagatgcaatgtgatc

SEQ ID NO: 58766 - DNA, 20 bp, Artificial Sequence
  chemically synthesized
tggcccaactaaatttctag

SEQ ID NO: 58767 - DNA, 20 bp, Artificial Sequence
  chemically synthesized
ctgtttccctaaacaaataa

SEQ ID NO: 58768 - DNA, 20 bp, Artificial Sequence
  chemically synthesized
ccaaaatcagcatagaacca

SEQ ID NO: 58769 - DNA, 20 bp, Artificial Sequence
  chemically synthesized
atccagtaactcagtgtcag

SEQ ID NO: 58770 - DNA, 20 bp, Artificial Sequence
  chemically synthesized
gaatgctcaagggagctatt

SEQ ID NO: 58771 - DNA, 20 bp, Artificial Sequence
  chemically synthesized
ctattgcaggtttctctgct

SEQ ID NO: 58772 - DNA, 20 bp, Artificial Sequence
  chemically synthesized
cctcaaatcatcaccgtatc

SEQ ID NO: 58773 - DNA, 20 bp, Artificial Sequence
  chemically synthesized
tccggagtctgtatattcag

SEQ ID NO: 58774 - DNA, 20 bp, Artificial Sequence
  chemically synthesized
agggaagattgcattctcct

SEQ ID NO: 58775 - DNA, 20 bp, Artificial Sequence
  chemically synthesized
tgcctcagcctcccaaagtg

SEQ ID NO: 58776 - DNA, 20 bp, Artificial Sequence
  chemically synthesized
tgggattacagtgtgagcca

SEQ ID NO: 58777 - DNA, 20 bp, Artificial Sequence
  chemically synthesized
agccactgcgcttggccaga

SEQ ID NO: 58778 - DNA, 20 bp, Artificial Sequence
  chemically synthesized
gatctgtctgaactgaaccc

SEQ ID NO: 58779 - DNA, 20 bp, Artificial Sequence
  chemically synthesized
taaatactgcccccactccc

SEQ ID NO: 58780 - DNA, 20 bp, Artificial Sequence
  chemically synthesized
tgataagaaaacataacaga

SEQ ID NO: 58781 - DNA, 20 bp, Artificial Sequence
  chemically synthesized
ttattgagtgctaactttat

SEQ ID NO: 58782 - DNA, 20 bp, Artificial Sequence
  chemically synthesized
gtactttatttatacaatta

SEQ ID NO: 58783 - DNA, 20 bp, Artificial Sequence
  chemically synthesized
gcactttgggaggctgaggt

SEQ ID NO: 58784 - DNA, 20 bp, Artificial Sequence
  chemically synthesized
agctcagaggttgcagtgag

SEQ ID NO: 58785 - DNA, 20 bp, Artificial Sequence
  chemically synthesized
aataatcattttgtaatata

SEQ ID NO: 58786 - DNA, 20 bp, Artificial Sequence
  chemically synthesized
cactcatctgttccctaagt

SEQ ID NO: 58787 - DNA, 20 bp, Artificial Sequence
  chemically synthesized
agatttacgtccactttaga

SEQ ID NO: 58788 - DNA, 20 bp, Artificial Sequence
  chemically synthesized
ctttagaaatggcttgtgag

SEQ ID NO: 58789 - DNA, 20 bp, Artificial Sequence
  chemically synthesized
ggcaagtttaagtgaccgat

SEQ ID NO: 58790 - DNA, 20 bp, Artificial Sequence
  chemically synthesized
gtagaatgttctagtagtgt

SEQ ID NO: 58791 - DNA, 20 bp, Artificial Sequence
  chemically synthesized
agtgtatcagttttcaggtg

SEQ ID NO: 58792 - DNA, 20 bp, Artificial Sequence
  chemically synthesized
tgccacatcacacatagacc

SEQ ID NO: 58793 - DNA, 20 bp, Artificial Sequence
  chemically synthesized
atcacacatagaccaaaggc

SEQ ID NO: 58794 - DNA, 20 bp, Artificial Sequence
  chemically synthesized
agaccaaaggcttaggtttt

SEQ ID NO: 58795 - DNA, 20 bp, Artificial Sequence
  chemically synthesized
gcatgagctgctgcactcag

SEQ ID NO: 58796 - DNA, 20 bp, Artificial Sequence
  chemically synthesized
gctgctgcactcagccatgt

SEQ ID NO: 58797 - DNA, 20 bp, Artificial Sequence
  chemically synthesized
ttgagaggctgagacaggag

SEQ ID NO: 58798 - DNA, 20 bp, Artificial Sequence
  chemically synthesized
aaaaaaaaaaaaagctgtat

SEQ ID NO: 58799 - DNA, 20 bp, Artificial Sequence
  chemically synthesized
tcatttaaagtgtacaattc

SEQ ID NO: 58800 - DNA, 20 bp, Artificial Sequence
  chemically synthesized
cactaatctactttctgtct

SEQ ID NO: 58801 - DNA, 20 bp, Artificial Sequence
  chemically synthesized
ctggcctctttcacttagca

SEQ ID NO: 58802 - DNA, 20 bp, Artificial Sequence
  chemically synthesized
ttcacttagcatgatgtttt

SEQ ID NO: 58803 - DNA, 20 bp, Artificial Sequence
  chemically synthesized
gaatataccacattttattt

SEQ ID NO: 58804 - DNA, 20 bp, Artificial Sequence
  chemically synthesized
cactttgggaggctgaggca

SEQ ID NO: 58805 - DNA, 20 bp, Artificial Sequence
  chemically synthesized
tgcctcagcctcccaaagtg

SEQ ID NO: 58806 - DNA, 20 bp, Artificial Sequence
  chemically synthesized
ggcaaatctatgagacagaa

SEQ ID NO: 58807 - DNA, 20 bp, Artificial Sequence
  chemically synthesized
gaaagtagattagtggttgc

SEQ ID NO: 58808 - DNA, 20 bp, Artificial Sequence
  chemically synthesized
aattatatctcaagctgtta

SEQ ID NO: 58809 - DNA, 20 bp, Artificial Sequence
  chemically synthesized
agctttttttttttttgaga

SEQ ID NO: 58810 - DNA, 20 bp, Artificial Sequence
  chemically synthesized
tgtctcagcctctcaagtag

SEQ ID NO: 58811 - DNA, 20 bp, Artificial Sequence
  chemically synthesized
ttttgtatttttagtagaga

SEQ ID NO: 58812 - DNA, 20 bp, Artificial Sequence
  chemically synthesized
atctcaggtgatctgcctgc

SEQ ID NO: 58813 - DNA, 20 bp, Artificial Sequence
  chemically synthesized
tgccttggcttcccaaagtg

SEQ ID NO: 58814 - DNA, 20 bp, Artificial Sequence
  chemically synthesized
tttgggaggctaaggcggga

SEQ ID NO: 58815 - DNA, 20 bp, Artificial Sequence
  chemically synthesized
gagttggaggttgcagtgag

SEQ ID NO: 58816 - DNA, 20 bp, Artificial Sequence
  chemically synthesized
atgccataacatgacatgga

SEQ ID NO: 58817 - DNA, 20 bp, Artificial Sequence
  chemically synthesized
aataagcaggatatattaca

SEQ ID NO: 58818 - DNA, 20 bp, Artificial Sequence
  chemically synthesized
acaaaatgattattttgtat

SEQ ID NO: 58819 - DNA, 20 bp, Artificial Sequence
  chemically synthesized
gagccacagcacccagccca

SEQ ID NO: 58820 - DNA, 20 bp, Artificial Sequence
  chemically synthesized
cacagcacccagcccagact

SEQ ID NO: 58821 - DNA, 20 bp, Artificial Sequence
  chemically synthesized
tcactgcaacctctgagctc

SEQ ID NO: 58822 - DNA, 20 bp, Artificial Sequence
  chemically synthesized
aggaccacaggcatgcacca

SEQ ID NO: 58823 - DNA, 20 bp, Artificial Sequence
  chemically synthesized
catgcaccaccacgcttggc

SEQ ID NO: 58824 - DNA, 20 bp, Artificial Sequence
  chemically synthesized
cacctcagcctcccaaagtg

SEQ ID NO: 58825 - DNA, 20 bp, Artificial Sequence
  chemically synthesized
cactcaataaactttatctg

SEQ ID NO: 58826 - DNA, 20 bp, Artificial Sequence
  chemically synthesized
ggacttggtccttgggagca

SEQ ID NO: 58827 - DNA, 20 bp, Artificial Sequence
  chemically synthesized
ctttctccctggttgggacc

SEQ ID NO: 58828 - DNA, 20 bp, Artificial Sequence
  chemically synthesized
ggagttcaggtgtgaaatag

SEQ ID NO: 58829 - DNA, 20 bp, Artificial Sequence
  chemically synthesized
caggaaatccattgatacgg

SEQ ID NO: 58830 - DNA, 20 bp, Artificial Sequence
  chemically synthesized
ttccttggtgctgtgactgg

SEQ ID NO: 58831 - DNA, 20 bp, Artificial Sequence
  chemically synthesized
aaccttgctgacactgagtt

SEQ ID NO: 58832 - DNA, 20 bp, Artificial Sequence
  chemically synthesized
gtgttactgcaacttgtgtg

SEQ ID NO: 58833 - DNA, 20 bp, Artificial Sequence
  chemically synthesized
tactgcaacttgtgtgccct

SEQ ID NO: 58834 - DNA, 20 bp, Artificial Sequence
  chemically synthesized
tctgaatctttctggttcta

SEQ ID NO: 58835 - DNA, 20 bp, Artificial Sequence
  chemically synthesized
gttctatgctgattttgggc

SEQ ID NO: 58836 - DNA, 20 bp, Artificial Sequence
  chemically synthesized
aggcacagagaaaccaaatt

SEQ ID NO: 58837 - DNA, 20 bp, Artificial Sequence
  chemically synthesized
gactttattcttaaataaaa

SEQ ID NO: 58838 - DNA, 20 bp, Artificial Sequence
  chemically synthesized
aaagatgttatgagcaggat

SEQ ID NO: 58839 - DNA, 20 bp, Artificial Sequence
  chemically synthesized
aaacaaggactttcaaataa

SEQ ID NO: 58840 - DNA, 20 bp, Artificial Sequence
  chemically synthesized
ggactttcaaataaataggc

SEQ ID NO: 58841 - DNA, 20 bp, Artificial Sequence
  chemically synthesized
agaaatactctgcatatcag

SEQ ID NO: 58842 - DNA, 20 bp, Artificial Sequence
  chemically synthesized
tgaggaggctgagacatgag

SEQ ID NO: 58843 - DNA, 20 bp, Artificial Sequence
  chemically synthesized
ggagttggctagctggacat

SEQ ID NO: 58844 - DNA, 20 bp, Artificial Sequence
  chemically synthesized
acgctgtggtagggtgggag

SEQ ID NO: 58845 - DNA, 20 bp, Artificial Sequence
  chemically synthesized
cctttaagaatgtgctcttg

SEQ ID NO: 58846 - DNA, 20 bp, Artificial Sequence
  chemically synthesized
ccctccccttgtcattttgc

SEQ ID NO: 58847 - DNA, 20 bp, Artificial Sequence
  chemically synthesized
agaatctggaaaaagcagag

SEQ ID NO: 58848 - DNA, 20 bp, Artificial Sequence
  chemically synthesized
aggagatgtcagctatacct

SEQ ID NO: 58849 - DNA, 20 bp, Artificial Sequence
  chemically synthesized
tataattaaagccatttaga

SEQ ID NO: 58850 - DNA, 20 bp, Artificial Sequence
  chemically synthesized
ttaggcagccttcttttcct

SEQ ID NO: 58851 - DNA, 20 bp, Artificial Sequence
  chemically synthesized
tctcagttaggatctccagc

SEQ ID NO: 58852 - DNA, 20 bp, Artificial Sequence
  chemically synthesized
gagctggccctacctggaag

SEQ ID NO: 58853 - DNA, 20 bp, Artificial Sequence
  chemically synthesized
tctagcaacaggtctttctc

SEQ ID NO: 58854 - DNA, 20 bp, Artificial Sequence
  chemically synthesized
aggtctttctcaatagcttc

SEQ ID NO: 58855 - DNA, 20 bp, Artificial Sequence
  chemically synthesized
cttttcaaaaacattaccca

SEQ ID NO: 58856 - DNA, 20 bp, Artificial Sequence
  chemically synthesized
aaaaacattacccaatatga

SEQ ID NO: 58857 - DNA, 20 bp, Artificial Sequence
  chemically synthesized
gcgaccctccaatctgccat

SEQ ID NO: 58858 - DNA, 20 bp, Artificial Sequence
  chemically synthesized
ttgctccaaataccagtgcc

SEQ ID NO: 58859 - DNA, 20 bp, Artificial Sequence
  chemically synthesized
agaccagctcgacttgggat

SEQ ID NO: 58860 - DNA, 20 bp, Artificial Sequence
  chemically synthesized
ggcggaatgggagccacttg

SEQ ID NO: 58861 - DNA, 20 bp, Artificial Sequence
  chemically synthesized
tctggctgctcgcaccacct

SEQ ID NO: 58862 - DNA, 20 bp, Artificial Sequence
  chemically synthesized
tagatgctgtggatgtggct

SEQ ID NO: 58863 - DNA, 20 bp, Artificial Sequence
  chemically synthesized
agcatgactgtgagagatag

SEQ ID NO: 58864 - DNA, 20 bp, Artificial Sequence
  chemically synthesized
atttgggacctttgctagag

SEQ ID NO: 58865 - DNA, 20 bp, Artificial Sequence
  chemically synthesized
gatggcagatgggagggtcg

SEQ ID NO: 58866 - DNA, 20 bp, Artificial Sequence
  chemically synthesized
tccattttatctttgaacgg

SEQ ID NO: 58867 - DNA, 20 bp, Artificial Sequence
  chemically synthesized
tctctctaacctaaacattc

SEQ ID NO: 58868 - DNA, 20 bp, Artificial Sequence
  chemically synthesized
ttcccaggtttttcatgtga

SEQ ID NO: 58869 - DNA, 20 bp, Artificial Sequence
  chemically synthesized
tactaaatgctgtgttactt

SEQ ID NO: 58870 - DNA, 20 bp, Artificial Sequence
  chemically synthesized
aatctccaggggagaaattc

SEQ ID NO: 58871 - DNA, 20 bp, Artificial Sequence
  chemically synthesized
tgcctcccacaaaatctttc

SEQ ID NO: 58872 - DNA, 20 bp, Artificial Sequence
  chemically synthesized
gtggctcacccttgtaatcc

SEQ ID NO: 58873 - DNA, 20 bp, Artificial Sequence
  chemically synthesized
aatggcgtgaacccaggagg

SEQ ID NO: 58874 - DNA, 20 bp, Artificial Sequence
  chemically synthesized
agatcaactgcagttatcta

SEQ ID NO: 58875 - DNA, 20 bp, Artificial Sequence
  chemically synthesized
caaatgaatgtatttaaatg

SEQ ID NO: 58876 - DNA, 20 bp, Artificial Sequence
  chemically synthesized
cgtgttaatttgttaaattt

SEQ ID NO: 58877 - DNA, 20 bp, Artificial Sequence
  chemically synthesized
tgttgaagaccagtaagaaa

SEQ ID NO: 58878 - DNA, 20 bp, Artificial Sequence
  chemically synthesized
aataaagattgtaaaaagct

SEQ ID NO: 58879 - DNA, 20 bp, Artificial Sequence
  chemically synthesized
acccacagaaatgctaacag

SEQ ID NO: 58880 - DNA, 20 bp, Artificial Sequence
  chemically synthesized
cacaggatgtggctggaatg

SEQ ID NO: 58881 - DNA, 20 bp, Artificial Sequence
  chemically synthesized
gctggaatgctgggattttg

SEQ ID NO: 58882 - DNA, 20 bp, Artificial Sequence
  chemically synthesized
gattagggagagaaacggaa

SEQ ID NO: 58883 - DNA, 20 bp, Artificial Sequence
  chemically synthesized
atgaggaaaatgagcagcaa

SEQ ID NO: 58884 - DNA, 20 bp, Artificial Sequence
  chemically synthesized
gatcaaaattgaccaggcac

SEQ ID NO: 58885 - DNA, 20 bp, Artificial Sequence
  chemically synthesized
aattgaccaggcacggtggc

SEQ ID NO: 58886 - DNA, 20 bp, Artificial Sequence
  chemically synthesized
tgggtggatcacttgaggtc

SEQ ID NO: 58887 - DNA, 20 bp, Artificial Sequence
  chemically synthesized
ttgagaggctgaggcaggag

SEQ ID NO: 58888 - DNA, 20 bp, Artificial Sequence
  chemically synthesized
tcggtaggctgaggcagaag

SEQ ID NO: 58889 - DNA, 20 bp, Artificial Sequence
  chemically synthesized
actccagcctgggcaacaga

SEQ ID NO: 58890 - DNA, 20 bp, Artificial Sequence
  chemically synthesized
aattttaacttccctatttt

SEQ ID NO: 58891 - DNA, 20 bp, Artificial Sequence
  chemically synthesized
tattttatctgtttgataat

SEQ ID NO: 58892 - DNA, 20 bp, Artificial Sequence
  chemically synthesized
ttaggaggctgaggcaagcc

SEQ ID NO: 58893 - DNA, 20 bp, Artificial Sequence
  chemically synthesized
tcagatggctgaggtgggag

SEQ ID NO: 58894 - DNA, 20 bp, Artificial Sequence
  chemically synthesized
catctcaaaaataaaaataa

SEQ ID NO: 58895 - DNA, 20 bp, Artificial Sequence
  chemically synthesized
ttctctgtagtaggaatatc

SEQ ID NO: 58896 - DNA, 20 bp, Artificial Sequence
  chemically synthesized
actctgtggttggtacagac

SEQ ID NO: 58897 - DNA, 20 bp, Artificial Sequence
  chemically synthesized
ttataagtcccttcatggtg

SEQ ID NO: 58898 - DNA, 20 bp, Artificial Sequence
  chemically synthesized
agtcccttcatggtgttggg

SEQ ID NO: 58899 - DNA, 20 bp, Artificial Sequence
  chemically synthesized
tgtttccttatctgtaaaac

SEQ ID NO: 58900 - DNA, 20 bp, Artificial Sequence
  chemically synthesized
gcccaaacattccctgactc

SEQ ID NO: 58901 - DNA, 20 bp, Artificial Sequence
  chemically synthesized
gttcttaccgaaatctgtag

SEQ ID NO: 58902 - DNA, 20 bp, Artificial Sequence
  chemically synthesized
ccagagaggggccctgctct

SEQ ID NO: 58903 - DNA, 20 bp, Artificial Sequence
  chemically synthesized
tcttgcagtttaatacagtc

SEQ ID NO: 58904 - DNA, 20 bp, Artificial Sequence
  chemically synthesized
tgttctggctacactggcct

SEQ ID NO: 58905 - DNA, 20 bp, Artificial Sequence
  chemically synthesized
caccaaacacgttcccacct

SEQ ID NO: 58906 - DNA, 20 bp, Artificial Sequence
  chemically synthesized
actctgaccacgctatttaa

SEQ ID NO: 58907 - DNA, 20 bp, Artificial Sequence
  chemically synthesized
ttaaccctgcttgcaaccgg

SEQ ID NO: 58908 - DNA, 20 bp, Artificial Sequence
  chemically synthesized
gcaaccggttccgttttttt

SEQ ID NO: 58909 - DNA, 20 bp, Artificial Sequence
  chemically synthesized
ccggttccgtttttttattt

SEQ ID NO: 58910 - DNA, 20 bp, Artificial Sequence
  chemically synthesized
cgtttttttatttgtttgtt

SEQ ID NO: 58911 - DNA, 20 bp, Artificial Sequence
  chemically synthesized
ttgtttttttagagacagtg

SEQ ID NO: 58912 - DNA, 20 bp, Artificial Sequence
  chemically synthesized
acacacagcaaattttttaa

SEQ ID NO: 58913 - DNA, 20 bp, Artificial Sequence
  chemically synthesized
cagcaaattttttaaatgtg

SEQ ID NO: 58914 - DNA, 20 bp, Artificial Sequence
  chemically synthesized
aaattttttaaatgtgtttt

SEQ ID NO: 58915 - DNA, 20 bp, Artificial Sequence
  chemically synthesized
tttttaaatgtgttttgttt

SEQ ID NO: 58916 - DNA, 20 bp, Artificial Sequence
  chemically synthesized
taaatgtgttttgtttgttt

SEQ ID NO: 58917 - DNA, 20 bp, Artificial Sequence
  chemically synthesized
tgtgttttgtttgtttgttt

SEQ ID NO: 58918 - DNA, 20 bp, Artificial Sequence
  chemically synthesized
gtttgattgtttttgcccag

SEQ ID NO: 58919 - DNA, 20 bp, Artificial Sequence
  chemically synthesized
acccttggcctcccaaagtg

SEQ ID NO: 58920 - DNA, 20 bp, Artificial Sequence
  chemically synthesized
ctgttgagagtgtgatggta

SEQ ID NO: 58921 - DNA, 20 bp, Artificial Sequence
  chemically synthesized
aaggttacgctctccccagg

SEQ ID NO: 58922 - DNA, 20 bp, Artificial Sequence
  chemically synthesized
accaactctgaggagccatc

SEQ ID NO: 58923 - DNA, 20 bp, Artificial Sequence
  chemically synthesized
gcacgtgaatctccatttca

SEQ ID NO: 58924 - DNA, 20 bp, Artificial Sequence
  chemically synthesized
agggaaccccatagataaat

SEQ ID NO: 58925 - DNA, 20 bp, Artificial Sequence
  chemically synthesized
accaaggctggagtgcagtg

SEQ ID NO: 58926 - DNA, 20 bp, Artificial Sequence
  chemically synthesized
aacctctgcctcccgggttg

SEQ ID NO: 58927 - DNA, 20 bp, Artificial Sequence
  chemically synthesized
tgccgcagcctcctgggtag

SEQ ID NO: 58928 - DNA, 20 bp, Artificial Sequence
  chemically synthesized
gcgcccgccaccatgcctgg

SEQ ID NO: 58929 - DNA, 20 bp, Artificial Sequence
  chemically synthesized
ttgtatttttttattagtga

SEQ ID NO: 58930 - DNA, 20 bp, Artificial Sequence
  chemically synthesized
tgcgttggcctcccaaagtg

SEQ ID NO: 58931 - DNA, 20 bp, Artificial Sequence
  chemically synthesized
cctaaggagcagagataata

SEQ ID NO: 58932 - DNA, 20 bp, Artificial Sequence
  chemically synthesized
agcaaacatatttctacaaa

SEQ ID NO: 58933 - DNA, 20 bp, Artificial Sequence
  chemically synthesized
gctcaccacctcccaggttc

SEQ ID NO: 58934 - DNA, 20 bp, Artificial Sequence
  chemically synthesized
tgccttagcctcctgagtag

SEQ ID NO: 58935 - DNA, 20 bp, Artificial Sequence
  chemically synthesized
ttttgtatttttagtagaga

SEQ ID NO: 58936 - DNA, 20 bp, Artificial Sequence
  chemically synthesized
cgcctcagcctcccaaagtg

SEQ ID NO: 58937 - DNA, 20 bp, Artificial Sequence
  chemically synthesized
cctggcctatcctacatatt

SEQ ID NO: 58938 - DNA, 20 bp, Artificial Sequence
  chemically synthesized
aacctctgcctcccaggttc

SEQ ID NO: 58939 - DNA, 20 bp, Artificial Sequence
  chemically synthesized
tttttccatttttagtaaag

SEQ ID NO: 58940 - DNA, 20 bp, Artificial Sequence
  chemically synthesized
gattttgcaatgttggccag

SEQ ID NO: 58941 - DNA, 20 bp, Artificial Sequence
  chemically synthesized
acctcaggtgatctacctac

SEQ ID NO: 58942 - DNA, 20 bp, Artificial Sequence
  chemically synthesized
taccttggcttcccaaagtg

SEQ ID NO: 58943 - DNA, 20 bp, Artificial Sequence
  chemically synthesized
gcatgagcaaccacaactgg

SEQ ID NO: 58944 - DNA, 20 bp, Artificial Sequence
  chemically synthesized
tgtatatttcacctcctcta

SEQ ID NO: 58945 - DNA, 20 bp, Artificial Sequence
  chemically synthesized
aacagtgtatagctcccagt

SEQ ID NO: 58946 - DNA, 20 bp, Artificial Sequence
  chemically synthesized
caaataactaagggaccttc

SEQ ID NO: 58947 - DNA, 20 bp, Artificial Sequence
  chemically synthesized
ctgagactttagggtgaggg

SEQ ID NO: 58948 - DNA, 20 bp, Artificial Sequence
  chemically synthesized
tactgaaaatgaaatctatc

SEQ ID NO: 58949 - DNA, 20 bp, Artificial Sequence
  chemically synthesized
aacgtaggcacagagagggc

SEQ ID NO: 58950 - DNA, 20 bp, Artificial Sequence
  chemically synthesized
tgggaaggacccccagaagc

SEQ ID NO: 58951 - DNA, 20 bp, Artificial Sequence
  chemically synthesized
tccatccaggttctgtaata

SEQ ID NO: 58952 - DNA, 20 bp, Artificial Sequence
  chemically synthesized
tctcctcatgtcccctcaag

SEQ ID NO: 58953 - DNA, 20 bp, Artificial Sequence
  chemically synthesized
taacaggtaaacgaggtcca

SEQ ID NO: 58954 - DNA, 20 bp, Artificial Sequence
  chemically synthesized
gcttctgtctgcaggggctg

SEQ ID NO: 58955 - DNA, 20 bp, Artificial Sequence
  chemically synthesized
cagtctcacaggttacaggg

SEQ ID NO: 58956 - DNA, 20 bp, Artificial Sequence
  chemically synthesized
gaatcctatggaaaaacaga

SEQ ID NO: 58957 - DNA, 20 bp, Artificial Sequence
  chemically synthesized
agtttctggggttactgaat

SEQ ID NO: 58958 - DNA, 20 bp, Artificial Sequence
  chemically synthesized
tcaagaagagtgtagcctga

SEQ ID NO: 58959 - DNA, 20 bp, Artificial Sequence
  chemically synthesized
tatgtaacttttgcattttg

SEQ ID NO: 58960 - DNA, 20 bp, Artificial Sequence
  chemically synthesized
ggtgtgtgccaccacatcca

SEQ ID NO: 58961 - DNA, 20 bp, Artificial Sequence
  chemically synthesized
ttttgtatttttagtagaga

SEQ ID NO: 58962 - DNA, 20 bp, Artificial Sequence
  chemically synthesized
cacctcagcctcccaaagtg

SEQ ID NO: 58963 - DNA, 20 bp, Artificial Sequence
  chemically synthesized
ttaaacacaaataatgaagc

SEQ ID NO: 58964 - DNA, 20 bp, Artificial Sequence
  chemically synthesized
caggcagatcacatgaggtc

SEQ ID NO: 58965 - DNA, 20 bp, Artificial Sequence
  chemically synthesized
gcctggccaacatggtgaaa

SEQ ID NO: 58966 - DNA, 20 bp, Artificial Sequence
  chemically synthesized
tcgggaggctaaggcaagag

SEQ ID NO: 58967 - DNA, 20 bp, Artificial Sequence
  chemically synthesized
gaggcggaggttgccgtgag

SEQ ID NO: 58968 - DNA, 20 bp, Artificial Sequence
  chemically synthesized
tggaagaatgcatatggaac

SEQ ID NO: 58969 - DNA, 20 bp, Artificial Sequence
  chemically synthesized
ttgctctctgtaaggatgta

SEQ ID NO: 58970 - DNA, 20 bp, Artificial Sequence
  chemically synthesized
gtaaggatgtatatagcttc

SEQ ID NO: 58971 - DNA, 20 bp, Artificial Sequence
  chemically synthesized
tttatcccgtgatggtggaa

SEQ ID NO: 58972 - DNA, 20 bp, Artificial Sequence
  chemically synthesized
ctctggcctctatcaaccca

SEQ ID NO: 58973 - DNA, 20 bp, Artificial Sequence
  chemically synthesized
atggttcttcaatggagatc

SEQ ID NO: 58974 - DNA, 20 bp, Artificial Sequence
  chemically synthesized
gaggcagaggttgcagtgag

SEQ ID NO: 58975 - DNA, 20 bp, Artificial Sequence
  chemically synthesized
aaagaaagtggccagaatgg

SEQ ID NO: 58976 - DNA, 20 bp, Artificial Sequence
  chemically synthesized
aaattggcaaatgctaaact

SEQ ID NO: 58977 - DNA, 20 bp, Artificial Sequence
  chemically synthesized
tttcccctgctccccagaga

SEQ ID NO: 58978 - DNA, 20 bp, Artificial Sequence
  chemically synthesized
gcggaagccagcctgcctac

SEQ ID NO: 58979 - DNA, 20 bp, Artificial Sequence
  chemically synthesized
agcaccttggtctctgcatc

SEQ ID NO: 58980 - DNA, 20 bp, Artificial Sequence
  chemically synthesized
atagcacatggactggcaca

SEQ ID NO: 58981 - DNA, 20 bp, Artificial Sequence
  chemically synthesized
cactgtttaataaatgttaa

SEQ ID NO: 58982 - DNA, 20 bp, Artificial Sequence
  chemically synthesized
gctgccagagataacctatt

SEQ ID NO: 58983 - DNA, 20 bp, Artificial Sequence
  chemically synthesized
aacaggctgttgaatcatct

SEQ ID NO: 58984 - DNA, 20 bp, Artificial Sequence
  chemically synthesized
acacgcccagctaattttcg

SEQ ID NO: 58985 - DNA, 20 bp, Artificial Sequence
  chemically synthesized
tcgtaatgtttttgtagaga

SEQ ID NO: 58986 - DNA, 20 bp, Artificial Sequence
  chemically synthesized
gaactcctgagttcacccag

SEQ ID NO: 58987 - DNA, 20 bp, Artificial Sequence
  chemically synthesized
cacctcggcctcccaaagtg

SEQ ID NO: 58988 - DNA, 20 bp, Artificial Sequence
  chemically synthesized
atctttctttatgttacctc

SEQ ID NO: 58989 - DNA, 20 bp, Artificial Sequence
  chemically synthesized
taccctttaacccatatgaa

SEQ ID NO: 58990 - DNA, 20 bp, Artificial Sequence
  chemically synthesized
cctgtattttcaactcactg

SEQ ID NO: 58991 - DNA, 20 bp, Artificial Sequence
  chemically synthesized
ggttggaagcatgagtagcc

SEQ ID NO: 58992 - DNA, 20 bp, Artificial Sequence
  chemically synthesized
ctccaatcacagctacccaa

SEQ ID NO: 58993 - DNA, 20 bp, Artificial Sequence
  chemically synthesized
acccaaaggagtttaatgcc

SEQ ID NO: 58994 - DNA, 20 bp, Artificial Sequence
  chemically synthesized
gcagagcccttgcagttatt

SEQ ID NO: 58995 - DNA, 20 bp, Artificial Sequence
  chemically synthesized
tgcagttattccaggcttgg

SEQ ID NO: 58996 - DNA, 20 bp, Artificial Sequence
  chemically synthesized
gctatgagtctgtgccttgc

SEQ ID NO: 58997 - DNA, 20 bp, Artificial Sequence
  chemically synthesized
ctgatctttggactcaaaaa

SEQ ID NO: 58998 - DNA, 20 bp, Artificial Sequence
  chemically synthesized
ggttgatgcaaacatgttca

SEQ ID NO: 58999 - DNA, 20 bp, Artificial Sequence
  chemically synthesized
ggccatgtactcagcagggc

SEQ ID NO: 59000 - DNA, 20 bp, Artificial Sequence
  chemically synthesized
agggccaatgattaactttg

SEQ ID NO: 59001 - DNA, 20 bp, Artificial Sequence
  chemically synthesized
caggacagagtctacatcca

SEQ ID NO: 59002 - DNA, 20 bp, Artificial Sequence
  chemically synthesized
acgatgattcttgcaaagat

SEQ ID NO: 59003 - DNA, 20 bp, Artificial Sequence
  chemically synthesized
aatcttggtgctctagctat

SEQ ID NO: 59004 - DNA, 20 bp, Artificial Sequence
  chemically synthesized
cctgggcaacaaagcaagac

SEQ ID NO: 59005 - DNA, 20 bp, Artificial Sequence
  chemically synthesized
ttctacacaaaaatttaaaa

SEQ ID NO: 59006 - DNA, 20 bp, Artificial Sequence
  chemically synthesized
ctattcaggaggctgaggca

SEQ ID NO: 59007 - DNA, 20 bp, Artificial Sequence
  chemically synthesized
tcaggaggctgaggcaggag

SEQ ID NO: 59008 - DNA, 20 bp, Artificial Sequence
  chemically synthesized
attagagtctagggtctgcc

SEQ ID NO: 59009 - DNA, 20 bp, Artificial Sequence
  chemically synthesized
gtctcttagggccagaaagt

SEQ ID NO: 59010 - DNA, 20 bp, Artificial Sequence
  chemically synthesized
aaagtaatcgtttttgaatg

SEQ ID NO: 59011 - DNA, 20 bp, Artificial Sequence
  chemically synthesized
cttaaagttacagcccttgg

SEQ ID NO: 59012 - DNA, 20 bp, Artificial Sequence
  chemically synthesized
ttttctatcttttgtagaga

SEQ ID NO: 59013 - DNA, 20 bp, Artificial Sequence
  chemically synthesized
agctcaagagatctgccagt

SEQ ID NO: 59014 - DNA, 20 bp, Artificial Sequence
  chemically synthesized
agtcttggcttcccaaagct

SEQ ID NO: 59015 - DNA, 20 bp, Artificial Sequence
  chemically synthesized
gtgaaccaccatgcctggcc

SEQ ID NO: 59016 - DNA, 20 bp, Artificial Sequence
  chemically synthesized
ctggccaagtgttttaactc

SEQ ID NO: 59017 - DNA, 20 bp, Artificial Sequence
  chemically synthesized
aaatggtaactggagactta

SEQ ID NO: 59018 - DNA, 20 bp, Artificial Sequence
  chemically synthesized
actttcagttatttttgaaa

SEQ ID NO: 59019 - DNA, 20 bp, Artificial Sequence
  chemically synthesized
tgaaaaagggcttctatatc

SEQ ID NO: 59020 - DNA, 20 bp, Artificial Sequence
  chemically synthesized
taaaaaatagggctatttaa

SEQ ID NO: 59021 - DNA, 20 bp, Artificial Sequence
  chemically synthesized
gcccaggctggtctcaaatt

SEQ ID NO: 59022 - DNA, 20 bp, Artificial Sequence
  chemically synthesized
cgcctcaacctagcaaagca

SEQ ID NO: 59023 - DNA, 20 bp, Artificial Sequence
  chemically synthesized
gataagagccagggggaata

SEQ ID NO: 59024 - DNA, 20 bp, Artificial Sequence
  chemically synthesized
ttgacagcattccatgctgg

SEQ ID NO: 59025 - DNA, 20 bp, Artificial Sequence
  chemically synthesized
actccagttgtccttgactg

SEQ ID NO: 59026 - DNA, 20 bp, Artificial Sequence
  chemically synthesized
attgcagtgacctctgggat

SEQ ID NO: 59027 - DNA, 20 bp, Artificial Sequence
  chemically synthesized
tggtcagcatatggggaggg

SEQ ID NO: 59028 - DNA, 20 bp, Artificial Sequence
  chemically synthesized
ctttccacctgccagcccct

SEQ ID NO: 59029 - DNA, 20 bp, Artificial Sequence
  chemically synthesized
gcccctttctgcttcctcca

SEQ ID NO: 59030 - DNA, 20 bp, Artificial Sequence
  chemically synthesized
cgtgggaaaacaggtgaggc

SEQ ID NO: 59031 - DNA, 20 bp, Artificial Sequence
  chemically synthesized
agctgactgcatcgagacac

SEQ ID NO: 59032 - DNA, 20 bp, Artificial Sequence
  chemically synthesized
gatatatgaggcgagtggct

SEQ ID NO: 59033 - DNA, 20 bp, Artificial Sequence
  chemically synthesized
tgctgagaatccactcattt

SEQ ID NO: 59034 - DNA, 20 bp, Artificial Sequence
  chemically synthesized
ctcactgcagcctcagtctc

SEQ ID NO: 59035 - DNA, 20 bp, Artificial Sequence
  chemically synthesized
tcagtctcctgggcttaagg

SEQ ID NO: 59036 - DNA, 22 bp, Artificial Sequence
  chemically synthesized
gctgggtttggtggtgtgcgcc

SEQ ID NO: 59037 - DNA, 22 bp, Artificial Sequence
  chemically synthesized
ggtttggtggtgtgcgcctgta

SEQ ID NO: 59038 - DNA, 22 bp, Artificial Sequence
  chemically synthesized
ggtggtgtgcgcctgtaggccc

SEQ ID NO: 59039 - DNA, 22 bp, Artificial Sequence
  chemically synthesized
gtggtgtgcgcctgtaggccca

SEQ ID NO: 59040 - DNA, 22 bp, Artificial Sequence
  chemically synthesized
taggcccagctacccagagact

SEQ ID NO: 59041 - DNA, 22 bp, Artificial Sequence
  chemically synthesized
cccagagactgatgcaaaacga

SEQ ID NO: 59042 - DNA, 22 bp, Artificial Sequence
  chemically synthesized
atgcaaaacgatcccttaagcc

SEQ ID NO: 59043 - DNA, 22 bp, Artificial Sequence
  chemically synthesized
aagcccaggagactgaggctgc

SEQ ID NO: 59044 - DNA, 22 bp, Artificial Sequence
  chemically synthesized
agcccaggagactgaggctgca

SEQ ID NO: 59045 - DNA, 22 bp, Artificial Sequence
  chemically synthesized
aggctgcagtgagctgtgatgg

SEQ ID NO: 59046 - DNA, 22 bp, Artificial Sequence
  chemically synthesized
cagtgagctgtgatggtgccac

SEQ ID NO: 59047 - DNA, 22 bp, Artificial Sequence
  chemically synthesized
tgatggtgccaccgcactccag

SEQ ID NO: 59048 - DNA, 22 bp, Artificial Sequence
  chemically synthesized
cagcctgggtaacagagtgaga

SEQ ID NO: 59049 - DNA, 22 bp, Artificial Sequence
  chemically synthesized
ggtaacagagtgagaccccgtc

SEQ ID NO: 59050 - DNA, 22 bp, Artificial Sequence
  chemically synthesized
aaataaacagataaatgagtgg

SEQ ID NO: 59051 - DNA, 22 bp, Artificial Sequence
  chemically synthesized
tcagcaaaacttctagccactc

SEQ ID NO: 59052 - DNA, 22 bp, Artificial Sequence
  chemically synthesized
agcaaaacttctagccactcgc

SEQ ID NO: 59053 - DNA, 22 bp, Artificial Sequence
  chemically synthesized
ctagccactcgcctcatatatc

SEQ ID NO: 59054 - DNA, 22 bp, Artificial Sequence
  chemically synthesized
tagccactcgcctcatatatcc

SEQ ID NO: 59055 - DNA, 22 bp, Artificial Sequence
  chemically synthesized
gccactcgcctcatatatccac

SEQ ID NO: 59056 - DNA, 22 bp, Artificial Sequence
  chemically synthesized
gcctcatatatccacaagacct

SEQ ID NO: 59057 - DNA, 22 bp, Artificial Sequence
  chemically synthesized
atatatccacaagacctttgag

SEQ ID NO: 59058 - DNA, 22 bp, Artificial Sequence
  chemically synthesized
tgagaatccacggtgtctcgat

SEQ ID NO: 59059 - DNA, 22 bp, Artificial Sequence
  chemically synthesized
gagaatccacggtgtctcgatg

SEQ ID NO: 59060 - DNA, 22 bp, Artificial Sequence
  chemically synthesized
agaatccacggtgtctcgatgc

SEQ ID NO: 59061 - DNA, 22 bp, Artificial Sequence
  chemically synthesized
gatgcagtcagctttctaacaa

SEQ ID NO: 59062 - DNA, 22 bp, Artificial Sequence
  chemically synthesized
tctaacaagctggggcctcacc

SEQ ID NO: 59063 - DNA, 22 bp, Artificial Sequence
  chemically synthesized
ctaacaagctggggcctcacct

SEQ ID NO: 59064 - DNA, 22 bp, Artificial Sequence
  chemically synthesized
taacaagctggggcctcacctg

SEQ ID NO: 59065 - DNA, 22 bp, Artificial Sequence
  chemically synthesized
acaagctggggcctcacctgtt

SEQ ID NO: 59066 - DNA, 22 bp, Artificial Sequence
  chemically synthesized
gggcctcacctgttttcccacg

SEQ ID NO: 59067 - DNA, 22 bp, Artificial Sequence
  chemically synthesized
acctgttttcccacggataaaa

SEQ ID NO: 59068 - DNA, 22 bp, Artificial Sequence
  chemically synthesized
ttttcccacggataaaaacgtg

SEQ ID NO: 59069 - DNA, 22 bp, Artificial Sequence
  chemically synthesized
tcccacggataaaaacgtgctg

SEQ ID NO: 59070 - DNA, 22 bp, Artificial Sequence
  chemically synthesized
cccacggataaaaacgtgctgg

SEQ ID NO: 59071 - DNA, 22 bp, Artificial Sequence
  chemically synthesized
ccacggataaaaacgtgctgga

SEQ ID NO: 59072 - DNA, 22 bp, Artificial Sequence
  chemically synthesized
gaggaagcagaaaggggctggc

SEQ ID NO: 59073 - DNA, 22 bp, Artificial Sequence
  chemically synthesized
gcaggtggaaagatgaggacca

SEQ ID NO: 59074 - DNA, 22 bp, Artificial Sequence
  chemically synthesized
atcgtctcatgactatgaggtt

SEQ ID NO: 59075 - DNA, 22 bp, Artificial Sequence
  chemically synthesized
atgactatgaggttgctctgat

SEQ ID NO: 59076 - DNA, 22 bp, Artificial Sequence
  chemically synthesized
tgaggttgctctgatccagagg

SEQ ID NO: 59077 - DNA, 22 bp, Artificial Sequence
  chemically synthesized
ctctgatccagagggtccccct

SEQ ID NO: 59078 - DNA, 22 bp, Artificial Sequence
  chemically synthesized
tgatccagagggtccccctgcc

SEQ ID NO: 59079 - DNA, 22 bp, Artificial Sequence
  chemically synthesized
atccagagggtccccctgcctg

SEQ ID NO: 59080 - DNA, 22 bp, Artificial Sequence
  chemically synthesized
cctggtggcccaccgccaggaa

SEQ ID NO: 59081 - DNA, 22 bp, Artificial Sequence
  chemically synthesized
gtggcccaccgccaggaagact

SEQ ID NO: 59082 - DNA, 22 bp, Artificial Sequence
  chemically synthesized
ccactgtccctggatgcccaga

SEQ ID NO: 59083 - DNA, 22 bp, Artificial Sequence
  chemically synthesized
tccctggatgcccagagtggga

SEQ ID NO: 59084 - DNA, 22 bp, Artificial Sequence
  chemically synthesized
gatgcccagagtgggatgtcaa

SEQ ID NO: 59085 - DNA, 22 bp, Artificial Sequence
  chemically synthesized
catcacttatcaactccttatc

SEQ ID NO: 59086 - DNA, 22 bp, Artificial Sequence
  chemically synthesized
atcaactccttatccatagggg

SEQ ID NO: 59087 - DNA, 22 bp, Artificial Sequence
  chemically synthesized
tcaactccttatccataggggt

SEQ ID NO: 59088 - DNA, 22 bp, Artificial Sequence
  chemically synthesized
cttatccataggggtattcttc

SEQ ID NO: 59089 - DNA, 22 bp, Artificial Sequence
  chemically synthesized
atccataggggtattcttcctg

SEQ ID NO: 59090 - DNA, 22 bp, Artificial Sequence
  chemically synthesized
tccataggggtattcttcctga

SEQ ID NO: 59091 - DNA, 22 bp, Artificial Sequence
  chemically synthesized
ttcctgaggcgtctcagaaaac

SEQ ID NO: 59092 - DNA, 22 bp, Artificial Sequence
  chemically synthesized
cctgaggcgtctcagaaaacag

SEQ ID NO: 59093 - DNA, 22 bp, Artificial Sequence
  chemically synthesized
ctgaggcgtctcagaaaacagg

SEQ ID NO: 59094 - DNA, 22 bp, Artificial Sequence
  chemically synthesized
aggcgtctcagaaaacagggcc

SEQ ID NO: 59095 - DNA, 22 bp, Artificial Sequence
  chemically synthesized
agaaaacagggccctccccata

SEQ ID NO: 59096 - DNA, 22 bp, Artificial Sequence
  chemically synthesized
cccatatgctgaccacataata

SEQ ID NO: 59097 - DNA, 22 bp, Artificial Sequence
  chemically synthesized
accacataatagaacccctccc

SEQ ID NO: 59098 - DNA, 22 bp, Artificial Sequence
  chemically synthesized
ccaactcagagaccctggctgc

SEQ ID NO: 59099 - DNA, 22 bp, Artificial Sequence
  chemically synthesized
agagaccctggctgctagctgc

SEQ ID NO: 59100 - DNA, 22 bp, Artificial Sequence
  chemically synthesized
gctgctagctgccctggcatga

SEQ ID NO: 59101 - DNA, 22 bp, Artificial Sequence
  chemically synthesized
ctagctgccctggcatgaccca

SEQ ID NO: 59102 - DNA, 22 bp, Artificial Sequence
  chemically synthesized
gctgccctggcatgacccagac

SEQ ID NO: 59103 - DNA, 22 bp, Artificial Sequence
  chemically synthesized
ccctggcatgacccagacagtg

SEQ ID NO: 59104 - DNA, 22 bp, Artificial Sequence
  chemically synthesized
gcatgacccagacagtggcctt

SEQ ID NO: 59105 - DNA, 22 bp, Artificial Sequence
  chemically synthesized
tgtatatgtttttagactcacc

SEQ ID NO: 59106 - DNA, 22 bp, Artificial Sequence
  chemically synthesized
gtatatgtttttagactcacct

SEQ ID NO: 59107 - DNA, 22 bp, Artificial Sequence
  chemically synthesized
tatatgtttttagactcacctt

SEQ ID NO: 59108 - DNA, 22 bp, Artificial Sequence
  chemically synthesized
ttagactcaccttgactcacct

SEQ ID NO: 59109 - DNA, 22 bp, Artificial Sequence
  chemically synthesized
tagactcaccttgactcacctc

SEQ ID NO: 59110 - DNA, 22 bp, Artificial Sequence
  chemically synthesized
agactcaccttgactcacctct

SEQ ID NO: 59111 - DNA, 22 bp, Artificial Sequence
  chemically synthesized
gactcaccttgactcacctctg

SEQ ID NO: 59112 - DNA, 22 bp, Artificial Sequence
  chemically synthesized
accttgactcacctctgaccat

SEQ ID NO: 59113 - DNA, 22 bp, Artificial Sequence
  chemically synthesized
gactcacctctgaccatagaaa

SEQ ID NO: 59114 - DNA, 22 bp, Artificial Sequence
  chemically synthesized
actcacctctgaccatagaaac

SEQ ID NO: 59115 - DNA, 22 bp, Artificial Sequence
  chemically synthesized
acctctgaccatagaaactctc

SEQ ID NO: 59116 - DNA, 22 bp, Artificial Sequence
  chemically synthesized
tgaccatagaaactctcatccc

SEQ ID NO: 59117 - DNA, 22 bp, Artificial Sequence
  chemically synthesized
accatagaaactctcatcccag

SEQ ID NO: 59118 - DNA, 22 bp, Artificial Sequence
  chemically synthesized
tcatcccagaggtcactgcaat

SEQ ID NO: 59119 - DNA, 22 bp, Artificial Sequence
  chemically synthesized
atcccagaggtcactgcaatag

SEQ ID NO: 59120 - DNA, 22 bp, Artificial Sequence
  chemically synthesized
caatagttactccacaacagag

SEQ ID NO: 59121 - DNA, 22 bp, Artificial Sequence
  chemically synthesized
ctccacaacagaggcttatctg

SEQ ID NO: 59122 - DNA, 22 bp, Artificial Sequence
  chemically synthesized
cacaacagaggcttatctgggt

SEQ ID NO: 59123 - DNA, 22 bp, Artificial Sequence
  chemically synthesized
atctgggtagagggaggctccc

SEQ ID NO: 59124 - DNA, 22 bp, Artificial Sequence
  chemically synthesized
tctgggtagagggaggctccct

SEQ ID NO: 59125 - DNA, 22 bp, Artificial Sequence
  chemically synthesized
ggtagagggaggctccctacct

SEQ ID NO: 59126 - DNA, 22 bp, Artificial Sequence
  chemically synthesized
cctacctatggcccagcagccc

SEQ ID NO: 59127 - DNA, 22 bp, Artificial Sequence
  chemically synthesized
cctatggcccagcagccctgac

SEQ ID NO: 59128 - DNA, 22 bp, Artificial Sequence
  chemically synthesized
tggcccagcagccctgacagtg

SEQ ID NO: 59129 - DNA, 22 bp, Artificial Sequence
  chemically synthesized
acagtgcagatcacatataccc

SEQ ID NO: 59130 - DNA, 22 bp, Artificial Sequence
  chemically synthesized
cctgccacgcatgggcttactt

SEQ ID NO: 59131 - DNA, 22 bp, Artificial Sequence
  chemically synthesized
ccacgcatgggcttactttaca

SEQ ID NO: 59132 - DNA, 22 bp, Artificial Sequence
  chemically synthesized
actttacacccacccacagtca

SEQ ID NO: 59133 - DNA, 22 bp, Artificial Sequence
  chemically synthesized
ctttacacccacccacagtcac

SEQ ID NO: 59134 - DNA, 22 bp, Artificial Sequence
  chemically synthesized
tacacccacccacagtcaccaa

SEQ ID NO: 59135 - DNA, 22 bp, Artificial Sequence
  chemically synthesized
acacccacccacagtcaccaac

SEQ ID NO: 59136 - DNA, 22 bp, Artificial Sequence
  chemically synthesized
cacccacccacagtcaccaaca

SEQ ID NO: 59137 - DNA, 22 bp, Artificial Sequence
  chemically synthesized
cctgctctccaaggttaggcgt

SEQ ID NO: 59138 - DNA, 22 bp, Artificial Sequence
  chemically synthesized
ctctccaaggttaggcgtggca

SEQ ID NO: 59139 - DNA, 22 bp, Artificial Sequence
  chemically synthesized
tccaaggttaggcgtggcagga

SEQ ID NO: 59140 - DNA, 22 bp, Artificial Sequence
  chemically synthesized
caaggttaggcgtggcaggaga

SEQ ID NO: 59141 - DNA, 22 bp, Artificial Sequence
  chemically synthesized
ggcgtggcaggagaagtttgct

SEQ ID NO: 59142 - DNA, 22 bp, Artificial Sequence
  chemically synthesized
gcttggaccagcagaaaccatg

SEQ ID NO: 59143 - DNA, 22 bp, Artificial Sequence
  chemically synthesized
cttggaccagcagaaaccatgc

SEQ ID NO: 59144 - DNA, 22 bp, Artificial Sequence
  chemically synthesized
ggaccagcagaaaccatgcagt

SEQ ID NO: 59145 - DNA, 22 bp, Artificial Sequence
  chemically synthesized
gaccagcagaaaccatgcagtc

SEQ ID NO: 59146 - DNA, 22 bp, Artificial Sequence
  chemically synthesized
gagtcagcatgggctgggtgcg

SEQ ID NO: 59147 - DNA, 22 bp, Artificial Sequence
  chemically synthesized
ggtgcgagcccttggtggggtg

SEQ ID NO: 59148 - DNA, 22 bp, Artificial Sequence
  chemically synthesized
ggtggggtggggaggagactcc

SEQ ID NO: 59149 - DNA, 22 bp, Artificial Sequence
  chemically synthesized
gtggggtggggaggagactcca

SEQ ID NO: 59150 - DNA, 22 bp, Artificial Sequence
  chemically synthesized
caggtcatacctcctggaggat

SEQ ID NO: 59151 - DNA, 22 bp, Artificial Sequence
  chemically synthesized
ctggaggatgttttaatcattt

SEQ ID NO: 59152 - DNA, 22 bp, Artificial Sequence
  chemically synthesized
gaggatgttttaatcatttcca

SEQ ID NO: 59153 - DNA, 22 bp, Artificial Sequence
  chemically synthesized
taatcatttccagcatggaatg

SEQ ID NO: 59154 - DNA, 22 bp, Artificial Sequence
  chemically synthesized
aatcatttccagcatggaatgc

SEQ ID NO: 59155 - DNA, 22 bp, Artificial Sequence
  chemically synthesized
atcatttccagcatggaatgct

SEQ ID NO: 59156 - DNA, 22 bp, Artificial Sequence
  chemically synthesized
ccagcatggaatgctgtcaact

SEQ ID NO: 59157 - DNA, 22 bp, Artificial Sequence
  chemically synthesized
cagcatggaatgctgtcaactt

SEQ ID NO: 59158 - DNA, 22 bp, Artificial Sequence
  chemically synthesized
tcaacttttgccacagattcat

SEQ ID NO: 59159 - DNA, 22 bp, Artificial Sequence
  chemically synthesized
ttgccacagattcattagctct

SEQ ID NO: 59160 - DNA, 22 bp, Artificial Sequence
  chemically synthesized
tgccacagattcattagctctg

SEQ ID NO: 59161 - DNA, 22 bp, Artificial Sequence
  chemically synthesized
gccacagattcattagctctga

SEQ ID NO: 59162 - DNA, 22 bp, Artificial Sequence
  chemically synthesized
ccacagattcattagctctgag

SEQ ID NO: 59163 - DNA, 22 bp, Artificial Sequence
  chemically synthesized
attagctctgagtttctttttt

SEQ ID NO: 59164 - DNA, 22 bp, Artificial Sequence
  chemically synthesized
gctctgagtttcttttttctgt

SEQ ID NO: 59165 - DNA, 22 bp, Artificial Sequence
  chemically synthesized
tgagtttcttttttctgtcccc

SEQ ID NO: 59166 - DNA, 22 bp, Artificial Sequence
  chemically synthesized
agtttcttttttctgtccccag

SEQ ID NO: 59167 - DNA, 22 bp, Artificial Sequence
  chemically synthesized
cttttttctgtccccagctacc

SEQ ID NO: 59168 - DNA, 22 bp, Artificial Sequence
  chemically synthesized
ttttttctgtccccagctaccc

SEQ ID NO: 59169 - DNA, 22 bp, Artificial Sequence
  chemically synthesized
ttttctgtccccagctacccct

SEQ ID NO: 59170 - DNA, 22 bp, Artificial Sequence
  chemically synthesized
tttctgtccccagctacccctt

SEQ ID NO: 59171 - DNA, 22 bp, Artificial Sequence
  chemically synthesized
ttctgtccccagctacccctta

SEQ ID NO: 59172 - DNA, 22 bp, Artificial Sequence
  chemically synthesized
tctgtccccagctaccccttac

SEQ ID NO: 59173 - DNA, 22 bp, Artificial Sequence
  chemically synthesized
ctgtccccagctaccccttaca

SEQ ID NO: 59174 - DNA, 22 bp, Artificial Sequence
  chemically synthesized
tgtccccagctaccccttacat

SEQ ID NO: 59175 - DNA, 22 bp, Artificial Sequence
  chemically synthesized
tccccagctaccccttacatgt

SEQ ID NO: 59176 - DNA, 22 bp, Artificial Sequence
  chemically synthesized
ccccttacatgtcaatatggac

SEQ ID NO: 59177 - DNA, 22 bp, Artificial Sequence
  chemically synthesized
acatgtcaatatggacttaatg

SEQ ID NO: 59178 - DNA, 22 bp, Artificial Sequence
  chemically synthesized
catgtcaatatggacttaatga

SEQ ID NO: 59179 - DNA, 22 bp, Artificial Sequence
  chemically synthesized
aatgatgggaaattcaggcaag

SEQ ID NO: 59180 - DNA, 22 bp, Artificial Sequence
  chemically synthesized
atgatgggaaattcaggcaagt

SEQ ID NO: 59181 - DNA, 22 bp, Artificial Sequence
  chemically synthesized
aggcaagtttttaaacatttta

SEQ ID NO: 59182 - DNA, 22 bp, Artificial Sequence
  chemically synthesized
ttaaacattttattccccctgg

SEQ ID NO: 59183 - DNA, 22 bp, Artificial Sequence
  chemically synthesized
taaacattttattccccctggc

SEQ ID NO: 59184 - DNA, 22 bp, Artificial Sequence
  chemically synthesized
aaacattttattccccctggct

SEQ ID NO: 59185 - DNA, 22 bp, Artificial Sequence
  chemically synthesized
aacattttattccccctggctc

SEQ ID NO: 59186 - DNA, 22 bp, Artificial Sequence
  chemically synthesized
tattccccctggctcttatcct

SEQ ID NO: 59187 - DNA, 22 bp, Artificial Sequence
  chemically synthesized
attccccctggctcttatcctc

SEQ ID NO: 59188 - DNA, 22 bp, Artificial Sequence
  chemically synthesized
ttccccctggctcttatcctca

SEQ ID NO: 59189 - DNA, 22 bp, Artificial Sequence
  chemically synthesized
cccctggctcttatcctcaaaa

SEQ ID NO: 59190 - DNA, 22 bp, Artificial Sequence
  chemically synthesized
gctcttatcctcaaaaaatgca

SEQ ID NO: 59191 - DNA, 22 bp, Artificial Sequence
  chemically synthesized
ttatcctcaaaaaatgcatgaa

SEQ ID NO: 59192 - DNA, 22 bp, Artificial Sequence
  chemically synthesized
atcctcaaaaaatgcatgaatt

SEQ ID NO: 59193 - DNA, 22 bp, Artificial Sequence
  chemically synthesized
tcctcaaaaaatgcatgaattt

SEQ ID NO: 59194 - DNA, 22 bp, Artificial Sequence
  chemically synthesized
aaaaaatgcatgaatttggagg

SEQ ID NO: 59195 - DNA, 22 bp, Artificial Sequence
  chemically synthesized
ggaggcagtggctcatgcctgt

SEQ ID NO: 59196 - DNA, 22 bp, Artificial Sequence
  chemically synthesized
gaggcagtggctcatgcctgta

SEQ ID NO: 59197 - DNA, 22 bp, Artificial Sequence
  chemically synthesized
atgcctgtaatcccaatgcttt

SEQ ID NO: 59198 - DNA, 22 bp, Artificial Sequence
  chemically synthesized
taatcccaatgctttgctaggt

SEQ ID NO: 59199 - DNA, 22 bp, Artificial Sequence
  chemically synthesized
tgctaggttgaggcgggaggat

SEQ ID NO: 59200 - DNA, 22 bp, Artificial Sequence
  chemically synthesized
gctaggttgaggcgggaggatc

SEQ ID NO: 59201 - DNA, 22 bp, Artificial Sequence
  chemically synthesized
ctaggttgaggcgggaggatca

SEQ ID NO: 59202 - DNA, 22 bp, Artificial Sequence
  chemically synthesized
ggttgaggcgggaggatcactt

SEQ ID NO: 59203 - DNA, 22 bp, Artificial Sequence
  chemically synthesized
aggcgggaggatcacttgaagc

SEQ ID NO: 59204 - DNA, 22 bp, Artificial Sequence
  chemically synthesized
gaagccaggaatttgagaccag

SEQ ID NO: 59205 - DNA, 22 bp, Artificial Sequence
  chemically synthesized
aagccaggaatttgagaccagc

SEQ ID NO: 59206 - DNA, 22 bp, Artificial Sequence
  chemically synthesized
gagaccagcctgggccgcatag

SEQ ID NO: 59207 - DNA, 22 bp, Artificial Sequence
  chemically synthesized
agaccagcctgggccgcatagt

SEQ ID NO: 59208 - DNA, 22 bp, Artificial Sequence
  chemically synthesized
ggccgcatagtgagaccccgtt

SEQ ID NO: 59209 - DNA, 22 bp, Artificial Sequence
  chemically synthesized
ctacaaaaataaataaataaat

SEQ ID NO: 59210 - DNA, 22 bp, Artificial Sequence
  chemically synthesized
tacaaaaataaataaataaata

SEQ ID NO: 59211 - DNA, 22 bp, Artificial Sequence
  chemically synthesized
caaaaataaataaataaataat

SEQ ID NO: 59212 - DNA, 22 bp, Artificial Sequence
  chemically synthesized
aatagccctattttttaaaatg

SEQ ID NO: 59213 - DNA, 22 bp, Artificial Sequence
  chemically synthesized
ttttttaaaatgcatgagttcg

SEQ ID NO: 59214 - DNA, 22 bp, Artificial Sequence
  chemically synthesized
tttaaaatgcatgagttcgtta

SEQ ID NO: 59215 - DNA, 22 bp, Artificial Sequence
  chemically synthesized
ttaaaatgcatgagttcgttac

SEQ ID NO: 59216 - DNA, 22 bp, Artificial Sequence
  chemically synthesized
taaaatgcatgagttcgttacc

SEQ ID NO: 59217 - DNA, 22 bp, Artificial Sequence
  chemically synthesized
aaaatgcatgagttcgttacct

SEQ ID NO: 59218 - DNA, 22 bp, Artificial Sequence
  chemically synthesized
aaatgcatgagttcgttacctg

SEQ ID NO: 59219 - DNA, 22 bp, Artificial Sequence
  chemically synthesized
gttacctgattcattccctggt

SEQ ID NO: 59220 - DNA, 22 bp, Artificial Sequence
  chemically synthesized
cctgattcattccctggttcct

SEQ ID NO: 59221 - DNA, 22 bp, Artificial Sequence
  chemically synthesized
attcattccctggttcctttca

SEQ ID NO: 59222 - DNA, 22 bp, Artificial Sequence
  chemically synthesized
attccctggttcctttcacagt

SEQ ID NO: 59223 - DNA, 22 bp, Artificial Sequence
  chemically synthesized
cctggttcctttcacagtcctc

SEQ ID NO: 59224 - DNA, 22 bp, Artificial Sequence
  chemically synthesized
gttcctttcacagtcctccgtg

SEQ ID NO: 59225 - DNA, 22 bp, Artificial Sequence
  chemically synthesized
ctttcacagtcctccgtgaccc

SEQ ID NO: 59226 - DNA, 22 bp, Artificial Sequence
  chemically synthesized
tcacagtcctccgtgacccaag

SEQ ID NO: 59227 - DNA, 22 bp, Artificial Sequence
  chemically synthesized
cacagtcctccgtgacccaagt

SEQ ID NO: 59228 - DNA, 22 bp, Artificial Sequence
  chemically synthesized
acagtcctccgtgacccaagtg

SEQ ID NO: 59229 - DNA, 22 bp, Artificial Sequence
  chemically synthesized
cgtgacccaagtgttagggttt

SEQ ID NO: 59230 - DNA, 22 bp, Artificial Sequence
  chemically synthesized
gggttttggtctctctactatt

SEQ ID NO: 59231 - DNA, 22 bp, Artificial Sequence
  chemically synthesized
tggtctctctactatttgtagg

SEQ ID NO: 59232 - DNA, 22 bp, Artificial Sequence
  chemically synthesized
ggtctctctactatttgtaggc

SEQ ID NO: 59233 - DNA, 22 bp, Artificial Sequence
  chemically synthesized
gtctctctactatttgtaggct

SEQ ID NO: 59234 - DNA, 22 bp, Artificial Sequence
  chemically synthesized
tctactatttgtaggctgatat

SEQ ID NO: 59235 - DNA, 22 bp, Artificial Sequence
  chemically synthesized
tactatttgtaggctgatatat

SEQ ID NO: 59236 - DNA, 22 bp, Artificial Sequence
  chemically synthesized
ctatttgtaggctgatatatag

SEQ ID NO: 59237 - DNA, 22 bp, Artificial Sequence
  chemically synthesized
tttgtaggctgatatatagtat

SEQ ID NO: 59238 - DNA, 22 bp, Artificial Sequence
  chemically synthesized
gtaggctgatatatagtataca

SEQ ID NO: 59239 - DNA, 22 bp, Artificial Sequence
  chemically synthesized
taggctgatatatagtatacac

SEQ ID NO: 59240 - DNA, 22 bp, Artificial Sequence
  chemically synthesized
atatatagtatacacacacaca

SEQ ID NO: 59241 - DNA, 22 bp, Artificial Sequence
  chemically synthesized
gagctttcttttgtatatctac

SEQ ID NO: 59242 - DNA, 22 bp, Artificial Sequence
  chemically synthesized
agctttcttttgtatatctaca

SEQ ID NO: 59243 - DNA, 22 bp, Artificial Sequence
  chemically synthesized
tcttttgtatatctacacacat

SEQ ID NO: 59244 - DNA, 22 bp, Artificial Sequence
  chemically synthesized
cttttgtatatctacacacata

SEQ ID NO: 59245 - DNA, 22 bp, Artificial Sequence
  chemically synthesized
ttttgtatatctacacacatat

SEQ ID NO: 59246 - DNA, 22 bp, Artificial Sequence
  chemically synthesized
ttgtatatctacacacatatgt

SEQ ID NO: 59247 - DNA, 22 bp, Artificial Sequence
  chemically synthesized
tgtatatctacacacatatgta

SEQ ID NO: 59248 - DNA, 22 bp, Artificial Sequence
  chemically synthesized
gtatatctacacacatatgtat

SEQ ID NO: 59249 - DNA, 22 bp, Artificial Sequence
  chemically synthesized
tatatctacacacatatgtata

SEQ ID NO: 59250 - DNA, 22 bp, Artificial Sequence
  chemically synthesized
cacacatatgtataagaaagct

SEQ ID NO: 59251 - DNA, 22 bp, Artificial Sequence
  chemically synthesized
aagatatagaagccctttttca

SEQ ID NO: 59252 - DNA, 22 bp, Artificial Sequence
  chemically synthesized
tttcaaaaataactgaaagttt

SEQ ID NO: 59253 - DNA, 22 bp, Artificial Sequence
  chemically synthesized
ttcaaaaataactgaaagtttc

SEQ ID NO: 59254 - DNA, 22 bp, Artificial Sequence
  chemically synthesized
tcaaaaataactgaaagtttca

SEQ ID NO: 59255 - DNA, 22 bp, Artificial Sequence
  chemically synthesized
caaaaataactgaaagtttcaa

SEQ ID NO: 59256 - DNA, 22 bp, Artificial Sequence
  chemically synthesized
aaaaataactgaaagtttcaaa

SEQ ID NO: 59257 - DNA, 22 bp, Artificial Sequence
  chemically synthesized
aaagtttcaaactctttaagtc

SEQ ID NO: 59258 - DNA, 22 bp, Artificial Sequence
  chemically synthesized
caaactctttaagtctccagtt

SEQ ID NO: 59259 - DNA, 22 bp, Artificial Sequence
  chemically synthesized
aaactctttaagtctccagtta

SEQ ID NO: 59260 - DNA, 22 bp, Artificial Sequence
  chemically synthesized
tttaagtctccagttaccattt

SEQ ID NO: 59261 - DNA, 22 bp, Artificial Sequence
  chemically synthesized
taagtctccagttaccattttg

SEQ ID NO: 59262 - DNA, 22 bp, Artificial Sequence
  chemically synthesized
aagtctccagttaccattttgc

SEQ ID NO: 59263 - DNA, 22 bp, Artificial Sequence
  chemically synthesized
agtctccagttaccattttgct

SEQ ID NO: 59264 - DNA, 22 bp, Artificial Sequence
  chemically synthesized
cagttaccattttgctggtatt

SEQ ID NO: 59265 - DNA, 22 bp, Artificial Sequence
  chemically synthesized
ccattttgctggtattcttatt

SEQ ID NO: 59266 - DNA, 22 bp, Artificial Sequence
  chemically synthesized
tgctggtattcttatttggaac

SEQ ID NO: 59267 - DNA, 22 bp, Artificial Sequence
  chemically synthesized
gctggtattcttatttggaacc

SEQ ID NO: 59268 - DNA, 22 bp, Artificial Sequence
  chemically synthesized
ctggtattcttatttggaacca

SEQ ID NO: 59269 - DNA, 22 bp, Artificial Sequence
  chemically synthesized
gtattcttatttggaaccatac

SEQ ID NO: 59270 - DNA, 22 bp, Artificial Sequence
  chemically synthesized
ttatttggaaccatacattcat

SEQ ID NO: 59271 - DNA, 22 bp, Artificial Sequence
  chemically synthesized
atttggaaccatacattcatca

SEQ ID NO: 59272 - DNA, 22 bp, Artificial Sequence
  chemically synthesized
tttggaaccatacattcatcat

SEQ ID NO: 59273 - DNA, 22 bp, Artificial Sequence
  chemically synthesized
ggaaccatacattcatcatatt

SEQ ID NO: 59274 - DNA, 22 bp, Artificial Sequence
  chemically synthesized
gaaccatacattcatcatattg

SEQ ID NO: 59275 - DNA, 22 bp, Artificial Sequence
  chemically synthesized
atcatattgttgcacagtaaga

SEQ ID NO: 59276 - DNA, 22 bp, Artificial Sequence
  chemically synthesized
ttgcacagtaagactatacatt

SEQ ID NO: 59277 - DNA, 22 bp, Artificial Sequence
  chemically synthesized
cacagtaagactatacattcat

SEQ ID NO: 59278 - DNA, 22 bp, Artificial Sequence
  chemically synthesized
tacattcattattttgcttaaa

SEQ ID NO: 59279 - DNA, 22 bp, Artificial Sequence
  chemically synthesized
attattttgcttaaacgtatga

SEQ ID NO: 59280 - DNA, 22 bp, Artificial Sequence
  chemically synthesized
ttttgcttaaacgtatgagtta

SEQ ID NO: 59281 - DNA, 22 bp, Artificial Sequence
  chemically synthesized
tgcttaaacgtatgagttaaaa

SEQ ID NO: 59282 - DNA, 22 bp, Artificial Sequence
  chemically synthesized
gcttaaacgtatgagttaaaac

SEQ ID NO: 59283 - DNA, 22 bp, Artificial Sequence
  chemically synthesized
cttaaacgtatgagttaaaaca

SEQ ID NO: 59284 - DNA, 22 bp, Artificial Sequence
  chemically synthesized
aaacgtatgagttaaaacactt

SEQ ID NO: 59285 - DNA, 22 bp, Artificial Sequence
  chemically synthesized
aacgtatgagttaaaacacttg

SEQ ID NO: 59286 - DNA, 22 bp, Artificial Sequence
  chemically synthesized
aaacacttggccaggcatggtg

SEQ ID NO: 59287 - DNA, 22 bp, Artificial Sequence
  chemically synthesized
ggccaggcatggtggttcacac

SEQ ID NO: 59288 - DNA, 22 bp, Artificial Sequence
  chemically synthesized
gccaggcatggtggttcacacc

SEQ ID NO: 59289 - DNA, 22 bp, Artificial Sequence
  chemically synthesized
acacctgtaatcccagagcttt

SEQ ID NO: 59290 - DNA, 22 bp, Artificial Sequence
  chemically synthesized
taatcccagagctttgggaagc

SEQ ID NO: 59291 - DNA, 22 bp, Artificial Sequence
  chemically synthesized
tgggaagccaagactggcagat

SEQ ID NO: 59292 - DNA, 22 bp, Artificial Sequence
  chemically synthesized
gggaagccaagactggcagatc

SEQ ID NO: 59293 - DNA, 22 bp, Artificial Sequence
  chemically synthesized
ggaagccaagactggcagatct

SEQ ID NO: 59294 - DNA, 22 bp, Artificial Sequence
  chemically synthesized
gcagatctcttgagctcaggaa

SEQ ID NO: 59295 - DNA, 22 bp, Artificial Sequence
  chemically synthesized
ttgagctcaggaattcaagacc

SEQ ID NO: 59296 - DNA, 22 bp, Artificial Sequence
  chemically synthesized
gagctcaggaattcaagaccag

SEQ ID NO: 59297 - DNA, 22 bp, Artificial Sequence
  chemically synthesized
agctcaggaattcaagaccagc

SEQ ID NO: 59298 - DNA, 22 bp, Artificial Sequence
  chemically synthesized
aggaattcaagaccagcctggg

SEQ ID NO: 59299 - DNA, 22 bp, Artificial Sequence
  chemically synthesized
aagaccagcctgggcaacatgg

SEQ ID NO: 59300 - DNA, 22 bp, Artificial Sequence
  chemically synthesized
ggcaacatggaaaaaccccatc

SEQ ID NO: 59301 - DNA, 22 bp, Artificial Sequence
  chemically synthesized
tacaaaagatagaaaaattagc

SEQ ID NO: 59302 - DNA, 22 bp, Artificial Sequence
  chemically synthesized
caaaagatagaaaaattagcca

SEQ ID NO: 59303 - DNA, 22 bp, Artificial Sequence
  chemically synthesized
gccaggcatggtggcgtgtgcc

SEQ ID NO: 59304 - DNA, 22 bp, Artificial Sequence
  chemically synthesized
tggtcccagctactcaggaggc

SEQ ID NO: 59305 - DNA, 22 bp, Artificial Sequence
  chemically synthesized
ctcaggaggctgaggtgggagg

SEQ ID NO: 59306 - DNA, 22 bp, Artificial Sequence
  chemically synthesized
aggaggctgaggtgggaggatc

SEQ ID NO: 59307 - DNA, 22 bp, Artificial Sequence
  chemically synthesized
aggtgggaggatcacattagcc

SEQ ID NO: 59308 - DNA, 22 bp, Artificial Sequence
  chemically synthesized
gcccaggaggttgaggctgcag

SEQ ID NO: 59309 - DNA, 22 bp, Artificial Sequence
  chemically synthesized
aggctgcagtgagccgtgatta

SEQ ID NO: 59310 - DNA, 22 bp, Artificial Sequence
  chemically synthesized
cagtgagccgtgattatgccac

SEQ ID NO: 59311 - DNA, 22 bp, Artificial Sequence
  chemically synthesized
tgccactgcactccagcctggg

SEQ ID NO: 59312 - DNA, 22 bp, Artificial Sequence
  chemically synthesized
cactccagcctgggagacagag

SEQ ID NO: 59313 - DNA, 22 bp, Artificial Sequence
  chemically synthesized
cagcctgggagacagagtgaga

SEQ ID NO: 59314 - DNA, 22 bp, Artificial Sequence
  chemically synthesized
ggagacagagtgagaccctgtt

SEQ ID NO: 59315 - DNA, 22 bp, Artificial Sequence
  chemically synthesized
tttcaaaaaaaagagagagaaa

SEQ ID NO: 59316 - DNA, 22 bp, Artificial Sequence
  chemically synthesized
caaaaaaaagagagagaaaatt

SEQ ID NO: 59317 - DNA, 22 bp, Artificial Sequence
  chemically synthesized
aaaaaaaagagagagaaaattt

SEQ ID NO: 59318 - DNA, 22 bp, Artificial Sequence
  chemically synthesized
aaaaaagaaaacaacaccaagg

SEQ ID NO: 59319 - DNA, 22 bp, Artificial Sequence
  chemically synthesized
aaaaagaaaacaacaccaaggg

SEQ ID NO: 59320 - DNA, 22 bp, Artificial Sequence
  chemically synthesized
taactttaaggtcattaaatga

SEQ ID NO: 59321 - DNA, 22 bp, Artificial Sequence
  chemically synthesized
taaggtcattaaatgaattaat

SEQ ID NO: 59322 - DNA, 22 bp, Artificial Sequence
  chemically synthesized
aaggtcattaaatgaattaatc

SEQ ID NO: 59323 - DNA, 22 bp, Artificial Sequence
  chemically synthesized
aggtcattaaatgaattaatca

SEQ ID NO: 59324 - DNA, 22 bp, Artificial Sequence
  chemically synthesized
aatgaattaatcactgcattca

SEQ ID NO: 59325 - DNA, 22 bp, Artificial Sequence
  chemically synthesized
atcactgcattcaaaaacgatt

SEQ ID NO: 59326 - DNA, 22 bp, Artificial Sequence
  chemically synthesized
cattcaaaaacgattactttct

SEQ ID NO: 59327 - DNA, 22 bp, Artificial Sequence
  chemically synthesized
aaaaacgattactttctggccc

SEQ ID NO: 59328 - DNA, 22 bp, Artificial Sequence
  chemically synthesized
ctttctggccctaagagacatg

SEQ ID NO: 59329 - DNA, 22 bp, Artificial Sequence
  chemically synthesized
tctggccctaagagacatgagg

SEQ ID NO: 59330 - DNA, 22 bp, Artificial Sequence
  chemically synthesized
ctggccctaagagacatgaggc

SEQ ID NO: 59331 - DNA, 22 bp, Artificial Sequence
  chemically synthesized
tggccctaagagacatgaggcc

SEQ ID NO: 59332 - DNA, 22 bp, Artificial Sequence
  chemically synthesized
gccctaagagacatgaggccaa

SEQ ID NO: 59333 - DNA, 22 bp, Artificial Sequence
  chemically synthesized
agagacatgaggccaataccag

SEQ ID NO: 59334 - DNA, 22 bp, Artificial Sequence
  chemically synthesized
atctcccaaaccagaggcagac

SEQ ID NO: 59335 - DNA, 22 bp, Artificial Sequence
  chemically synthesized
ccaaaccagaggcagaccctag

SEQ ID NO: 59336 - DNA, 22 bp, Artificial Sequence
  chemically synthesized
gactctaatacagttaaggaaa

SEQ ID NO: 59337 - DNA, 22 bp, Artificial Sequence
  chemically synthesized
taatacagttaaggaaagacca

SEQ ID NO: 59338 - DNA, 22 bp, Artificial Sequence
  chemically synthesized
atacagttaaggaaagaccagc

SEQ ID NO: 59339 - DNA, 22 bp, Artificial Sequence
  chemically synthesized
aggaaagaccagcaagatgata

SEQ ID NO: 59340 - DNA, 22 bp, Artificial Sequence
  chemically synthesized
ctatattttatttgttgttttt

SEQ ID NO: 59341 - DNA, 22 bp, Artificial Sequence
  chemically synthesized
tattttatttgttgtttttctt

SEQ ID NO: 59342 - DNA, 22 bp, Artificial Sequence
  chemically synthesized
tatttgttgtttttcttttgtt

SEQ ID NO: 59343 - DNA, 22 bp, Artificial Sequence
  chemically synthesized
atttgttgtttttcttttgttt

SEQ ID NO: 59344 - DNA, 22 bp, Artificial Sequence
  chemically synthesized
tttgttgtttttcttttgtttt

SEQ ID NO: 59345 - DNA, 22 bp, Artificial Sequence
  chemically synthesized
gttgtttttcttttgttttgtt

SEQ ID NO: 59346 - DNA, 22 bp, Artificial Sequence
  chemically synthesized
ttgtttttcttttgttttgttt

SEQ ID NO: 59347 - DNA, 22 bp, Artificial Sequence
  chemically synthesized
tttttcttttgttttgttttgt

SEQ ID NO: 59348 - DNA, 22 bp, Artificial Sequence
  chemically synthesized
ttcttttgttttgttttgtttt

SEQ ID NO: 59349 - DNA, 22 bp, Artificial Sequence
  chemically synthesized
tcttttgttttgttttgttttg

SEQ ID NO: 59350 - DNA, 22 bp, Artificial Sequence
  chemically synthesized
cttttgttttgttttgttttgt

SEQ ID NO: 59351 - DNA, 22 bp, Artificial Sequence
  chemically synthesized
ttttgttttgttttgttttgtt

SEQ ID NO: 59352 - DNA, 22 bp, Artificial Sequence
  chemically synthesized
ttgttttgttttgttttgtttt

SEQ ID NO: 59353 - DNA, 22 bp, Artificial Sequence
  chemically synthesized
tgttttgttttgttttgttttg

SEQ ID NO: 59354 - DNA, 22 bp, Artificial Sequence
  chemically synthesized
gttttgttttgttttgttttgt

SEQ ID NO: 59355 - DNA, 22 bp, Artificial Sequence
  chemically synthesized
ttttgttttgttttgttttgtt

SEQ ID NO: 59356 - DNA, 22 bp, Artificial Sequence
  chemically synthesized
tgttttgttttgttttgttttg

SEQ ID NO: 59357 - DNA, 22 bp, Artificial Sequence
  chemically synthesized
gttttgttttgttttgttttgt

SEQ ID NO: 59358 - DNA, 22 bp, Artificial Sequence
  chemically synthesized
ttttgttttgttttgttttgtt

SEQ ID NO: 59359 - DNA, 22 bp, Artificial Sequence
  chemically synthesized
tgttttgttttgttttgtttta

SEQ ID NO: 59360 - DNA, 22 bp, Artificial Sequence
  chemically synthesized
gttttgttttgttttgttttag

SEQ ID NO: 59361 - DNA, 22 bp, Artificial Sequence
  chemically synthesized
ttttgttttgttttgttttaga

SEQ ID NO: 59362 - DNA, 22 bp, Artificial Sequence
  chemically synthesized
tgttttgttttgttttagagac

SEQ ID NO: 59363 - DNA, 22 bp, Artificial Sequence
  chemically synthesized
gttttgttttgttttagagact

SEQ ID NO: 59364 - DNA, 22 bp, Artificial Sequence
  chemically synthesized
ttttgttttgttttagagactg

SEQ ID NO: 59365 - DNA, 22 bp, Artificial Sequence
  chemically synthesized
tgttttgttttagagactgggg

SEQ ID NO: 59366 - DNA, 22 bp, Artificial Sequence
  chemically synthesized
gttttgttttagagactggggt

SEQ ID NO: 59367 - DNA, 22 bp, Artificial Sequence
  chemically synthesized
ttttgttttagagactggggtc

SEQ ID NO: 59368 - DNA, 22 bp, Artificial Sequence
  chemically synthesized
tgttttagagactggggtcttg

SEQ ID NO: 59369 - DNA, 22 bp, Artificial Sequence
  chemically synthesized
gttttagagactggggtcttgc

SEQ ID NO: 59370 - DNA, 22 bp, Artificial Sequence
  chemically synthesized
ttttagagactggggtcttgct

SEQ ID NO: 59371 - DNA, 22 bp, Artificial Sequence
  chemically synthesized
tagagactggggtcttgctcga

SEQ ID NO: 59372 - DNA, 22 bp, Artificial Sequence
  chemically synthesized
agagactggggtcttgctcgat

SEQ ID NO: 59373 - DNA, 22 bp, Artificial Sequence
  chemically synthesized
gagactggggtcttgctcgatt

SEQ ID NO: 59374 - DNA, 22 bp, Artificial Sequence
  chemically synthesized
gggtcttgctcgattgcccagg

SEQ ID NO: 59375 - DNA, 22 bp, Artificial Sequence
  chemically synthesized
gctcgattgcccaggctgtagt

SEQ ID NO: 59376 - DNA, 22 bp, Artificial Sequence
  chemically synthesized
ctcgattgcccaggctgtagtg

SEQ ID NO: 59377 - DNA, 22 bp, Artificial Sequence
  chemically synthesized
gattgcccaggctgtagtgcag

SEQ ID NO: 59378 - DNA, 22 bp, Artificial Sequence
  chemically synthesized
cccaggctgtagtgcagcggtg

SEQ ID NO: 59379 - DNA, 22 bp, Artificial Sequence
  chemically synthesized
tagtgcagcggtgggacaatag

SEQ ID NO: 59380 - DNA, 22 bp, Artificial Sequence
  chemically synthesized
actgcagactccaactcctggg

SEQ ID NO: 59381 - DNA, 22 bp, Artificial Sequence
  chemically synthesized
cagactccaactcctgggctca

SEQ ID NO: 59382 - DNA, 22 bp, Artificial Sequence
  chemically synthesized
caactcctgggctcaagcaatc

SEQ ID NO: 59383 - DNA, 22 bp, Artificial Sequence
  chemically synthesized
ctgggctcaagcaatcctcctg

SEQ ID NO: 59384 - DNA, 22 bp, Artificial Sequence
  chemically synthesized
ggctcaagcaatcctcctgcct

SEQ ID NO: 59385 - DNA, 22 bp, Artificial Sequence
  chemically synthesized
aagcaatcctcctgcctcagcc

SEQ ID NO: 59386 - DNA, 22 bp, Artificial Sequence
  chemically synthesized
ctgcctcagcctcctgaatagc

SEQ ID NO: 59387 - DNA, 22 bp, Artificial Sequence
  chemically synthesized
cctcagcctcctgaatagctgg

SEQ ID NO: 59388 - DNA, 22 bp, Artificial Sequence
  chemically synthesized
agcctcctgaatagctgggact

SEQ ID NO: 59389 - DNA, 22 bp, Artificial Sequence
  chemically synthesized
ctgaatagctgggactacaagg

SEQ ID NO: 59390 - DNA, 22 bp, Artificial Sequence
  chemically synthesized
aatagctgggactacaagggta

SEQ ID NO: 59391 - DNA, 22 bp, Artificial Sequence
  chemically synthesized
ggactacaagggtacaccatca

SEQ ID NO: 59392 - DNA, 22 bp, Artificial Sequence
  chemically synthesized
caagggtacaccatcacacaca

SEQ ID NO: 59393 - DNA, 22 bp, Artificial Sequence
  chemically synthesized
tttaaatttttgtgtagaaacg

SEQ ID NO: 59394 - DNA, 22 bp, Artificial Sequence
  chemically synthesized
ttaaatttttgtgtagaaacga

SEQ ID NO: 59395 - DNA, 22 bp, Artificial Sequence
  chemically synthesized
taaatttttgtgtagaaacgag

SEQ ID NO: 59396 - DNA, 22 bp, Artificial Sequence
  chemically synthesized
aaatttttgtgtagaaacgagg

SEQ ID NO: 59397 - DNA, 22 bp, Artificial Sequence
  chemically synthesized
aatttttgtgtagaaacgaggg

SEQ ID NO: 59398 - DNA, 22 bp, Artificial Sequence
  chemically synthesized
ttgtgtagaaacgagggtcttg

SEQ ID NO: 59399 - DNA, 22 bp, Artificial Sequence
  chemically synthesized
tgtgtagaaacgagggtcttgc

SEQ ID NO: 59400 - DNA, 22 bp, Artificial Sequence
  chemically synthesized
gtgtagaaacgagggtcttgct

SEQ ID NO: 59401 - DNA, 22 bp, Artificial Sequence
  chemically synthesized
tgtagaaacgagggtcttgctt

SEQ ID NO: 59402 - DNA, 22 bp, Artificial Sequence
  chemically synthesized
gctttgttgcccaggctggtct

SEQ ID NO: 59403 - DNA, 22 bp, Artificial Sequence
  chemically synthesized
ctttgttgcccaggctggtctc

SEQ ID NO: 59404 - DNA, 22 bp, Artificial Sequence
  chemically synthesized
tgttgcccaggctggtctccaa

SEQ ID NO: 59405 - DNA, 22 bp, Artificial Sequence
  chemically synthesized
gttgcccaggctggtctccaac

SEQ ID NO: 59406 - DNA, 22 bp, Artificial Sequence
  chemically synthesized
ttgcccaggctggtctccaact

SEQ ID NO: 59407 - DNA, 22 bp, Artificial Sequence
  chemically synthesized
cccaggctggtctccaactcct

SEQ ID NO: 59408 - DNA, 22 bp, Artificial Sequence
  chemically synthesized
gtctccaactcctggcttcaag

SEQ ID NO: 59409 - DNA, 22 bp, Artificial Sequence
  chemically synthesized
caactcctggcttcaagggatc

SEQ ID NO: 59410 - DNA, 22 bp, Artificial Sequence
  chemically synthesized
ctggcttcaagggatcctccca

SEQ ID NO: 59411 - DNA, 22 bp, Artificial Sequence
  chemically synthesized
gcttcaagggatcctcccacct

SEQ ID NO: 59412 - DNA, 22 bp, Artificial Sequence
  chemically synthesized
caagggatcctcccacctcagc

SEQ ID NO: 59413 - DNA, 22 bp, Artificial Sequence
  chemically synthesized
aagggatcctcccacctcagcc

SEQ ID NO: 59414 - DNA, 22 bp, Artificial Sequence
  chemically synthesized
ccacctcagcctcccaaattgc

SEQ ID NO: 59415 - DNA, 22 bp, Artificial Sequence
  chemically synthesized
agcctcccaaattgctgggatt

SEQ ID NO: 59416 - DNA, 22 bp, Artificial Sequence
  chemically synthesized
ccaaattgctgggattacaggt

SEQ ID NO: 59417 - DNA, 22 bp, Artificial Sequence
  chemically synthesized
ctgggattacaggtgtgagcca

SEQ ID NO: 59418 - DNA, 22 bp, Artificial Sequence
  chemically synthesized
ggattacaggtgtgagccacca

SEQ ID NO: 59419 - DNA, 22 bp, Artificial Sequence
  chemically synthesized
caggtgtgagccaccacaacca

SEQ ID NO: 59420 - DNA, 22 bp, Artificial Sequence
  chemically synthesized
tactaattttaaaattaagaac

SEQ ID NO: 59421 - DNA, 22 bp, Artificial Sequence
  chemically synthesized
actaattttaaaattaagaact

SEQ ID NO: 59422 - DNA, 22 bp, Artificial Sequence
  chemically synthesized
ctaattttaaaattaagaactt

SEQ ID NO: 59423 - DNA, 22 bp, Artificial Sequence
  chemically synthesized
attttaaaattaagaacttaaa

SEQ ID NO: 59424 - DNA, 22 bp, Artificial Sequence
  chemically synthesized
taaaattaagaacttaaaactt

SEQ ID NO: 59425 - DNA, 22 bp, Artificial Sequence
  chemically synthesized
aaaattaagaacttaaaacttg

SEQ ID NO: 59426 - DNA, 22 bp, Artificial Sequence
  chemically synthesized
aaattaagaacttaaaacttga

SEQ ID NO: 59427 - DNA, 22 bp, Artificial Sequence
  chemically synthesized
agaacttaaaacttgaatagct

SEQ ID NO: 59428 - DNA, 22 bp, Artificial Sequence
  chemically synthesized
aaaacttgaatagctagagcac

SEQ ID NO: 59429 - DNA, 22 bp, Artificial Sequence
  chemically synthesized
aaacttgaatagctagagcacc

SEQ ID NO: 59430 - DNA, 22 bp, Artificial Sequence
  chemically synthesized
gaatagctagagcaccaagatt

SEQ ID NO: 59431 - DNA, 22 bp, Artificial Sequence
  chemically synthesized
aatagctagagcaccaagattt

SEQ ID NO: 59432 - DNA, 22 bp, Artificial Sequence
  chemically synthesized
gagcaccaagatttttctttgt

SEQ ID NO: 59433 - DNA, 22 bp, Artificial Sequence
  chemically synthesized
ttctttgtccccaaataagtgc

SEQ ID NO: 59434 - DNA, 22 bp, Artificial Sequence
  chemically synthesized
tctttgtccccaaataagtgca

SEQ ID NO: 59435 - DNA, 22 bp, Artificial Sequence
  chemically synthesized
ctttgtccccaaataagtgcag

SEQ ID NO: 59436 - DNA, 22 bp, Artificial Sequence
  chemically synthesized
tttgtccccaaataagtgcagt

SEQ ID NO: 59437 - DNA, 22 bp, Artificial Sequence
  chemically synthesized
tgtccccaaataagtgcagttg

SEQ ID NO: 59438 - DNA, 22 bp, Artificial Sequence
  chemically synthesized
gtccccaaataagtgcagttgc

SEQ ID NO: 59439 - DNA, 22 bp, Artificial Sequence
  chemically synthesized
tccccaaataagtgcagttgca

SEQ ID NO: 59440 - DNA, 22 bp, Artificial Sequence
  chemically synthesized
caggcatagaaaatctgacatc

SEQ ID NO: 59441 - DNA, 22 bp, Artificial Sequence
  chemically synthesized
acatctttgcaagaatcatcgt

SEQ ID NO: 59442 - DNA, 22 bp, Artificial Sequence
  chemically synthesized
tgcaagaatcatcgtggatgta

SEQ ID NO: 59443 - DNA, 22 bp, Artificial Sequence
  chemically synthesized
gcaagaatcatcgtggatgtag

SEQ ID NO: 59444 - DNA, 22 bp, Artificial Sequence
  chemically synthesized
caagaatcatcgtggatgtaga

SEQ ID NO: 59445 - DNA, 22 bp, Artificial Sequence
  chemically synthesized
tgtcctgtgtctctggcctggt

SEQ ID NO: 59446 - DNA, 22 bp, Artificial Sequence
  chemically synthesized
tcctgtgtctctggcctggttt

SEQ ID NO: 59447 - DNA, 22 bp, Artificial Sequence
  chemically synthesized
tgtctctggcctggtttcgggg

SEQ ID NO: 59448 - DNA, 22 bp, Artificial Sequence
  chemically synthesized
tggcctggtttcggggaccagg

SEQ ID NO: 59449 - DNA, 22 bp, Artificial Sequence
  chemically synthesized
gcctggtttcggggaccaggag

SEQ ID NO: 59450 - DNA, 22 bp, Artificial Sequence
  chemically synthesized
gtttcggggaccaggagggcag

SEQ ID NO: 59451 - DNA, 22 bp, Artificial Sequence
  chemically synthesized
cggggaccaggagggcagaccc

SEQ ID NO: 59452 - DNA, 22 bp, Artificial Sequence
  chemically synthesized
ggggaccaggagggcagaccct

SEQ ID NO: 59453 - DNA, 22 bp, Artificial Sequence
  chemically synthesized
gcactgccaagaagcatgccaa

SEQ ID NO: 59454 - DNA, 22 bp, Artificial Sequence
  chemically synthesized
cactgccaagaagcatgccaaa

SEQ ID NO: 59455 - DNA, 22 bp, Artificial Sequence
  chemically synthesized
ccaagaagcatgccaaagttaa

SEQ ID NO: 59456 - DNA, 22 bp, Artificial Sequence
  chemically synthesized
atcattggccctgctgagtaca

SEQ ID NO: 59457 - DNA, 22 bp, Artificial Sequence
  chemically synthesized
gccctgctgagtacatggccga

SEQ ID NO: 59458 - DNA, 22 bp, Artificial Sequence
  chemically synthesized
ctgagtacatggccgatcaggc

SEQ ID NO: 59459 - DNA, 22 bp, Artificial Sequence
  chemically synthesized
agtacatggccgatcaggctgt

SEQ ID NO: 59460 - DNA, 22 bp, Artificial Sequence
  chemically synthesized
tttttgtgtgcctgtttttcta

SEQ ID NO: 59461 - DNA, 22 bp, Artificial Sequence
  chemically synthesized
ttgtgtgcctgtttttctattt

SEQ ID NO: 59462 - DNA, 22 bp, Artificial Sequence
  chemically synthesized
tgtgtgcctgtttttctatttt

SEQ ID NO: 59463 - DNA, 22 bp, Artificial Sequence
  chemically synthesized
gtgtgcctgtttttctatttta

SEQ ID NO: 59464 - DNA, 22 bp, Artificial Sequence
  chemically synthesized
tgtgcctgtttttctattttac

SEQ ID NO: 59465 - DNA, 22 bp, Artificial Sequence
  chemically synthesized
tttttctattttacgtaaatca

SEQ ID NO: 59466 - DNA, 22 bp, Artificial Sequence
  chemically synthesized
ttctattttacgtaaatcaccc

SEQ ID NO: 59467 - DNA, 22 bp, Artificial Sequence
  chemically synthesized
tctattttacgtaaatcaccct

SEQ ID NO: 59468 - DNA, 22 bp, Artificial Sequence
  chemically synthesized
ctattttacgtaaatcaccctg

SEQ ID NO: 59469 - DNA, 22 bp, Artificial Sequence
  chemically synthesized
tattttacgtaaatcaccctga

SEQ ID NO: 59470 - DNA, 22 bp, Artificial Sequence
  chemically synthesized
ttttacgtaaatcaccctgaac

SEQ ID NO: 59471 - DNA, 22 bp, Artificial Sequence
  chemically synthesized
tacgtaaatcaccctgaacatg

SEQ ID NO: 59472 - DNA, 22 bp, Artificial Sequence
  chemically synthesized
acgtaaatcaccctgaacatgt

SEQ ID NO: 59473 - DNA, 22 bp, Artificial Sequence
  chemically synthesized
cgtaaatcaccctgaacatgtt

SEQ ID NO: 59474 - DNA, 22 bp, Artificial Sequence
  chemically synthesized
aacatgtttgcatcaacctact

SEQ ID NO: 59475 - DNA, 22 bp, Artificial Sequence
  chemically synthesized
gcatcaacctactggtgatgca

SEQ ID NO: 59476 - DNA, 22 bp, Artificial Sequence
  chemically synthesized
catcaacctactggtgatgcac

SEQ ID NO: 59477 - DNA, 22 bp, Artificial Sequence
  chemically synthesized
ctggtgatgcacctttgatcaa

SEQ ID NO: 59478 - DNA, 22 bp, Artificial Sequence
  chemically synthesized
gtgatgcacctttgatcaatac

SEQ ID NO: 59479 - DNA, 22 bp, Artificial Sequence
  chemically synthesized
tgatcaatacattttagacaaa

SEQ ID NO: 59480 - DNA, 22 bp, Artificial Sequence
  chemically synthesized
gatcaatacattttagacaaac

SEQ ID NO: 59481 - DNA, 22 bp, Artificial Sequence
  chemically synthesized
atcaatacattttagacaaacg

SEQ ID NO: 59482 - DNA, 22 bp, Artificial Sequence
  chemically synthesized
tagacaaacgtggtttttgagt

SEQ ID NO: 59483 - DNA, 22 bp, Artificial Sequence
  chemically synthesized
agacaaacgtggtttttgagtc

SEQ ID NO: 59484 - DNA, 22 bp, Artificial Sequence
  chemically synthesized
gacaaacgtggtttttgagtcc

SEQ ID NO: 59485 - DNA, 22 bp, Artificial Sequence
  chemically synthesized
ttgagtccaaagatcagggctg

SEQ ID NO: 59486 - DNA, 22 bp, Artificial Sequence
  chemically synthesized
tgagtccaaagatcagggctgg

SEQ ID NO: 59487 - DNA, 22 bp, Artificial Sequence
  chemically synthesized
gagtccaaagatcagggctggg

SEQ ID NO: 59488 - DNA, 22 bp, Artificial Sequence
  chemically synthesized
agtccaaagatcagggctgggt

SEQ ID NO: 59489 - DNA, 22 bp, Artificial Sequence
  chemically synthesized
ggttgacctgaatactggatac

SEQ ID NO: 59490 - DNA, 22 bp, Artificial Sequence
  chemically synthesized
acctgaatactggatacagggc

SEQ ID NO: 59491 - DNA, 22 bp, Artificial Sequence
  chemically synthesized
aatactggatacagggcatata

SEQ ID NO: 59492 - DNA, 22 bp, Artificial Sequence
  chemically synthesized
gatacagggcatataaaacagg

SEQ ID NO: 59493 - DNA, 22 bp, Artificial Sequence
  chemically synthesized
atagcagagcaatcaccaccaa

SEQ ID NO: 59494 - DNA, 22 bp, Artificial Sequence
  chemically synthesized
gaataactgcaagggctctgct

SEQ ID NO: 59495 - DNA, 22 bp, Artificial Sequence
  chemically synthesized
caagggctctgctgacatcttc

SEQ ID NO: 59496 - DNA, 22 bp, Artificial Sequence
  chemically synthesized
tgctgacatcttcctgaggtgc

SEQ ID NO: 59497 - DNA, 22 bp, Artificial Sequence
  chemically synthesized
ctgacatcttcctgaggtgcca

SEQ ID NO: 59498 - DNA, 22 bp, Artificial Sequence
  chemically synthesized
acatcttcctgaggtgccaagg

SEQ ID NO: 59499 - DNA, 22 bp, Artificial Sequence
  chemically synthesized
cctgaggtgccaaggaaatgag

SEQ ID NO: 59500 - DNA, 22 bp, Artificial Sequence
  chemically synthesized
ctgaggtgccaaggaaatgagg

SEQ ID NO: 59501 - DNA, 22 bp, Artificial Sequence
  chemically synthesized
aggtgccaaggaaatgaggatg

SEQ ID NO: 59502 - DNA, 22 bp, Artificial Sequence
  chemically synthesized
tccatgactttgggatccagtc

SEQ ID NO: 59503 - DNA, 22 bp, Artificial Sequence
  chemically synthesized
catgactttgggatccagtcaa

SEQ ID NO: 59504 - DNA, 22 bp, Artificial Sequence
  chemically synthesized
tgggatccagtcaacacattac

SEQ ID NO: 59505 - DNA, 22 bp, Artificial Sequence
  chemically synthesized
gggatccagtcaacacattacc

SEQ ID NO: 59506 - DNA, 22 bp, Artificial Sequence
  chemically synthesized
ggatccagtcaacacattacct

SEQ ID NO: 59507 - DNA, 22 bp, Artificial Sequence
  chemically synthesized
cctccaggtgaattaccaagac

SEQ ID NO: 59508 - DNA, 22 bp, Artificial Sequence
  chemically synthesized
caggtgaattaccaagactccc

SEQ ID NO: 59509 - DNA, 22 bp, Artificial Sequence
  chemically synthesized
ccaagactcccaggactggttc

SEQ ID NO: 59510 - DNA, 22 bp, Artificial Sequence
  chemically synthesized
ccaggactggttcatcttggtg

SEQ ID NO: 59511 - DNA, 22 bp, Artificial Sequence
  chemically synthesized
gttcatcttggtgtccgtgatc

SEQ ID NO: 59512 - DNA, 22 bp, Artificial Sequence
  chemically synthesized
atcttggtgtccgtgatcgcag

SEQ ID NO: 59513 - DNA, 22 bp, Artificial Sequence
  chemically synthesized
ggtgtccgtgatcgcagacctc

SEQ ID NO: 59514 - DNA, 22 bp, Artificial Sequence
  chemically synthesized
gtgtccgtgatcgcagacctca

SEQ ID NO: 59515 - DNA, 22 bp, Artificial Sequence
  chemically synthesized
aggaatgccttctacgtcctct

SEQ ID NO: 59516 - DNA, 22 bp, Artificial Sequence
  chemically synthesized
ctacgtcctcttccccatctgg

SEQ ID NO: 59517 - DNA, 22 bp, Artificial Sequence
  chemically synthesized
tacgtcctcttccccatctggt

SEQ ID NO: 59518 - DNA, 22 bp, Artificial Sequence
  chemically synthesized
cgtcctcttccccatctggttc

SEQ ID NO: 59519 - DNA, 22 bp, Artificial Sequence
  chemically synthesized
ttccccatctggttccatcttc

SEQ ID NO: 59520 - DNA, 22 bp, Artificial Sequence
  chemically synthesized
ccccatctggttccatcttcag

SEQ ID NO: 59521 - DNA, 22 bp, Artificial Sequence
  chemically synthesized
cccatctggttccatcttcagg

SEQ ID NO: 59522 - DNA, 22 bp, Artificial Sequence
  chemically synthesized
gttccatcttcaggaagctgtg

SEQ ID NO: 59523 - DNA, 22 bp, Artificial Sequence
  chemically synthesized
catcttcaggaagctgtgggca

SEQ ID NO: 59524 - DNA, 22 bp, Artificial Sequence
  chemically synthesized
caggaagctgtgggcattaaac

SEQ ID NO: 59525 - DNA, 22 bp, Artificial Sequence
  chemically synthesized
aggaagctgtgggcattaaact

SEQ ID NO: 59526 - DNA, 22 bp, Artificial Sequence
  chemically synthesized
tgggcattaaactcctttgggt

SEQ ID NO: 59527 - DNA, 22 bp, Artificial Sequence
  chemically synthesized
aactcctttgggtagctgtgat

SEQ ID NO: 59528 - DNA, 22 bp, Artificial Sequence
  chemically synthesized
ctttgggtagctgtgattggag

SEQ ID NO: 59529 - DNA, 22 bp, Artificial Sequence
  chemically synthesized
tgggtagctgtgattggagact

SEQ ID NO: 59530 - DNA, 22 bp, Artificial Sequence
  chemically synthesized
gggtagctgtgattggagactg

SEQ ID NO: 59531 - DNA, 22 bp, Artificial Sequence
  chemically synthesized
ggtagctgtgattggagactgg

SEQ ID NO: 59532 - DNA, 22 bp, Artificial Sequence
  chemically synthesized
tgattggagactggctcaacct

SEQ ID NO: 59533 - DNA, 22 bp, Artificial Sequence
  chemically synthesized
gagactggctcaacctcgtctt

SEQ ID NO: 59534 - DNA, 22 bp, Artificial Sequence
  chemically synthesized
gctcaacctcgtctttaagtgg

SEQ ID NO: 59535 - DNA, 22 bp, Artificial Sequence
  chemically synthesized
aacctcgtctttaagtggtaag

SEQ ID NO: 59536 - DNA, 22 bp, Artificial Sequence
  chemically synthesized
gtctttaagtggtaagaaccat

SEQ ID NO: 59537 - DNA, 22 bp, Artificial Sequence
  chemically synthesized
taagtggtaagaaccatataga

SEQ ID NO: 59538 - DNA, 22 bp, Artificial Sequence
  chemically synthesized
aagtggtaagaaccatatagag

SEQ ID NO: 59539 - DNA, 22 bp, Artificial Sequence
  chemically synthesized
agtggtaagaaccatatagaga

SEQ ID NO: 59540 - DNA, 22 bp, Artificial Sequence
  chemically synthesized
gcattcgctctcgcaatgtctg

SEQ ID NO: 59541 - DNA, 22 bp, Artificial Sequence
  chemically synthesized
gctctcgcaatgtctgtccatc

SEQ ID NO: 59542 - DNA, 22 bp, Artificial Sequence
  chemically synthesized
tcgcaatgtctgtccatcagaa

SEQ ID NO: 59543 - DNA, 22 bp, Artificial Sequence
  chemically synthesized
gcaatgtctgtccatcagaagt

SEQ ID NO: 59544 - DNA, 22 bp, Artificial Sequence
  chemically synthesized
tccatcagaagttgctttcccc

SEQ ID NO: 59545 - DNA, 22 bp, Artificial Sequence
  chemically synthesized
ctttccccaggctattcaggaa

SEQ ID NO: 59546 - DNA, 22 bp, Artificial Sequence
  chemically synthesized
tccccaggctattcaggaagcc

SEQ ID NO: 59547 - DNA, 22 bp, Artificial Sequence
  chemically synthesized
ccccaggctattcaggaagcca

SEQ ID NO: 59548 - DNA, 22 bp, Artificial Sequence
  chemically synthesized
cccaggctattcaggaagccac

SEQ ID NO: 59549 - DNA, 22 bp, Artificial Sequence
  chemically synthesized
ttcaggaagccacgggctactc

SEQ ID NO: 59550 - DNA, 22 bp, Artificial Sequence
  chemically synthesized
aggaagccacgggctactcatg

SEQ ID NO: 59551 - DNA, 22 bp, Artificial Sequence
  chemically synthesized
ctcatgcttccaacccctctct

SEQ ID NO: 59552 - DNA, 22 bp, Artificial Sequence
  chemically synthesized
atgcttccaacccctctctctg

SEQ ID NO: 59553 - DNA, 22 bp, Artificial Sequence
  chemically synthesized
ccaacccctctctctgactttg

SEQ ID NO: 59554 - DNA, 22 bp, Artificial Sequence
  chemically synthesized
caacccctctctctgactttgg

SEQ ID NO: 59555 - DNA, 22 bp, Artificial Sequence
  chemically synthesized
tctctgactttggatcatctac

SEQ ID NO: 59556 - DNA, 22 bp, Artificial Sequence
  chemically synthesized
tctgactttggatcatctacat

SEQ ID NO: 59557 - DNA, 22 bp, Artificial Sequence
  chemically synthesized
tgactttggatcatctacataa

SEQ ID NO: 59558 - DNA, 22 bp, Artificial Sequence
  chemically synthesized
actttggatcatctacataaag

SEQ ID NO: 59559 - DNA, 22 bp, Artificial Sequence
  chemically synthesized
tggatcatctacataaaggggg

SEQ ID NO: 59560 - DNA, 22 bp, Artificial Sequence
  chemically synthesized
ggatcatctacataaaggggga

SEQ ID NO: 59561 - DNA, 22 bp, Artificial Sequence
  chemically synthesized
gatcatctacataaagggggaa

SEQ ID NO: 59562 - DNA, 22 bp, Artificial Sequence
  chemically synthesized
cataaagggggaagacagaaaa

SEQ ID NO: 59563 - DNA, 22 bp, Artificial Sequence
  chemically synthesized
ccagtgagttgaaaatacagga

SEQ ID NO: 59564 - DNA, 22 bp, Artificial Sequence
  chemically synthesized
aaaatacaggaaagcctatttc

SEQ ID NO: 59565 - DNA, 22 bp, Artificial Sequence
  chemically synthesized
tttcatatgggttaaagggtag

SEQ ID NO: 59566 - DNA, 22 bp, Artificial Sequence
  chemically synthesized
catatgggttaaagggtaggac

SEQ ID NO: 59567 - DNA, 22 bp, Artificial Sequence
  chemically synthesized
atatgggttaaagggtaggaca

SEQ ID NO: 59568 - DNA, 22 bp, Artificial Sequence
  chemically synthesized
aagggtaggacagttgaatttc

SEQ ID NO: 59569 - DNA, 22 bp, Artificial Sequence
  chemically synthesized
aatttcgtgaaaagtctgagtt

SEQ ID NO: 59570 - DNA, 22 bp, Artificial Sequence
  chemically synthesized
cgtgaaaagtctgagttatata

SEQ ID NO: 59571 - DNA, 22 bp, Artificial Sequence
  chemically synthesized
gtgaaaagtctgagttatatag

SEQ ID NO: 59572 - DNA, 22 bp, Artificial Sequence
  chemically synthesized
agttatataggctttgagcaaa

SEQ ID NO: 59573 - DNA, 22 bp, Artificial Sequence
  chemically synthesized
tataggctttgagcaaagagtt

SEQ ID NO: 59574 - DNA, 22 bp, Artificial Sequence
  chemically synthesized
tgagcaaagagttttattagta

SEQ ID NO: 59575 - DNA, 22 bp, Artificial Sequence
  chemically synthesized
gagcaaagagttttattagtat

SEQ ID NO: 59576 - DNA, 22 bp, Artificial Sequence
  chemically synthesized
agcaaagagttttattagtatg

SEQ ID NO: 59577 - DNA, 22 bp, Artificial Sequence
  chemically synthesized
tattagtatgaagcagaagagg

SEQ ID NO: 59578 - DNA, 22 bp, Artificial Sequence
  chemically synthesized
attagtatgaagcagaagaggt

SEQ ID NO: 59579 - DNA, 22 bp, Artificial Sequence
  chemically synthesized
ttagtatgaagcagaagaggta

SEQ ID NO: 59580 - DNA, 22 bp, Artificial Sequence
  chemically synthesized
gtatgaagcagaagaggtaaca

SEQ ID NO: 59581 - DNA, 22 bp, Artificial Sequence
  chemically synthesized
acacctgtaatcccagcacttt

SEQ ID NO: 59582 - DNA, 22 bp, Artificial Sequence
  chemically synthesized
taatcccagcactttgggaggc

SEQ ID NO: 59583 - DNA, 22 bp, Artificial Sequence
  chemically synthesized
tgggaggccgaggtgggcgaat

SEQ ID NO: 59584 - DNA, 22 bp, Artificial Sequence
  chemically synthesized
gggaggccgaggtgggcgaatc

SEQ ID NO: 59585 - DNA, 22 bp, Artificial Sequence
  chemically synthesized
ggaggccgaggtgggcgaatca

SEQ ID NO: 59586 - DNA, 22 bp, Artificial Sequence
  chemically synthesized
ctgggtgaactcaggagttcaa

SEQ ID NO: 59587 - DNA, 22 bp, Artificial Sequence
  chemically synthesized
ggtgaactcaggagttcaagac

SEQ ID NO: 59588 - DNA, 22 bp, Artificial Sequence
  chemically synthesized
aggagttcaagaccagcctggg

SEQ ID NO: 59589 - DNA, 22 bp, Artificial Sequence
  chemically synthesized
aagaccagcctgggcaacatgg

SEQ ID NO: 59590 - DNA, 22 bp, Artificial Sequence
  chemically synthesized
ggcaacatggcgaaactccatc

SEQ ID NO: 59591 - DNA, 22 bp, Artificial Sequence
  chemically synthesized
catctctacaaaaacattacga

SEQ ID NO: 59592 - DNA, 22 bp, Artificial Sequence
  chemically synthesized
tacaaaaacattacgaaaatta

SEQ ID NO: 59593 - DNA, 22 bp, Artificial Sequence
  chemically synthesized
caaaaacattacgaaaattagc

SEQ ID NO: 59594 - DNA, 22 bp, Artificial Sequence
  chemically synthesized
cgaaaattagctgggcgtgttg

SEQ ID NO: 59595 - DNA, 22 bp, Artificial Sequence
  chemically synthesized
gctgggcgtgttggtgctgtag

SEQ ID NO: 59596 - DNA, 22 bp, Artificial Sequence
  chemically synthesized
ggcgtgttggtgctgtagtccc

SEQ ID NO: 59597 - DNA, 22 bp, Artificial Sequence
  chemically synthesized
gtgctgtagtcccagctactca

SEQ ID NO: 59598 - DNA, 22 bp, Artificial Sequence
  chemically synthesized
tagtcccagctactcaggaggc

SEQ ID NO: 59599 - DNA, 22 bp, Artificial Sequence
  chemically synthesized
ctcaggaggctgaggtgagagg

SEQ ID NO: 59600 - DNA, 22 bp, Artificial Sequence
  chemically synthesized
aggaggctgaggtgagaggcgg

SEQ ID NO: 59601 - DNA, 22 bp, Artificial Sequence
  chemically synthesized
aggtgagaggcggaggaggttg

SEQ ID NO: 59602 - DNA, 22 bp, Artificial Sequence
  chemically synthesized
cagtgagtcaagatcatgccac

SEQ ID NO: 59603 - DNA, 22 bp, Artificial Sequence
  chemically synthesized
cactccagcctgggcaacagag

SEQ ID NO: 59604 - DNA, 22 bp, Artificial Sequence
  chemically synthesized
cagcctgggcaacagagtaaga

SEQ ID NO: 59605 - DNA, 22 bp, Artificial Sequence
  chemically synthesized
ggcaacagagtaagaccctgtc

SEQ ID NO: 59606 - DNA, 22 bp, Artificial Sequence
  chemically synthesized
tctcaaaaaaaaaaaaaagata

SEQ ID NO: 59607 - DNA, 22 bp, Artificial Sequence
  chemically synthesized
aaaaaaaaaaaaaagatagatg

SEQ ID NO: 59608 - DNA, 22 bp, Artificial Sequence
  chemically synthesized
tatgaaaaaaggaaacacacag

SEQ ID NO: 59609 - DNA, 22 bp, Artificial Sequence
  chemically synthesized
aacagcctgttttgtggggtaa

SEQ ID NO: 59610 - DNA, 22 bp, Artificial Sequence
  chemically synthesized
ttttgtggggtaatgaaaagtc

SEQ ID NO: 59611 - DNA, 22 bp, Artificial Sequence
  chemically synthesized
tgtggggtaatgaaaagtcacc

SEQ ID NO: 59612 - DNA, 22 bp, Artificial Sequence
  chemically synthesized
gtggggtaatgaaaagtcaccc

SEQ ID NO: 59613 - DNA, 22 bp, Artificial Sequence
  chemically synthesized
tggggtaatgaaaagtcaccct

SEQ ID NO: 59614 - DNA, 22 bp, Artificial Sequence
  chemically synthesized
ggaactgggctccagccctcgt

SEQ ID NO: 59615 - DNA, 22 bp, Artificial Sequence
  chemically synthesized
ggctccagccctcgttctgcca

SEQ ID NO: 59616 - DNA, 22 bp, Artificial Sequence
  chemically synthesized
cagccctcgttctgccacccac

SEQ ID NO: 59617 - DNA, 22 bp, Artificial Sequence
  chemically synthesized
gttctgccacccaccaactaca

SEQ ID NO: 59618 - DNA, 22 bp, Artificial Sequence
  chemically synthesized
tgccacccaccaactacatgtc

SEQ ID NO: 59619 - DNA, 22 bp, Artificial Sequence
  chemically synthesized
ccacccaccaactacatgtcct

SEQ ID NO: 59620 - DNA, 22 bp, Artificial Sequence
  chemically synthesized
catgtccttggcaagtcatatc

SEQ ID NO: 59621 - DNA, 22 bp, Artificial Sequence
  chemically synthesized
ggcaagtcatatcaattatctg

SEQ ID NO: 59622 - DNA, 22 bp, Artificial Sequence
  chemically synthesized
gcaagtcatatcaattatctga

SEQ ID NO: 59623 - DNA, 22 bp, Artificial Sequence
  chemically synthesized
tctgagtttctgttttataatc

SEQ ID NO: 59624 - DNA, 22 bp, Artificial Sequence
  chemically synthesized
agtttctgttttataatctaca

SEQ ID NO: 59625 - DNA, 22 bp, Artificial Sequence
  chemically synthesized
ctgttttataatctacaaatag

SEQ ID NO: 59626 - DNA, 22 bp, Artificial Sequence
  chemically synthesized
tgttttataatctacaaatagg

SEQ ID NO: 59627 - DNA, 22 bp, Artificial Sequence
  chemically synthesized
ttttataatctacaaataggtt

SEQ ID NO: 59628 - DNA, 22 bp, Artificial Sequence
  chemically synthesized
tataatctacaaataggttatc

SEQ ID NO: 59629 - DNA, 22 bp, Artificial Sequence
  chemically synthesized
ataatctacaaataggttatct

SEQ ID NO: 59630 - DNA, 22 bp, Artificial Sequence
  chemically synthesized
taatctacaaataggttatctc

SEQ ID NO: 59631 - DNA, 22 bp, Artificial Sequence
  chemically synthesized
caaataggttatctctggcagc

SEQ ID NO: 59632 - DNA, 22 bp, Artificial Sequence
  chemically synthesized
tctctggcagcttaataataat

SEQ ID NO: 59633 - DNA, 22 bp, Artificial Sequence
  chemically synthesized
tggcagcttaataataatcagg

SEQ ID NO: 59634 - DNA, 22 bp, Artificial Sequence
  chemically synthesized
gcagcttaataataatcagggt

SEQ ID NO: 59635 - DNA, 22 bp, Artificial Sequence
  chemically synthesized
aataataatcagggttaacatt

SEQ ID NO: 59636 - DNA, 22 bp, Artificial Sequence
  chemically synthesized
ataataatcagggttaacattt

SEQ ID NO: 59637 - DNA, 22 bp, Artificial Sequence
  chemically synthesized
acatttattaaacagtgtgtgc

SEQ ID NO: 59638 - DNA, 22 bp, Artificial Sequence
  chemically synthesized
attaaacagtgtgtgccagtcc

SEQ ID NO: 59639 - DNA, 22 bp, Artificial Sequence
  chemically synthesized
ttaaacagtgtgtgccagtcca

SEQ ID NO: 59640 - DNA, 22 bp, Artificial Sequence
  chemically synthesized
aacagtgtgtgccagtccatgt

SEQ ID NO: 59641 - DNA, 22 bp, Artificial Sequence
  chemically synthesized
tgtgcttttctgtgaggtagtt

SEQ ID NO: 59642 - DNA, 22 bp, Artificial Sequence
  chemically synthesized
ttctgtgaggtagttactgcta

SEQ ID NO: 59643 - DNA, 22 bp, Artificial Sequence
  chemically synthesized
tctgtgaggtagttactgctat

SEQ ID NO: 59644 - DNA, 22 bp, Artificial Sequence
  chemically synthesized
ctgtgaggtagttactgctatt

SEQ ID NO: 59645 - DNA, 22 bp, Artificial Sequence
  chemically synthesized
tgtgaggtagttactgctattt

SEQ ID NO: 59646 - DNA, 22 bp, Artificial Sequence
  chemically synthesized
tgaggtagttactgctatttac

SEQ ID NO: 59647 - DNA, 22 bp, Artificial Sequence
  chemically synthesized
ctgctatttacagaaacagtag

SEQ ID NO: 59648 - DNA, 22 bp, Artificial Sequence
  chemically synthesized
ctatttacagaaacagtagatg

SEQ ID NO: 59649 - DNA, 22 bp, Artificial Sequence
  chemically synthesized
tttacagaaacagtagatgcag

SEQ ID NO: 59650 - DNA, 22 bp, Artificial Sequence
  chemically synthesized
acagaaacagtagatgcagaga

SEQ ID NO: 59651 - DNA, 22 bp, Artificial Sequence
  chemically synthesized
cagaaacagtagatgcagagac

SEQ ID NO: 59652 - DNA, 22 bp, Artificial Sequence
  chemically synthesized
agttaaatgattaggccaacaa

SEQ ID NO: 59653 - DNA, 22 bp, Artificial Sequence
  chemically synthesized
aatgattaggccaacaaggtta

SEQ ID NO: 59654 - DNA, 22 bp, Artificial Sequence
  chemically synthesized
ggccaacaaggttagtacatgc

SEQ ID NO: 59655 - DNA, 22 bp, Artificial Sequence
  chemically synthesized
gtacatgccgagccaggatgga

SEQ ID NO: 59656 - DNA, 22 bp, Artificial Sequence
  chemically synthesized
gcttccgcggcaatgctcttat

SEQ ID NO: 59657 - DNA, 22 bp, Artificial Sequence
  chemically synthesized
ccgcggcaatgctcttatgaac

SEQ ID NO: 59658 - DNA, 22 bp, Artificial Sequence
  chemically synthesized
cgcggcaatgctcttatgaact

SEQ ID NO: 59659 - DNA, 22 bp, Artificial Sequence
  chemically synthesized
ttatgaactatgttacgtccag

SEQ ID NO: 59660 - DNA, 22 bp, Artificial Sequence
  chemically synthesized
atgaactatgttacgtccagtg

SEQ ID NO: 59661 - DNA, 22 bp, Artificial Sequence
  chemically synthesized
tgaactatgttacgtccagtgc

SEQ ID NO: 59662 - DNA, 22 bp, Artificial Sequence
  chemically synthesized
tgttacgtccagtgctgataaa

SEQ ID NO: 59663 - DNA, 22 bp, Artificial Sequence
  chemically synthesized
cgtccagtgctgataaactgac

SEQ ID NO: 59664 - DNA, 22 bp, Artificial Sequence
  chemically synthesized
ataaactgactctctggggagc

SEQ ID NO: 59665 - DNA, 22 bp, Artificial Sequence
  chemically synthesized
actctctggggagcaggggaaa

SEQ ID NO: 59666 - DNA, 22 bp, Artificial Sequence
  chemically synthesized
tctggggagcaggggaaagccc

SEQ ID NO: 59667 - DNA, 22 bp, Artificial Sequence
  chemically synthesized
tggggagcaggggaaagccctg

SEQ ID NO: 59668 - DNA, 22 bp, Artificial Sequence
  chemically synthesized
gggagcaggggaaagccctgag

SEQ ID NO: 59669 - DNA, 22 bp, Artificial Sequence
  chemically synthesized
agtttagcatttgccaatttct

SEQ ID NO: 59670 - DNA, 22 bp, Artificial Sequence
  chemically synthesized
agcatttgccaatttctatcac

SEQ ID NO: 59671 - DNA, 22 bp, Artificial Sequence
  chemically synthesized
gcatttgccaatttctatcacg

SEQ ID NO: 59672 - DNA, 22 bp, Artificial Sequence
  chemically synthesized
gccaatttctatcacgtaaaca

SEQ ID NO: 59673 - DNA, 22 bp, Artificial Sequence
  chemically synthesized
ccaatttctatcacgtaaacat

SEQ ID NO: 59674 - DNA, 22 bp, Artificial Sequence
  chemically synthesized
ctatcacgtaaacattcccatt

SEQ ID NO: 59675 - DNA, 22 bp, Artificial Sequence
  chemically synthesized
tatcacgtaaacattcccattc

SEQ ID NO: 59676 - DNA, 22 bp, Artificial Sequence
  chemically synthesized
tcacgtaaacattcccattctg

SEQ ID NO: 59677 - DNA, 22 bp, Artificial Sequence
  chemically synthesized
ccattctggccactttctttct

SEQ ID NO: 59678 - DNA, 22 bp, Artificial Sequence
  chemically synthesized
tggccactttctttctttcttt

SEQ ID NO: 59679 - DNA, 22 bp, Artificial Sequence
  chemically synthesized
gccactttctttctttctttct

SEQ ID NO: 59680 - DNA, 22 bp, Artificial Sequence
  chemically synthesized
tctttctttctttcttttgttt

SEQ ID NO: 59681 - DNA, 22 bp, Artificial Sequence
  chemically synthesized
ctttctttctttcttttgtttg

SEQ ID NO: 59682 - DNA, 22 bp, Artificial Sequence
  chemically synthesized
tttctttctttcttttgtttgt

SEQ ID NO: 59683 - DNA, 22 bp, Artificial Sequence
  chemically synthesized
tctttctttcttttgtttgttt

SEQ ID NO: 59684 - DNA, 22 bp, Artificial Sequence
  chemically synthesized
ctttctttcttttgtttgtttg

SEQ ID NO: 59685 - DNA, 22 bp, Artificial Sequence
  chemically synthesized
tttctttcttttgtttgtttgt

SEQ ID NO: 59686 - DNA, 22 bp, Artificial Sequence
  chemically synthesized
tctttcttttgtttgtttgttt

SEQ ID NO: 59687 - DNA, 22 bp, Artificial Sequence
  chemically synthesized
ctttcttttgtttgtttgtttg

SEQ ID NO: 59688 - DNA, 22 bp, Artificial Sequence
  chemically synthesized
tttcttttgtttgtttgtttga

SEQ ID NO: 59689 - DNA, 22 bp, Artificial Sequence
  chemically synthesized
tcttttgtttgtttgtttgaga

SEQ ID NO: 59690 - DNA, 22 bp, Artificial Sequence
  chemically synthesized
cttttgtttgtttgtttgagat

SEQ ID NO: 59691 - DNA, 22 bp, Artificial Sequence
  chemically synthesized
ttttgtttgtttgtttgagatg

SEQ ID NO: 59692 - DNA, 22 bp, Artificial Sequence
  chemically synthesized
ttgtttgtttgtttgagatgga

SEQ ID NO: 59693 - DNA, 22 bp, Artificial Sequence
  chemically synthesized
tgtttgtttgtttgagatggag

SEQ ID NO: 59694 - DNA, 22 bp, Artificial Sequence
  chemically synthesized
gtttgtttgtttgagatggagt

SEQ ID NO: 59695 - DNA, 22 bp, Artificial Sequence
  chemically synthesized
tttgtttgtttgagatggagtc

SEQ ID NO: 59696 - DNA, 22 bp, Artificial Sequence
  chemically synthesized
gtttgtttgagatggagtctcg

SEQ ID NO: 59697 - DNA, 22 bp, Artificial Sequence
  chemically synthesized
tttgtttgagatggagtctcgc

SEQ ID NO: 59698 - DNA, 22 bp, Artificial Sequence
  chemically synthesized
gtttgagatggagtctcgcact

SEQ ID NO: 59699 - DNA, 22 bp, Artificial Sequence
  chemically synthesized
tttgagatggagtctcgcactg

SEQ ID NO: 59700 - DNA, 22 bp, Artificial Sequence
  chemically synthesized
gagatggagtctcgcactgttg

SEQ ID NO: 59701 - DNA, 22 bp, Artificial Sequence
  chemically synthesized
agatggagtctcgcactgttgc

SEQ ID NO: 59702 - DNA, 22 bp, Artificial Sequence
  chemically synthesized
gcactgttgcctggctggagtg

SEQ ID NO: 59703 - DNA, 22 bp, Artificial Sequence
  chemically synthesized
ttgcctggctggagtgcaatgg

SEQ ID NO: 59704 - DNA, 22 bp, Artificial Sequence
  chemically synthesized
cctggctggagtgcaatggtgc

SEQ ID NO: 59705 - DNA, 22 bp, Artificial Sequence
  chemically synthesized
gctggagtgcaatggtgcaatc

SEQ ID NO: 59706 - DNA, 22 bp, Artificial Sequence
  chemically synthesized
gagtgcaatggtgcaatctcag

SEQ ID NO: 59707 - DNA, 22 bp, Artificial Sequence
  chemically synthesized
agctcactgcaacctctgcctc

SEQ ID NO: 59708 - DNA, 22 bp, Artificial Sequence
  chemically synthesized
actgcaacctctgcctctccgg

SEQ ID NO: 59709 - DNA, 22 bp, Artificial Sequence
  chemically synthesized
caacctctgcctctccggttca

SEQ ID NO: 59710 - DNA, 22 bp, Artificial Sequence
  chemically synthesized
tgcctctccggttcaagtgatt

SEQ ID NO: 59711 - DNA, 22 bp, Artificial Sequence
  chemically synthesized
cctctccggttcaagtgattct

SEQ ID NO: 59712 - DNA, 22 bp, Artificial Sequence
  chemically synthesized
tccggttcaagtgattctcctg

SEQ ID NO: 59713 - DNA, 22 bp, Artificial Sequence
  chemically synthesized
cggttcaagtgattctcctgcc

SEQ ID NO: 59714 - DNA, 22 bp, Artificial Sequence
  chemically synthesized
aagtgattctcctgcctcagcc

SEQ ID NO: 59715 - DNA, 22 bp, Artificial Sequence
  chemically synthesized
tcctgcctcagcctcccaagta

SEQ ID NO: 59716 - DNA, 22 bp, Artificial Sequence
  chemically synthesized
ctgcctcagcctcccaagtagc

SEQ ID NO: 59717 - DNA, 22 bp, Artificial Sequence
  chemically synthesized
cctcagcctcccaagtagctgg

SEQ ID NO: 59718 - DNA, 22 bp, Artificial Sequence
  chemically synthesized
agcctcccaagtagctgggatt

SEQ ID NO: 59719 - DNA, 22 bp, Artificial Sequence
  chemically synthesized
ccaagtagctgggattacaggt

SEQ ID NO: 59720 - DNA, 22 bp, Artificial Sequence
  chemically synthesized
ggattacaggtgcccgccacca

SEQ ID NO: 59721 - DNA, 22 bp, Artificial Sequence
  chemically synthesized
caggtgcccgccaccatgccca

SEQ ID NO: 59722 - DNA, 22 bp, Artificial Sequence
  chemically synthesized
attttttttgtatttttagtag

SEQ ID NO: 59723 - DNA, 22 bp, Artificial Sequence
  chemically synthesized
tttttgtatttttagtagagac

SEQ ID NO: 59724 - DNA, 22 bp, Artificial Sequence
  chemically synthesized
ttttgtatttttagtagagaca

SEQ ID NO: 59725 - DNA, 22 bp, Artificial Sequence
  chemically synthesized
tttgtatttttagtagagacat

SEQ ID NO: 59726 - DNA, 22 bp, Artificial Sequence
  chemically synthesized
ttgtatttttagtagagacatg

SEQ ID NO: 59727 - DNA, 22 bp, Artificial Sequence
  chemically synthesized
tgtatttttagtagagacatgg

SEQ ID NO: 59728 - DNA, 22 bp, Artificial Sequence
  chemically synthesized
gtatttttagtagagacatggt

SEQ ID NO: 59729 - DNA, 22 bp, Artificial Sequence
  chemically synthesized
tatttttagtagagacatggtt

SEQ ID NO: 59730 - DNA, 22 bp, Artificial Sequence
  chemically synthesized
ttagtagagacatggtttcact

SEQ ID NO: 59731 - DNA, 22 bp, Artificial Sequence
  chemically synthesized
tagtagagacatggtttcacta

SEQ ID NO: 59732 - DNA, 22 bp, Artificial Sequence
  chemically synthesized
agtagagacatggtttcactat

SEQ ID NO: 59733 - DNA, 22 bp, Artificial Sequence
  chemically synthesized
gtagagacatggtttcactatg

SEQ ID NO: 59734 - DNA, 22 bp, Artificial Sequence
  chemically synthesized
cactatgttgactaggctggtc

SEQ ID NO: 59735 - DNA, 22 bp, Artificial Sequence
  chemically synthesized
actatgttgactaggctggtct

SEQ ID NO: 59736 - DNA, 22 bp, Artificial Sequence
  chemically synthesized
tgttgactaggctggtctcgaa

SEQ ID NO: 59737 - DNA, 22 bp, Artificial Sequence
  chemically synthesized
actaggctggtctcgaactcct

SEQ ID NO: 59738 - DNA, 22 bp, Artificial Sequence
  chemically synthesized
ggctggtctcgaactcctgacc

SEQ ID NO: 59739 - DNA, 22 bp, Artificial Sequence
  chemically synthesized
gtctcgaactcctgacctcatg

SEQ ID NO: 59740 - DNA, 22 bp, Artificial Sequence
  chemically synthesized
gaactcctgacctcatgatctg

SEQ ID NO: 59741 - DNA, 22 bp, Artificial Sequence
  chemically synthesized
ctgacctcatgatctgcctgcc

SEQ ID NO: 59742 - DNA, 22 bp, Artificial Sequence
  chemically synthesized
acctcatgatctgcctgccttg

SEQ ID NO: 59743 - DNA, 22 bp, Artificial Sequence
  chemically synthesized
atgatctgcctgccttggcctc

SEQ ID NO: 59744 - DNA, 22 bp, Artificial Sequence
  chemically synthesized
cctgccttggcctccctaagtg

SEQ ID NO: 59745 - DNA, 22 bp, Artificial Sequence
  chemically synthesized
ccttggcctccctaagtgctag

SEQ ID NO: 59746 - DNA, 22 bp, Artificial Sequence
  chemically synthesized
ggcctccctaagtgctaggatt

SEQ ID NO: 59747 - DNA, 22 bp, Artificial Sequence
  chemically synthesized
gcctccctaagtgctaggatta

SEQ ID NO: 59748 - DNA, 22 bp, Artificial Sequence
  chemically synthesized
cctaagtgctaggattacaggc

SEQ ID NO: 59749 - DNA, 22 bp, Artificial Sequence
  chemically synthesized
agtgctaggattacaggcgtga

SEQ ID NO: 59750 - DNA, 22 bp, Artificial Sequence
  chemically synthesized
ggattacaggcgtgagccacta

SEQ ID NO: 59751 - DNA, 22 bp, Artificial Sequence
  chemically synthesized
caggcgtgagccactacaccca

SEQ ID NO: 59752 - DNA, 22 bp, Artificial Sequence
  chemically synthesized
cacccagccgcatgattctaaa

SEQ ID NO: 59753 - DNA, 22 bp, Artificial Sequence
  chemically synthesized
taaaaaataaaaagatgaagtg

SEQ ID NO: 59754 - DNA, 22 bp, Artificial Sequence
  chemically synthesized
aaaaataaaaagatgaagtgtt

SEQ ID NO: 59755 - DNA, 22 bp, Artificial Sequence
  chemically synthesized
ttccaaacatctgatctccatt

SEQ ID NO: 59756 - DNA, 22 bp, Artificial Sequence
  chemically synthesized
caaacatctgatctccattgaa

SEQ ID NO: 59757 - DNA, 22 bp, Artificial Sequence
  chemically synthesized
atctccattgaagaaccatgca

SEQ ID NO: 59758 - DNA, 22 bp, Artificial Sequence
  chemically synthesized
cattgaagaaccatgcaatctc

SEQ ID NO: 59759 - DNA, 22 bp, Artificial Sequence
  chemically synthesized
aagaaccatgcaatctctctgg

SEQ ID NO: 59760 - DNA, 22 bp, Artificial Sequence
  chemically synthesized
tctgggttgatagaggccagag

SEQ ID NO: 59761 - DNA, 22 bp, Artificial Sequence
  chemically synthesized
tgggttgatagaggccagagtt

SEQ ID NO: 59762 - DNA, 22 bp, Artificial Sequence
  chemically synthesized
ggttgatagaggccagagttag

SEQ ID NO: 59763 - DNA, 22 bp, Artificial Sequence
  chemically synthesized
atagaggccagagttagtggct

SEQ ID NO: 59764 - DNA, 22 bp, Artificial Sequence
  chemically synthesized
gtggctctccctgatttcggtg

SEQ ID NO: 59765 - DNA, 22 bp, Artificial Sequence
  chemically synthesized
tccctgatttcggtgagaaatc

SEQ ID NO: 59766 - DNA, 22 bp, Artificial Sequence
  chemically synthesized
cctgatttcggtgagaaatcac

SEQ ID NO: 59767 - DNA, 22 bp, Artificial Sequence
  chemically synthesized
atttcggtgagaaatcactatt

SEQ ID NO: 59768 - DNA, 22 bp, Artificial Sequence
  chemically synthesized
cggtgagaaatcactattccac

SEQ ID NO: 59769 - DNA, 22 bp, Artificial Sequence
  chemically synthesized
ggtgagaaatcactattccacc

SEQ ID NO: 59770 - DNA, 22 bp, Artificial Sequence
  chemically synthesized
ttccaccatcacgggataaaag

SEQ ID NO: 59771 - DNA, 22 bp, Artificial Sequence
  chemically synthesized
caccatcacgggataaaaggca

SEQ ID NO: 59772 - DNA, 22 bp, Artificial Sequence
  chemically synthesized
actggcggttgacacctatttc

SEQ ID NO: 59773 - DNA, 22 bp, Artificial Sequence
  chemically synthesized
gcggttgacacctatttccaca

SEQ ID NO: 59774 - DNA, 22 bp, Artificial Sequence
  chemically synthesized
acacctatttccacagtgaaag

SEQ ID NO: 59775 - DNA, 22 bp, Artificial Sequence
  chemically synthesized
tttccacagtgaaagatatatc

SEQ ID NO: 59776 - DNA, 22 bp, Artificial Sequence
  chemically synthesized
ccacagtgaaagatatatctag

SEQ ID NO: 59777 - DNA, 22 bp, Artificial Sequence
  chemically synthesized
cacagtgaaagatatatctagt

SEQ ID NO: 59778 - DNA, 22 bp, Artificial Sequence
  chemically synthesized
gtacttttaaaggggaagtggt

SEQ ID NO: 59779 - DNA, 22 bp, Artificial Sequence
  chemically synthesized
ttaaaggggaagtggtttgtct

SEQ ID NO: 59780 - DNA, 22 bp, Artificial Sequence
  chemically synthesized
taaaggggaagtggtttgtctg

SEQ ID NO: 59781 - DNA, 22 bp, Artificial Sequence
  chemically synthesized
aaaggggaagtggtttgtctga

SEQ ID NO: 59782 - DNA, 22 bp, Artificial Sequence
  chemically synthesized
aaggggaagtggtttgtctgag

SEQ ID NO: 59783 - DNA, 22 bp, Artificial Sequence
  chemically synthesized
gtctgagatactctgtttcaaa

SEQ ID NO: 59784 - DNA, 22 bp, Artificial Sequence
  chemically synthesized
tctgagatactctgtttcaaag

SEQ ID NO: 59785 - DNA, 22 bp, Artificial Sequence
  chemically synthesized
agatactctgtttcaaagtaga

SEQ ID NO: 59786 - DNA, 22 bp, Artificial Sequence
  chemically synthesized
tgtttcaaagtagagaggatac

SEQ ID NO: 59787 - DNA, 22 bp, Artificial Sequence
  chemically synthesized
tttcaaagtagagaggatacag

SEQ ID NO: 59788 - DNA, 22 bp, Artificial Sequence
  chemically synthesized
caaagtagagaggatacagaac

SEQ ID NO: 59789 - DNA, 22 bp, Artificial Sequence
  chemically synthesized
aaagtagagaggatacagaaca

SEQ ID NO: 59790 - DNA, 22 bp, Artificial Sequence
  chemically synthesized
aagctatatacatccttacaga

SEQ ID NO: 59791 - DNA, 22 bp, Artificial Sequence
  chemically synthesized
tatacatccttacagagagcaa

SEQ ID NO: 59792 - DNA, 22 bp, Artificial Sequence
  chemically synthesized
acagagagcaattctgatggaa

SEQ ID NO: 59793 - DNA, 22 bp, Artificial Sequence
  chemically synthesized
cagagagcaattctgatggaaa

SEQ ID NO: 59794 - DNA, 22 bp, Artificial Sequence
  chemically synthesized
tgatggaaatgcaggccatgtt

SEQ ID NO: 59795 - DNA, 22 bp, Artificial Sequence
  chemically synthesized
atggaaatgcaggccatgtttc

SEQ ID NO: 59796 - DNA, 22 bp, Artificial Sequence
  chemically synthesized
ccctggggggggctcgtcctag

SEQ ID NO: 59797 - DNA, 22 bp, Artificial Sequence
  chemically synthesized
cctggggggggctcgtcctagg

SEQ ID NO: 59798 - DNA, 22 bp, Artificial Sequence
  chemically synthesized
gggggggctcgtcctaggggct

SEQ ID NO: 59799 - DNA, 22 bp, Artificial Sequence
  chemically synthesized
gtcctaggggctggagtgcatt

SEQ ID NO: 59800 - DNA, 22 bp, Artificial Sequence
  chemically synthesized
ggggctggagtgcattctctga

SEQ ID NO: 59801 - DNA, 22 bp, Artificial Sequence
  chemically synthesized
gagtgcattctctgatgtcaga

SEQ ID NO: 59802 - DNA, 22 bp, Artificial Sequence
  chemically synthesized
tctgatgtcagaggaaatgcaa

SEQ ID NO: 59803 - DNA, 22 bp, Artificial Sequence
  chemically synthesized
tgatgtcagaggaaatgcaaga

SEQ ID NO: 59804 - DNA, 22 bp, Artificial Sequence
  chemically synthesized
atgtcagaggaaatgcaagatt

SEQ ID NO: 59805 - DNA, 22 bp, Artificial Sequence
  chemically synthesized
cctgaggcctgagggaacccat

SEQ ID NO: 59806 - DNA, 22 bp, Artificial Sequence
  chemically synthesized
aggcctgagggaacccatggta

SEQ ID NO: 59807 - DNA, 22 bp, Artificial Sequence
  chemically synthesized
agggaacccatggtatatgcaa

SEQ ID NO: 59808 - DNA, 22 bp, Artificial Sequence
  chemically synthesized
caaactgtagttccatatgcat

SEQ ID NO: 59809 - DNA, 22 bp, Artificial Sequence
  chemically synthesized
aaactgtagttccatatgcatt

SEQ ID NO: 59810 - DNA, 22 bp, Artificial Sequence
  chemically synthesized
tagttccatatgcattcttcca

SEQ ID NO: 59811 - DNA, 22 bp, Artificial Sequence
  chemically synthesized
catatgcattcttccaggacaa

SEQ ID NO: 59812 - DNA, 22 bp, Artificial Sequence
  chemically synthesized
ttccaggacaaatacttcttga

SEQ ID NO: 59813 - DNA, 22 bp, Artificial Sequence
  chemically synthesized
ccaggacaaatacttcttgagg

SEQ ID NO: 59814 - DNA, 22 bp, Artificial Sequence
  chemically synthesized
caggacaaatacttcttgaggt

SEQ ID NO: 59815 - DNA, 22 bp, Artificial Sequence
  chemically synthesized
cttgaggttaaaaaaaaaaagt

SEQ ID NO: 59816 - DNA, 22 bp, Artificial Sequence
  chemically synthesized
ttgaggttaaaaaaaaaaagtc

SEQ ID NO: 59817 - DNA, 22 bp, Artificial Sequence
  chemically synthesized
gaggttaaaaaaaaaaagtcac

SEQ ID NO: 59818 - DNA, 22 bp, Artificial Sequence
  chemically synthesized
aggttaaaaaaaaaaagtcaca

SEQ ID NO: 59819 - DNA, 22 bp, Artificial Sequence
  chemically synthesized
aaaaaaaaaagtcacatagctg

SEQ ID NO: 59820 - DNA, 22 bp, Artificial Sequence
  chemically synthesized
ccattttatggatttcaggatt

SEQ ID NO: 59821 - DNA, 22 bp, Artificial Sequence
  chemically synthesized
tatggatttcaggatttttttt

SEQ ID NO: 59822 - DNA, 22 bp, Artificial Sequence
  chemically synthesized
atggatttcaggattttttttt

SEQ ID NO: 59823 - DNA, 22 bp, Artificial Sequence
  chemically synthesized
tggatttcaggatttttttttt

SEQ ID NO: 59824 - DNA, 22 bp, Artificial Sequence
  chemically synthesized
caggattttttttttttttttt

SEQ ID NO: 59825 - DNA, 22 bp, Artificial Sequence
  chemically synthesized
aggatttttttttttttttttt

SEQ ID NO: 59826 - DNA, 22 bp, Artificial Sequence
  chemically synthesized
ttttttttttttttttgagatg

SEQ ID NO: 59827 - DNA, 22 bp, Artificial Sequence
  chemically synthesized
tttttttttttttttgagatgg

SEQ ID NO: 59828 - DNA, 22 bp, Artificial Sequence
  chemically synthesized
ttttttttttttttgagatgga

SEQ ID NO: 59829 - DNA, 22 bp, Artificial Sequence
  chemically synthesized
tttttttttttttgagatggag

SEQ ID NO: 59830 - DNA, 22 bp, Artificial Sequence
  chemically synthesized
ttttttttttttgagatggagt

SEQ ID NO: 59831 - DNA, 22 bp, Artificial Sequence
  chemically synthesized
tttttttttttgagatggagtc

SEQ ID NO: 59832 - DNA, 22 bp, Artificial Sequence
  chemically synthesized
ttttttttttgagatggagtct

SEQ ID NO: 59833 - DNA, 22 bp, Artificial Sequence
  chemically synthesized
tttttttttgagatggagtctt

SEQ ID NO: 59834 - DNA, 22 bp, Artificial Sequence
  chemically synthesized
ttttttttgagatggagtcttg

SEQ ID NO: 59835 - DNA, 22 bp, Artificial Sequence
  chemically synthesized
tttttttgagatggagtcttgc

SEQ ID NO: 59836 - DNA, 22 bp, Artificial Sequence
  chemically synthesized
ttttttgagatggagtcttgct

SEQ ID NO: 59837 - DNA, 22 bp, Artificial Sequence
  chemically synthesized
tttttgagatggagtcttgctc

SEQ ID NO: 59838 - DNA, 22 bp, Artificial Sequence
  chemically synthesized
ttttgagatggagtcttgctct

SEQ ID NO: 59839 - DNA, 22 bp, Artificial Sequence
  chemically synthesized
tttgagatggagtcttgctctg

SEQ ID NO: 59840 - DNA, 22 bp, Artificial Sequence
  chemically synthesized
ttgagatggagtcttgctctgt

SEQ ID NO: 59841 - DNA, 22 bp, Artificial Sequence
  chemically synthesized
tgagatggagtcttgctctgtc

SEQ ID NO: 59842 - DNA, 22 bp, Artificial Sequence
  chemically synthesized
gagatggagtcttgctctgtca

SEQ ID NO: 59843 - DNA, 22 bp, Artificial Sequence
  chemically synthesized
agatggagtcttgctctgtcac

SEQ ID NO: 59844 - DNA, 22 bp, Artificial Sequence
  chemically synthesized
gctctgtcacccagcctgtagt

SEQ ID NO: 59845 - DNA, 22 bp, Artificial Sequence
  chemically synthesized
ctctgtcacccagcctgtagtg

SEQ ID NO: 59846 - DNA, 22 bp, Artificial Sequence
  chemically synthesized
tgtcacccagcctgtagtgcag

SEQ ID NO: 59847 - DNA, 22 bp, Artificial Sequence
  chemically synthesized
tcacccagcctgtagtgcagtg

SEQ ID NO: 59848 - DNA, 22 bp, Artificial Sequence
  chemically synthesized
tagtgcagtggcataatctcgg

SEQ ID NO: 59849 - DNA, 22 bp, Artificial Sequence
  chemically synthesized
ggctcacggcaacctccgcctc

SEQ ID NO: 59850 - DNA, 22 bp, Artificial Sequence
  chemically synthesized
acggcaacctccgcctcccagg

SEQ ID NO: 59851 - DNA, 22 bp, Artificial Sequence
  chemically synthesized
cgcctcccaggttcaagcgatt

SEQ ID NO: 59852 - DNA, 22 bp, Artificial Sequence
  chemically synthesized
ccaggttcaagcgattctcttg

SEQ ID NO: 59853 - DNA, 22 bp, Artificial Sequence
  chemically synthesized
aagcgattctcttgccttagcc

SEQ ID NO: 59854 - DNA, 22 bp, Artificial Sequence
  chemically synthesized
tcttgccttagcctcccgagta

SEQ ID NO: 59855 - DNA, 22 bp, Artificial Sequence
  chemically synthesized
ttgccttagcctcccgagtagc

SEQ ID NO: 59856 - DNA, 22 bp, Artificial Sequence
  chemically synthesized
gccttagcctcccgagtagctg

SEQ ID NO: 59857 - DNA, 22 bp, Artificial Sequence
  chemically synthesized
ccttagcctcccgagtagctgg

SEQ ID NO: 59858 - DNA, 22 bp, Artificial Sequence
  chemically synthesized
agcctcccgagtagctgggatt

SEQ ID NO: 59859 - DNA, 22 bp, Artificial Sequence
  chemically synthesized
gcctcccgagtagctgggatta

SEQ ID NO: 59860 - DNA, 22 bp, Artificial Sequence
  chemically synthesized
ccgagtagctgggattacagtc

SEQ ID NO: 59861 - DNA, 22 bp, Artificial Sequence
  chemically synthesized
ggattacagtcacgcaccacca

SEQ ID NO: 59862 - DNA, 22 bp, Artificial Sequence
  chemically synthesized
cagtcacgcaccaccacatctg

SEQ ID NO: 59863 - DNA, 22 bp, Artificial Sequence
  chemically synthesized
gctaattctttatattttttgg

SEQ ID NO: 59864 - DNA, 22 bp, Artificial Sequence
  chemically synthesized
attctttatattttttggtaga

SEQ ID NO: 59865 - DNA, 22 bp, Artificial Sequence
  chemically synthesized
tttatattttttggtagaaacg

SEQ ID NO: 59866 - DNA, 22 bp, Artificial Sequence
  chemically synthesized
tatattttttggtagaaacggt

SEQ ID NO: 59867 - DNA, 22 bp, Artificial Sequence
  chemically synthesized
atattttttggtagaaacggtg

SEQ ID NO: 59868 - DNA, 22 bp, Artificial Sequence
  chemically synthesized
tattttttggtagaaacggtgt

SEQ ID NO: 59869 - DNA, 22 bp, Artificial Sequence
  chemically synthesized
tttggtagaaacggtgtttcac

SEQ ID NO: 59870 - DNA, 22 bp, Artificial Sequence
  chemically synthesized
ttggtagaaacggtgtttcacc

SEQ ID NO: 59871 - DNA, 22 bp, Artificial Sequence
  chemically synthesized
tggtagaaacggtgtttcacca

SEQ ID NO: 59872 - DNA, 22 bp, Artificial Sequence
  chemically synthesized
ggtagaaacggtgtttcaccat

SEQ ID NO: 59873 - DNA, 22 bp, Artificial Sequence
  chemically synthesized
gtagaaacggtgtttcaccatg

SEQ ID NO: 59874 - DNA, 22 bp, Artificial Sequence
  chemically synthesized
caccatgttggccaggctggtc

SEQ ID NO: 59875 - DNA, 22 bp, Artificial Sequence
  chemically synthesized
accatgttggccaggctggtct

SEQ ID NO: 59876 - DNA, 22 bp, Artificial Sequence
  chemically synthesized
gccaggctggtctcaaactcct

SEQ ID NO: 59877 - DNA, 22 bp, Artificial Sequence
  chemically synthesized
gtctcaaactcctgacctcatg

SEQ ID NO: 59878 - DNA, 22 bp, Artificial Sequence
  chemically synthesized
aaactcctgacctcatgtgatc

SEQ ID NO: 59879 - DNA, 22 bp, Artificial Sequence
  chemically synthesized
ctgacctcatgtgatctgcctg

SEQ ID NO: 59880 - DNA, 22 bp, Artificial Sequence
  chemically synthesized
acctcatgtgatctgcctgcct

SEQ ID NO: 59881 - DNA, 22 bp, Artificial Sequence
  chemically synthesized
atgtgatctgcctgccttggcc

SEQ ID NO: 59882 - DNA, 22 bp, Artificial Sequence
  chemically synthesized
cctgccttggcctcccaaagtg

SEQ ID NO: 59883 - DNA, 22 bp, Artificial Sequence
  chemically synthesized
ccttggcctcccaaagtgctga

SEQ ID NO: 59884 - DNA, 22 bp, Artificial Sequence
  chemically synthesized
ggcctcccaaagtgctgagatt

SEQ ID NO: 59885 - DNA, 22 bp, Artificial Sequence
  chemically synthesized
gcctcccaaagtgctgagatta

SEQ ID NO: 59886 - DNA, 22 bp, Artificial Sequence
  chemically synthesized
ccaaagtgctgagattacaggt

SEQ ID NO: 59887 - DNA, 22 bp, Artificial Sequence
  chemically synthesized
agattacaggtgtgagccaccg

SEQ ID NO: 59888 - DNA, 22 bp, Artificial Sequence
  chemically synthesized
caggtgtgagccaccgcgcctg

SEQ ID NO: 59889 - DNA, 22 bp, Artificial Sequence
  chemically synthesized
cctggagttcagaatcttgggc

SEQ ID NO: 59890 - DNA, 22 bp, Artificial Sequence
  chemically synthesized
gagttcagaatcttgggcttca

SEQ ID NO: 59891 - DNA, 22 bp, Artificial Sequence
  chemically synthesized
agaatcttgggcttcattattt

SEQ ID NO: 59892 - DNA, 22 bp, Artificial Sequence
  chemically synthesized
gggcttcattatttgtgtttaa

SEQ ID NO: 59893 - DNA, 22 bp, Artificial Sequence
  chemically synthesized
ggcttcattatttgtgtttaaa

SEQ ID NO: 59894 - DNA, 22 bp, Artificial Sequence
  chemically synthesized
cattatttgtgtttaaatagat

SEQ ID NO: 59895 - DNA, 22 bp, Artificial Sequence
  chemically synthesized
attatttgtgtttaaatagatc

SEQ ID NO: 59896 - DNA, 22 bp, Artificial Sequence
  chemically synthesized
tttgtgtttaaatagatcatac

SEQ ID NO: 59897 - DNA, 22 bp, Artificial Sequence
  chemically synthesized
gtgtttaaatagatcatacagt

SEQ ID NO: 59898 - DNA, 22 bp, Artificial Sequence
  chemically synthesized
tgtttaaatagatcatacagtc

SEQ ID NO: 59899 - DNA, 22 bp, Artificial Sequence
  chemically synthesized
aaatagatcatacagtcaggca

SEQ ID NO: 59900 - DNA, 22 bp, Artificial Sequence
  chemically synthesized
aatagatcatacagtcaggcac

SEQ ID NO: 59901 - DNA, 22 bp, Artificial Sequence
  chemically synthesized
atgcctgtaatcccagcacttt

SEQ ID NO: 59902 - DNA, 22 bp, Artificial Sequence
  chemically synthesized
taatcccagcactttgggaggc

SEQ ID NO: 59903 - DNA, 22 bp, Artificial Sequence
  chemically synthesized
tgggaggctgaggtgggaggat

SEQ ID NO: 59904 - DNA, 22 bp, Artificial Sequence
  chemically synthesized
gggaggctgaggtgggaggatt

SEQ ID NO: 59905 - DNA, 22 bp, Artificial Sequence
  chemically synthesized
ggaggctgaggtgggaggattg

SEQ ID NO: 59906 - DNA, 22 bp, Artificial Sequence
  chemically synthesized
aggtgggaggattgcctgagtt

SEQ ID NO: 59907 - DNA, 22 bp, Artificial Sequence
  chemically synthesized
cctgagttcaggagatggagac

SEQ ID NO: 59908 - DNA, 22 bp, Artificial Sequence
  chemically synthesized
agttcaggagatggagaccagc

SEQ ID NO: 59909 - DNA, 22 bp, Artificial Sequence
  chemically synthesized
aggagatggagaccagcctggg

SEQ ID NO: 59910 - DNA, 22 bp, Artificial Sequence
  chemically synthesized
ggcaacatggtgaaaccccgtc

SEQ ID NO: 59911 - DNA, 22 bp, Artificial Sequence
  chemically synthesized
tactaaaaatacaaaaactagc

SEQ ID NO: 59912 - DNA, 22 bp, Artificial Sequence
  chemically synthesized
ctaaaaatacaaaaactagctg

SEQ ID NO: 59913 - DNA, 22 bp, Artificial Sequence
  chemically synthesized
aaaatacaaaaactagctggat

SEQ ID NO: 59914 - DNA, 22 bp, Artificial Sequence
  chemically synthesized
gctggatgtggtggcacacacc

SEQ ID NO: 59915 - DNA, 22 bp, Artificial Sequence
  chemically synthesized
gatgtggtggcacacacctgta

SEQ ID NO: 59916 - DNA, 22 bp, Artificial Sequence
  chemically synthesized
tagtcccagctattcaggaggc

SEQ ID NO: 59917 - DNA, 22 bp, Artificial Sequence
  chemically synthesized
ttcaggaggctgaggtgggagg

SEQ ID NO: 59918 - DNA, 22 bp, Artificial Sequence
  chemically synthesized
aggaggctgaggtgggaggatc

SEQ ID NO: 59919 - DNA, 22 bp, Artificial Sequence
  chemically synthesized
aggtgggaggatcccaggaggt

SEQ ID NO: 59920 - DNA, 22 bp, Artificial Sequence
  chemically synthesized
cgccactgcactccaggctggg

SEQ ID NO: 59921 - DNA, 22 bp, Artificial Sequence
  chemically synthesized
cactccaggctgggttactgag

SEQ ID NO: 59922 - DNA, 22 bp, Artificial Sequence
  chemically synthesized
caggctgggttactgagccaga

SEQ ID NO: 59923 - DNA, 22 bp, Artificial Sequence
  chemically synthesized
ggttactgagccagatcctgtc

SEQ ID NO: 59924 - DNA, 22 bp, Artificial Sequence
  chemically synthesized
ctgagccagatcctgtctcaaa

SEQ ID NO: 59925 - DNA, 22 bp, Artificial Sequence
  chemically synthesized
agccagatcctgtctcaaaaaa

SEQ ID NO: 59926 - DNA, 22 bp, Artificial Sequence
  chemically synthesized
tctcaaaaaaaaaaaagataat

SEQ ID NO: 59927 - DNA, 22 bp, Artificial Sequence
  chemically synthesized
aaaaaaaaaaaagataatacat

SEQ ID NO: 59928 - DNA, 22 bp, Artificial Sequence
  chemically synthesized
aaacagttcaaaatgcaaaagt

SEQ ID NO: 59929 - DNA, 22 bp, Artificial Sequence
  chemically synthesized
aaaatgcaaaagttacatacat

SEQ ID NO: 59930 - DNA, 22 bp, Artificial Sequence
  chemically synthesized
catacataaggaagtgtcatga

SEQ ID NO: 59931 - DNA, 22 bp, Artificial Sequence
  chemically synthesized
cctctcacacttctccccagcc

SEQ ID NO: 59932 - DNA, 22 bp, Artificial Sequence
  chemically synthesized
tcacacttctccccagccaccc

SEQ ID NO: 59933 - DNA, 22 bp, Artificial Sequence
  chemically synthesized
acacttctccccagccacccag

SEQ ID NO: 59934 - DNA, 22 bp, Artificial Sequence
  chemically synthesized
ctccccagccacccagttctcc

SEQ ID NO: 59935 - DNA, 22 bp, Artificial Sequence
  chemically synthesized
tccccagccacccagttctccc

SEQ ID NO: 59936 - DNA, 22 bp, Artificial Sequence
  chemically synthesized
cccagccacccagttctccctt

SEQ ID NO: 59937 - DNA, 22 bp, Artificial Sequence
  chemically synthesized
tcccttctagaggcaacatgtg

SEQ ID NO: 59938 - DNA, 22 bp, Artificial Sequence
  chemically synthesized
ccttctagaggcaacatgtgaa

SEQ ID NO: 59939 - DNA, 22 bp, Artificial Sequence
  chemically synthesized
ctagaggcaacatgtgaaatcc

SEQ ID NO: 59940 - DNA, 22 bp, Artificial Sequence
  chemically synthesized
tagaggcaacatgtgaaatcct

SEQ ID NO: 59941 - DNA, 22 bp, Artificial Sequence
  chemically synthesized
gaggcaacatgtgaaatccttc

SEQ ID NO: 59942 - DNA, 22 bp, Artificial Sequence
  chemically synthesized
ctcaggctacactcttcttgaa

SEQ ID NO: 59943 - DNA, 22 bp, Artificial Sequence
  chemically synthesized
tcaggctacactcttcttgaag

SEQ ID NO: 59944 - DNA, 22 bp, Artificial Sequence
  chemically synthesized
aggctacactcttcttgaaggt

SEQ ID NO: 59945 - DNA, 22 bp, Artificial Sequence
  chemically synthesized
cactcttcttgaaggtgtaggc

SEQ ID NO: 59946 - DNA, 22 bp, Artificial Sequence
  chemically synthesized
ttcttgaaggtgtaggctttgg

SEQ ID NO: 59947 - DNA, 22 bp, Artificial Sequence
  chemically synthesized
cttgaaggtgtaggctttgggc

SEQ ID NO: 59948 - DNA, 22 bp, Artificial Sequence
  chemically synthesized
ttgaaggtgtaggctttgggca

SEQ ID NO: 59949 - DNA, 22 bp, Artificial Sequence
  chemically synthesized
gaaggtgtaggctttgggcaaa

SEQ ID NO: 59950 - DNA, 22 bp, Artificial Sequence
  chemically synthesized
aaggtgtaggctttgggcaaaa

SEQ ID NO: 59951 - DNA, 22 bp, Artificial Sequence
  chemically synthesized
tgggcaaaagcattcattcagt

SEQ ID NO: 59952 - DNA, 22 bp, Artificial Sequence
  chemically synthesized
gggcaaaagcattcattcagta

SEQ ID NO: 59953 - DNA, 22 bp, Artificial Sequence
  chemically synthesized
ggcaaaagcattcattcagtaa

SEQ ID NO: 59954 - DNA, 22 bp, Artificial Sequence
  chemically synthesized
attcagtaaccccagaaacttg

SEQ ID NO: 59955 - DNA, 22 bp, Artificial Sequence
  chemically synthesized
agtaaccccagaaacttgttct

SEQ ID NO: 59956 - DNA, 22 bp, Artificial Sequence
  chemically synthesized
gttctgtttttccataggattc

SEQ ID NO: 59957 - DNA, 22 bp, Artificial Sequence
  chemically synthesized
ttctgtttttccataggattct

SEQ ID NO: 59958 - DNA, 22 bp, Artificial Sequence
  chemically synthesized
tgtttttccataggattctctt

SEQ ID NO: 59959 - DNA, 22 bp, Artificial Sequence
  chemically synthesized
tttttccataggattctctttg

SEQ ID NO: 59960 - DNA, 22 bp, Artificial Sequence
  chemically synthesized
ttccataggattctctttggac

SEQ ID NO: 59961 - DNA, 22 bp, Artificial Sequence
  chemically synthesized
tccataggattctctttggaca

SEQ ID NO: 59962 - DNA, 22 bp, Artificial Sequence
  chemically synthesized
ccataggattctctttggacag

SEQ ID NO: 59963 - DNA, 22 bp, Artificial Sequence
  chemically synthesized
cataggattctctttggacagc

SEQ ID NO: 59964 - DNA, 22 bp, Artificial Sequence
  chemically synthesized
tctttggacagcgtccatactg

SEQ ID NO: 59965 - DNA, 22 bp, Artificial Sequence
  chemically synthesized
tttggacagcgtccatactggt

SEQ ID NO: 59966 - DNA, 22 bp, Artificial Sequence
  chemically synthesized
tggacagcgtccatactggtgg

SEQ ID NO: 59967 - DNA, 22 bp, Artificial Sequence
  chemically synthesized
ggacagcgtccatactggtggg

SEQ ID NO: 59968 - DNA, 22 bp, Artificial Sequence
  chemically synthesized
gacagcgtccatactggtgggt

SEQ ID NO: 59969 - DNA, 22 bp, Artificial Sequence
  chemically synthesized
gtgggttttggatactgactac

SEQ ID NO: 59970 - DNA, 22 bp, Artificial Sequence
  chemically synthesized
tggatactgactactacagcaa

SEQ ID NO: 59971 - DNA, 22 bp, Artificial Sequence
  chemically synthesized
ggatactgactactacagcaac

SEQ ID NO: 59972 - DNA, 22 bp, Artificial Sequence
  chemically synthesized
gatactgactactacagcaaca

SEQ ID NO: 59973 - DNA, 22 bp, Artificial Sequence
  chemically synthesized
actactacagcaacacttccgt

SEQ ID NO: 59974 - DNA, 22 bp, Artificial Sequence
  chemically synthesized
ctacagcaacacttccgtgccc

SEQ ID NO: 59975 - DNA, 22 bp, Artificial Sequence
  chemically synthesized
cagcaacacttccgtgcccctg

SEQ ID NO: 59976 - DNA, 22 bp, Artificial Sequence
  chemically synthesized
ccgtgcccctgataaagcagtt

SEQ ID NO: 59977 - DNA, 22 bp, Artificial Sequence
  chemically synthesized
cgtgcccctgataaagcagttc

SEQ ID NO: 59978 - DNA, 22 bp, Artificial Sequence
  chemically synthesized
ataaagcagttccctgtaacct

SEQ ID NO: 59979 - DNA, 22 bp, Artificial Sequence
  chemically synthesized
cctgtaacctgtgagactggac

SEQ ID NO: 59980 - DNA, 22 bp, Artificial Sequence
  chemically synthesized
taacctgtgagactggaccagg

SEQ ID NO: 59981 - DNA, 22 bp, Artificial Sequence
  chemically synthesized
tgagactggaccaggtaagcgt

SEQ ID NO: 59982 - DNA, 22 bp, Artificial Sequence
  chemically synthesized
gaccaggtaagcgtcccagccc

SEQ ID NO: 59983 - DNA, 22 bp, Artificial Sequence
  chemically synthesized
cagacagaagctgagtggacct

SEQ ID NO: 59984 - DNA, 22 bp, Artificial Sequence
  chemically synthesized
agtggacctcgtttacctgtta

SEQ ID NO: 59985 - DNA, 22 bp, Artificial Sequence
  chemically synthesized
gtttacctgttatggatgaaac

SEQ ID NO: 59986 - DNA, 22 bp, Artificial Sequence
  chemically synthesized
acctgttatggatgaaactgac

SEQ ID NO: 59987 - DNA, 22 bp, Artificial Sequence
  chemically synthesized
cctgttatggatgaaactgacc

SEQ ID NO: 59988 - DNA, 22 bp, Artificial Sequence
  chemically synthesized
ttatggatgaaactgaccttga

SEQ ID NO: 59989 - DNA, 22 bp, Artificial Sequence
  chemically synthesized
tggatgaaactgaccttgaggg

SEQ ID NO: 59990 - DNA, 22 bp, Artificial Sequence
  chemically synthesized
accttgaggggacatgaggaga

SEQ ID NO: 59991 - DNA, 22 bp, Artificial Sequence
  chemically synthesized
gaggggacatgaggagagccat

SEQ ID NO: 59992 - DNA, 22 bp, Artificial Sequence
  chemically synthesized
aggggacatgaggagagccatt

SEQ ID NO: 59993 - DNA, 22 bp, Artificial Sequence
  chemically synthesized
ctttgtacttttgtcatgctct

SEQ ID NO: 59994 - DNA, 22 bp, Artificial Sequence
  chemically synthesized
tgtacttttgtcatgctcttca

SEQ ID NO: 59995 - DNA, 22 bp, Artificial Sequence
  chemically synthesized
gtacttttgtcatgctcttcaa

SEQ ID NO: 59996 - DNA, 22 bp, Artificial Sequence
  chemically synthesized
tacttttgtcatgctcttcaat

SEQ ID NO: 59997 - DNA, 22 bp, Artificial Sequence
  chemically synthesized
ttgtcatgctcttcaattggca

SEQ ID NO: 59998 - DNA, 22 bp, Artificial Sequence
  chemically synthesized
tgtcatgctcttcaattggcac

SEQ ID NO: 59999 - DNA, 22 bp, Artificial Sequence
  chemically synthesized
gtcatgctcttcaattggcaca

SEQ ID NO: 60000 - DNA, 22 bp, Artificial Sequence
  chemically synthesized
tcatgctcttcaattggcacaa

SEQ ID NO: 60001 - DNA, 22 bp, Artificial Sequence
  chemically synthesized
ttcaattggcacaaattaattc

SEQ ID NO: 60002 - DNA, 22 bp, Artificial Sequence
  chemically synthesized
caattggcacaaattaattcac

SEQ ID NO: 60003 - DNA, 22 bp, Artificial Sequence
  chemically synthesized
aattggcacaaattaattcact

SEQ ID NO: 60004 - DNA, 22 bp, Artificial Sequence
  chemically synthesized
gcacaaattaattcacttctgc

SEQ ID NO: 60005 - DNA, 22 bp, Artificial Sequence
  chemically synthesized
attcacttctgcaatactttcc

SEQ ID NO: 60006 - DNA, 22 bp, Artificial Sequence
  chemically synthesized
acttctgcaatactttcctgaa

SEQ ID NO: 60007 - DNA, 22 bp, Artificial Sequence
  chemically synthesized
ctgcaatactttcctgaatagc

SEQ ID NO: 60008 - DNA, 22 bp, Artificial Sequence
  chemically synthesized
tgcaatactttcctgaatagca

SEQ ID NO: 60009 - DNA, 22 bp, Artificial Sequence
  chemically synthesized
caatactttcctgaatagcaca

SEQ ID NO: 60010 - DNA, 22 bp, Artificial Sequence
  chemically synthesized
tcctgaatagcacagtagtatt

SEQ ID NO: 60011 - DNA, 22 bp, Artificial Sequence
  chemically synthesized
cctgaatagcacagtagtattg

SEQ ID NO: 60012 - DNA, 22 bp, Artificial Sequence
  chemically synthesized
ctgaatagcacagtagtattgg

SEQ ID NO: 60013 - DNA, 22 bp, Artificial Sequence
  chemically synthesized
aatagcacagtagtattggaaa

SEQ ID NO: 60014 - DNA, 22 bp, Artificial Sequence
  chemically synthesized
gaaatctgcctattacagaacc

SEQ ID NO: 60015 - DNA, 22 bp, Artificial Sequence
  chemically synthesized
cctattacagaacctggatgga

SEQ ID NO: 60016 - DNA, 22 bp, Artificial Sequence
  chemically synthesized
ttacagaacctggatggagtcc

SEQ ID NO: 60017 - DNA, 22 bp, Artificial Sequence
  chemically synthesized
cagaacctggatggagtccaga

SEQ ID NO: 60018 - DNA, 22 bp, Artificial Sequence
  chemically synthesized
gatggagtccagagaggcacgg

SEQ ID NO: 60019 - DNA, 22 bp, Artificial Sequence
  chemically synthesized
gtgagagtcaccgccctgcagc

SEQ ID NO: 60020 - DNA, 22 bp, Artificial Sequence
  chemically synthesized
cagcgctgtgtcctgagaaagg

SEQ ID NO: 60021 - DNA, 22 bp, Artificial Sequence
  chemically synthesized
tgtcctgagaaaggagggggca

SEQ ID NO: 60022 - DNA, 22 bp, Artificial Sequence
  chemically synthesized
agaaaggagggggcagaagcct

SEQ ID NO: 60023 - DNA, 22 bp, Artificial Sequence
  chemically synthesized
agcttctgggggtccttcccaa

SEQ ID NO: 60024 - DNA, 22 bp, Artificial Sequence
  chemically synthesized
ctgggggtccttcccaatggcc

SEQ ID NO: 60025 - DNA, 22 bp, Artificial Sequence
  chemically synthesized
tgggggtccttcccaatggcct

SEQ ID NO: 60026 - DNA, 22 bp, Artificial Sequence
  chemically synthesized
ggggtccttcccaatggcctgg

SEQ ID NO: 60027 - DNA, 22 bp, Artificial Sequence
  chemically synthesized
cccaatggcctggcccactgga

SEQ ID NO: 60028 - DNA, 22 bp, Artificial Sequence
  chemically synthesized
ccaatggcctggcccactggat

SEQ ID NO: 60029 - DNA, 22 bp, Artificial Sequence
  chemically synthesized
gcccactggatgtgccctcctg

SEQ ID NO: 60030 - DNA, 22 bp, Artificial Sequence
  chemically synthesized
gatgtgccctcctgagctgacc

SEQ ID NO: 60031 - DNA, 22 bp, Artificial Sequence
  chemically synthesized
ctgagctgaccgtccaatccct

SEQ ID NO: 60032 - DNA, 22 bp, Artificial Sequence
  chemically synthesized
agctgaccgtccaatcccttgc

SEQ ID NO: 60033 - DNA, 22 bp, Artificial Sequence
  chemically synthesized
accgtccaatcccttgccctct

SEQ ID NO: 60034 - DNA, 22 bp, Artificial Sequence
  chemically synthesized
gccctctctgtgcctacgtttt

SEQ ID NO: 60035 - DNA, 22 bp, Artificial Sequence
  chemically synthesized
ccctctctgtgcctacgtttta

SEQ ID NO: 60036 - DNA, 22 bp, Artificial Sequence
  chemically synthesized
tctgtgcctacgttttattagt

SEQ ID NO: 60037 - DNA, 22 bp, Artificial Sequence
  chemically synthesized
tgtgcctacgttttattagtta

SEQ ID NO: 60038 - DNA, 22 bp, Artificial Sequence
  chemically synthesized
tgcctacgttttattagttaca

SEQ ID NO: 60039 - DNA, 22 bp, Artificial Sequence
  chemically synthesized
cgttttattagttacagccaga

SEQ ID NO: 60040 - DNA, 22 bp, Artificial Sequence
  chemically synthesized
tattagttacagccagatggtt

SEQ ID NO: 60041 - DNA, 22 bp, Artificial Sequence
  chemically synthesized
attagttacagccagatggtta

SEQ ID NO: 60042 - DNA, 22 bp, Artificial Sequence
  chemically synthesized
ttagttacagccagatggttac

SEQ ID NO: 60043 - DNA, 22 bp, Artificial Sequence
  chemically synthesized
gttacagccagatggttactgt

SEQ ID NO: 60044 - DNA, 22 bp, Artificial Sequence
  chemically synthesized
cagccagatggttactgtcaaa

SEQ ID NO: 60045 - DNA, 22 bp, Artificial Sequence
  chemically synthesized
ctgtcaaatcaaatgatagatt

SEQ ID NO: 60046 - DNA, 22 bp, Artificial Sequence
  chemically synthesized
tcaaatcaaatgatagatttca

SEQ ID NO: 60047 - DNA, 22 bp, Artificial Sequence
  chemically synthesized
cattttcagtatgtaataggaa

SEQ ID NO: 60048 - DNA, 22 bp, Artificial Sequence
  chemically synthesized
attttcagtatgtaataggaag

SEQ ID NO: 60049 - DNA, 22 bp, Artificial Sequence
  chemically synthesized
tcagtatgtaataggaagcccc

SEQ ID NO: 60050 - DNA, 22 bp, Artificial Sequence
  chemically synthesized
cagtatgtaataggaagcccct

SEQ ID NO: 60051 - DNA, 22 bp, Artificial Sequence
  chemically synthesized
agtatgtaataggaagcccctc

SEQ ID NO: 60052 - DNA, 22 bp, Artificial Sequence
  chemically synthesized
cctcaccctaaagtctcagctg

SEQ ID NO: 60053 - DNA, 22 bp, Artificial Sequence
  chemically synthesized
accctaaagtctcagctgccct

SEQ ID NO: 60054 - DNA, 22 bp, Artificial Sequence
  chemically synthesized
aagtctcagctgccctctaaga

SEQ ID NO: 60055 - DNA, 22 bp, Artificial Sequence
  chemically synthesized
agctgccctctaagactagtac

SEQ ID NO: 60056 - DNA, 22 bp, Artificial Sequence
  chemically synthesized
ccctctaagactagtactctct

SEQ ID NO: 60057 - DNA, 22 bp, Artificial Sequence
  chemically synthesized
taagactagtactctctaaggt

SEQ ID NO: 60058 - DNA, 22 bp, Artificial Sequence
  chemically synthesized
agactagtactctctaaggtac

SEQ ID NO: 60059 - DNA, 22 bp, Artificial Sequence
  chemically synthesized
gtactctctaaggtactagtat

SEQ ID NO: 60060 - DNA, 22 bp, Artificial Sequence
  chemically synthesized
tctaaggtactagtatcccttc

SEQ ID NO: 60061 - DNA, 22 bp, Artificial Sequence
  chemically synthesized
taaggtactagtatcccttcct

SEQ ID NO: 60062 - DNA, 22 bp, Artificial Sequence
  chemically synthesized
aggtactagtatcccttcctca

SEQ ID NO: 60063 - DNA, 22 bp, Artificial Sequence
  chemically synthesized
gtatcccttcctcagagaccct

SEQ ID NO: 60064 - DNA, 22 bp, Artificial Sequence
  chemically synthesized
cctcagagaccctttccctgac

SEQ ID NO: 60065 - DNA, 22 bp, Artificial Sequence
  chemically synthesized
ctcagagaccctttccctgacc

SEQ ID NO: 60066 - DNA, 22 bp, Artificial Sequence
  chemically synthesized
agagaccctttccctgacccca

SEQ ID NO: 60067 - DNA, 22 bp, Artificial Sequence
  chemically synthesized
tccctgaccccaaaactaggga

SEQ ID NO: 60068 - DNA, 22 bp, Artificial Sequence
  chemically synthesized
ccctgaccccaaaactagggaa

SEQ ID NO: 60069 - DNA, 22 bp, Artificial Sequence
  chemically synthesized
cctgaccccaaaactagggaag

SEQ ID NO: 60070 - DNA, 22 bp, Artificial Sequence
  chemically synthesized
accccaaaactagggaaggtcc

SEQ ID NO: 60071 - DNA, 22 bp, Artificial Sequence
  chemically synthesized
gggaaggtcccttagttatttg

SEQ ID NO: 60072 - DNA, 22 bp, Artificial Sequence
  chemically synthesized
agttatttgctctcacagacca

SEQ ID NO: 60073 - DNA, 22 bp, Artificial Sequence
  chemically synthesized
gttatttgctctcacagaccac

SEQ ID NO: 60074 - DNA, 22 bp, Artificial Sequence
  chemically synthesized
tttgctctcacagaccacgcat

SEQ ID NO: 60075 - DNA, 22 bp, Artificial Sequence
  chemically synthesized
gctctcacagaccacgcattta

SEQ ID NO: 60076 - DNA, 22 bp, Artificial Sequence
  chemically synthesized
ctctcacagaccacgcatttac

SEQ ID NO: 60077 - DNA, 22 bp, Artificial Sequence
  chemically synthesized
tcacagaccacgcatttacctc

SEQ ID NO: 60078 - DNA, 22 bp, Artificial Sequence
  chemically synthesized
acagaccacgcatttacctcag

SEQ ID NO: 60079 - DNA, 22 bp, Artificial Sequence
  chemically synthesized
acctcagagcatattcactcat

SEQ ID NO: 60080 - DNA, 22 bp, Artificial Sequence
  chemically synthesized
cctcagagcatattcactcatt

SEQ ID NO: 60081 - DNA, 22 bp, Artificial Sequence
  chemically synthesized
agagcatattcactcattcagc

SEQ ID NO: 60082 - DNA, 22 bp, Artificial Sequence
  chemically synthesized
actcattcagctgttacttacc

SEQ ID NO: 60083 - DNA, 22 bp, Artificial Sequence
  chemically synthesized
attcagctgttacttaccaagc

SEQ ID NO: 60084 - DNA, 22 bp, Artificial Sequence
  chemically synthesized
agctgttacttaccaagcacct

SEQ ID NO: 60085 - DNA, 22 bp, Artificial Sequence
  chemically synthesized
ttacttaccaagcacctactgg

SEQ ID NO: 60086 - DNA, 22 bp, Artificial Sequence
  chemically synthesized
cttaccaagcacctactgggag

SEQ ID NO: 60087 - DNA, 22 bp, Artificial Sequence
  chemically synthesized
accaagcacctactgggagcta

SEQ ID NO: 60088 - DNA, 22 bp, Artificial Sequence
  chemically synthesized
ccaagcacctactgggagctat

SEQ ID NO: 60089 - DNA, 22 bp, Artificial Sequence
  chemically synthesized
ctgggagctatacactgttcta

SEQ ID NO: 60090 - DNA, 22 bp, Artificial Sequence
  chemically synthesized
ggagctatacactgttctatgt

SEQ ID NO: 60091 - DNA, 22 bp, Artificial Sequence
  chemically synthesized
tacactgttctatgtgctaggg

SEQ ID NO: 60092 - DNA, 22 bp, Artificial Sequence
  chemically synthesized
ttctatgtgctagggatacctc

SEQ ID NO: 60093 - DNA, 22 bp, Artificial Sequence
  chemically synthesized
tatgtgctagggatacctctgt

SEQ ID NO: 60094 - DNA, 22 bp, Artificial Sequence
  chemically synthesized
tgtgctagggatacctctgtca

SEQ ID NO: 60095 - DNA, 22 bp, Artificial Sequence
  chemically synthesized
gggatacctctgtcagtgaaca

SEQ ID NO: 60096 - DNA, 22 bp, Artificial Sequence
  chemically synthesized
tgtcagtgaacaacacagacac

SEQ ID NO: 60097 - DNA, 22 bp, Artificial Sequence
  chemically synthesized
tcagtgaacaacacagacacaa

SEQ ID NO: 60098 - DNA, 22 bp, Artificial Sequence
  chemically synthesized
cccttgtggagctgaaatctga

SEQ ID NO: 60099 - DNA, 22 bp, Artificial Sequence
  chemically synthesized
gtggagctgaaatctgaataga

SEQ ID NO: 60100 - DNA, 22 bp, Artificial Sequence
  chemically synthesized
tggagctgaaatctgaatagag

SEQ ID NO: 60101 - DNA, 22 bp, Artificial Sequence
  chemically synthesized
aaatctgaatagaggaggtgaa

SEQ ID NO: 60102 - DNA, 22 bp, Artificial Sequence
  chemically synthesized
aatagaggaggtgaaatataca

SEQ ID NO: 60103 - DNA, 22 bp, Artificial Sequence
  chemically synthesized
taataaataagtaaactaggcc

SEQ ID NO: 60104 - DNA, 22 bp, Artificial Sequence
  chemically synthesized
ggccagttgtggttgctcatgc

SEQ ID NO: 60105 - DNA, 22 bp, Artificial Sequence
  chemically synthesized
tggttgctcatgcctgtaatcc

SEQ ID NO: 60106 - DNA, 22 bp, Artificial Sequence
  chemically synthesized
ctcatgcctgtaatcccagcac

SEQ ID NO: 60107 - DNA, 22 bp, Artificial Sequence
  chemically synthesized
atgcctgtaatcccagcacttt

SEQ ID NO: 60108 - DNA, 22 bp, Artificial Sequence
  chemically synthesized
taatcccagcactttgggaagc

SEQ ID NO: 60109 - DNA, 22 bp, Artificial Sequence
  chemically synthesized
tgggaagccaaggtaggtagat

SEQ ID NO: 60110 - DNA, 22 bp, Artificial Sequence
  chemically synthesized
gggaagccaaggtaggtagatc

SEQ ID NO: 60111 - DNA, 22 bp, Artificial Sequence
  chemically synthesized
ggaagccaaggtaggtagatca

SEQ ID NO: 60112 - DNA, 22 bp, Artificial Sequence
  chemically synthesized
aggtcaggagttcaaaaccagc

SEQ ID NO: 60113 - DNA, 22 bp, Artificial Sequence
  chemically synthesized
aaaaccagcctggccaacattg

SEQ ID NO: 60114 - DNA, 22 bp, Artificial Sequence
  chemically synthesized
gccaacattgcaaaatcctgtc

SEQ ID NO: 60115 - DNA, 22 bp, Artificial Sequence
  chemically synthesized
caaaatcctgtctttactaaaa

SEQ ID NO: 60116 - DNA, 22 bp, Artificial Sequence
  chemically synthesized
tctttactaaaaatggaaaaat

SEQ ID NO: 60117 - DNA, 22 bp, Artificial Sequence
  chemically synthesized
tactaaaaatggaaaaattggt

SEQ ID NO: 60118 - DNA, 22 bp, Artificial Sequence
  chemically synthesized
actaaaaatggaaaaattggtc

SEQ ID NO: 60119 - DNA, 22 bp, Artificial Sequence
  chemically synthesized
ctaaaaatggaaaaattggtca

SEQ ID NO: 60120 - DNA, 22 bp, Artificial Sequence
  chemically synthesized
aaaatggaaaaattggtcaggc

SEQ ID NO: 60121 - DNA, 22 bp, Artificial Sequence
  chemically synthesized
gtcaggcgtgatggcacacgcc

SEQ ID NO: 60122 - DNA, 22 bp, Artificial Sequence
  chemically synthesized
tagtctcagctacctgggaggc

SEQ ID NO: 60123 - DNA, 22 bp, Artificial Sequence
  chemically synthesized
agctacctgggaggctgaggca

SEQ ID NO: 60124 - DNA, 22 bp, Artificial Sequence
  chemically synthesized
cctgggaggctgaggcaggaga

SEQ ID NO: 60125 - DNA, 22 bp, Artificial Sequence
  chemically synthesized
ggaggctgaggcaggagaatcg

SEQ ID NO: 60126 - DNA, 22 bp, Artificial Sequence
  chemically synthesized
aggcaggagaatcgcttgaacc

SEQ ID NO: 60127 - DNA, 22 bp, Artificial Sequence
  chemically synthesized
gaacctgggaggcagaggttgc

SEQ ID NO: 60128 - DNA, 22 bp, Artificial Sequence
  chemically synthesized
aacctgggaggcagaggttgca

SEQ ID NO: 60129 - DNA, 22 bp, Artificial Sequence
  chemically synthesized
ggaggcagaggttgcagtgaac

SEQ ID NO: 60130 - DNA, 22 bp, Artificial Sequence
  chemically synthesized
cagtgaaccgagatcggaccac

SEQ ID NO: 60131 - DNA, 22 bp, Artificial Sequence
  chemically synthesized
cactccagcctgaatgacagaa

SEQ ID NO: 60132 - DNA, 22 bp, Artificial Sequence
  chemically synthesized
cagcctgaatgacagaacgaga

SEQ ID NO: 60133 - DNA, 22 bp, Artificial Sequence
  chemically synthesized
aatgacagaacgagactctgtc

SEQ ID NO: 60134 - DNA, 22 bp, Artificial Sequence
  chemically synthesized
tgtctcaaaaaaaaagtaaact

SEQ ID NO: 60135 - DNA, 22 bp, Artificial Sequence
  chemically synthesized
tctcaaaaaaaaagtaaactat

SEQ ID NO: 60136 - DNA, 22 bp, Artificial Sequence
  chemically synthesized
aaaaaaaaagtaaactattaat

SEQ ID NO: 60137 - DNA, 22 bp, Artificial Sequence
  chemically synthesized
ttaatatgtaggataggccagg

SEQ ID NO: 60138 - DNA, 22 bp, Artificial Sequence
  chemically synthesized
atatgtaggataggccaggcac

SEQ ID NO: 60139 - DNA, 22 bp, Artificial Sequence
  chemically synthesized
accctgtaatcccagcactttg

SEQ ID NO: 60140 - DNA, 22 bp, Artificial Sequence
  chemically synthesized
taatcccagcactttgggaggc

SEQ ID NO: 60141 - DNA, 22 bp, Artificial Sequence
  chemically synthesized
tgggaggctgaggcgggtggat

SEQ ID NO: 60142 - DNA, 22 bp, Artificial Sequence
  chemically synthesized
gggaggctgaggcgggtggatc

SEQ ID NO: 60143 - DNA, 22 bp, Artificial Sequence
  chemically synthesized
ggaggctgaggcgggtggatca

SEQ ID NO: 60144 - DNA, 22 bp, Artificial Sequence
  chemically synthesized
aggcgggtggatcacctgaggt

SEQ ID NO: 60145 - DNA, 22 bp, Artificial Sequence
  chemically synthesized
aggtgaggagttcaagaccagc

SEQ ID NO: 60146 - DNA, 22 bp, Artificial Sequence
  chemically synthesized
aagaccagcctggccaacatgg

SEQ ID NO: 60147 - DNA, 22 bp, Artificial Sequence
  chemically synthesized
gccaacatggcaaaaccctgtc

SEQ ID NO: 60148 - DNA, 22 bp, Artificial Sequence
  chemically synthesized
tctctactaaaaatacaaaaat

SEQ ID NO: 60149 - DNA, 22 bp, Artificial Sequence
  chemically synthesized
tactaaaaatacaaaaattagc

SEQ ID NO: 60150 - DNA, 22 bp, Artificial Sequence
  chemically synthesized
ctaaaaatacaaaaattagctg

SEQ ID NO: 60151 - DNA, 22 bp, Artificial Sequence
  chemically synthesized
aaaatacaaaaattagctgggt

SEQ ID NO: 60152 - DNA, 22 bp, Artificial Sequence
  chemically synthesized
gctgggtgtcctggtgcatgcc

SEQ ID NO: 60153 - DNA, 22 bp, Artificial Sequence
  chemically synthesized
ggtgtcctggtgcatgcctgta

SEQ ID NO: 60154 - DNA, 22 bp, Artificial Sequence
  chemically synthesized
gtgcatgcctgtaatctgagct

SEQ ID NO: 60155 - DNA, 22 bp, Artificial Sequence
  chemically synthesized
taatctgagctactcaggaggc

SEQ ID NO: 60156 - DNA, 22 bp, Artificial Sequence
  chemically synthesized
agctactcaggaggctaaggca

SEQ ID NO: 60157 - DNA, 22 bp, Artificial Sequence
  chemically synthesized
ctcaggaggctaaggcaggaga

SEQ ID NO: 60158 - DNA, 22 bp, Artificial Sequence
  chemically synthesized
aggaggctaaggcaggagaatc

SEQ ID NO: 60159 - DNA, 22 bp, Artificial Sequence
  chemically synthesized
aggcaggagaatcgcttgaacc

SEQ ID NO: 60160 - DNA, 22 bp, Artificial Sequence
  chemically synthesized
gaacctgggaggtggtgagcca

SEQ ID NO: 60161 - DNA, 22 bp, Artificial Sequence
  chemically synthesized
aacctgggaggtggtgagccaa

SEQ ID NO: 60162 - DNA, 22 bp, Artificial Sequence
  chemically synthesized
ggaggtggtgagccaagattgc

SEQ ID NO: 60163 - DNA, 22 bp, Artificial Sequence
  chemically synthesized
cgccattgcactccagcctggg

SEQ ID NO: 60164 - DNA, 22 bp, Artificial Sequence
  chemically synthesized
cactccagcctgggcgacaaaa

SEQ ID NO: 60165 - DNA, 22 bp, Artificial Sequence
  chemically synthesized
cagcctgggcgacaaaatgaga

SEQ ID NO: 60166 - DNA, 22 bp, Artificial Sequence
  chemically synthesized
ggcgacaaaatgagacaccatc

SEQ ID NO: 60167 - DNA, 22 bp, Artificial Sequence
  chemically synthesized
aaaaaaaaaaaaaaatatatat

SEQ ID NO: 60168 - DNA, 22 bp, Artificial Sequence
  chemically synthesized
gaaaatgattgtttataggcaa

SEQ ID NO: 60169 - DNA, 22 bp, Artificial Sequence
  chemically synthesized
tttataggcaaaaaaaaaaaaa

SEQ ID NO: 60170 - DNA, 22 bp, Artificial Sequence
  chemically synthesized
ataggcaaaaaaaaaaaaaaag

SEQ ID NO: 60171 - DNA, 22 bp, Artificial Sequence
  chemically synthesized
taggcaaaaaaaaaaaaaaaga

SEQ ID NO: 60172 - DNA, 22 bp, Artificial Sequence
  chemically synthesized
ttgtagaaatatgtttgctttc

SEQ ID NO: 60173 - DNA, 22 bp, Artificial Sequence
  chemically synthesized
tgtagaaatatgtttgctttca

SEQ ID NO: 60174 - DNA, 22 bp, Artificial Sequence
  chemically synthesized
gtagaaatatgtttgctttcat

SEQ ID NO: 60175 - DNA, 22 bp, Artificial Sequence
  chemically synthesized
tagaaatatgtttgctttcatc

SEQ ID NO: 60176 - DNA, 22 bp, Artificial Sequence
  chemically synthesized
gctttcatcataacagcttgtt

SEQ ID NO: 60177 - DNA, 22 bp, Artificial Sequence
  chemically synthesized
ctttcatcataacagcttgtta

SEQ ID NO: 60178 - DNA, 22 bp, Artificial Sequence
  chemically synthesized
tcatcataacagcttgttatca

SEQ ID NO: 60179 - DNA, 22 bp, Artificial Sequence
  chemically synthesized
catcataacagcttgttatcaa

SEQ ID NO: 60180 - DNA, 22 bp, Artificial Sequence
  chemically synthesized
atcataacagcttgttatcaag

SEQ ID NO: 60181 - DNA, 22 bp, Artificial Sequence
  chemically synthesized
gttatcaaggatgaatttctcc

SEQ ID NO: 60182 - DNA, 22 bp, Artificial Sequence
  chemically synthesized
ttatcaaggatgaatttctccc

SEQ ID NO: 60183 - DNA, 22 bp, Artificial Sequence
  chemically synthesized
tcaaggatgaatttctccctga

SEQ ID NO: 60184 - DNA, 22 bp, Artificial Sequence
  chemically synthesized
ctccctgaaattaatggaggca

SEQ ID NO: 60185 - DNA, 22 bp, Artificial Sequence
  chemically synthesized
tccctgaaattaatggaggcac

SEQ ID NO: 60186 - DNA, 22 bp, Artificial Sequence
  chemically synthesized
cctgaaattaatggaggcacag

SEQ ID NO: 60187 - DNA, 22 bp, Artificial Sequence
  chemically synthesized
aaattaatggaggcacagactg

SEQ ID NO: 60188 - DNA, 22 bp, Artificial Sequence
  chemically synthesized
atggaggcacagactggaaagt

SEQ ID NO: 60189 - DNA, 22 bp, Artificial Sequence
  chemically synthesized
gaaagtttaaagtggctttaag

SEQ ID NO: 60190 - DNA, 22 bp, Artificial Sequence
  chemically synthesized
aaagtggctttaagaggttatt

SEQ ID NO: 60191 - DNA, 22 bp, Artificial Sequence
  chemically synthesized
aagtggctttaagaggttattt

SEQ ID NO: 60192 - DNA, 22 bp, Artificial Sequence
  chemically synthesized
taagaggttattttatttagtc

SEQ ID NO: 60193 - DNA, 22 bp, Artificial Sequence
  chemically synthesized
aagaggttattttatttagtcc

SEQ ID NO: 60194 - DNA, 22 bp, Artificial Sequence
  chemically synthesized
agaggttattttatttagtcct

SEQ ID NO: 60195 - DNA, 22 bp, Artificial Sequence
  chemically synthesized
ttttatttagtcctctgtctta

SEQ ID NO: 60196 - DNA, 22 bp, Artificial Sequence
  chemically synthesized
tatttagtcctctgtcttaata

SEQ ID NO: 60197 - DNA, 22 bp, Artificial Sequence
  chemically synthesized
atttagtcctctgtcttaatag

SEQ ID NO: 60198 - DNA, 22 bp, Artificial Sequence
  chemically synthesized
tttagtcctctgtcttaataga

SEQ ID NO: 60199 - DNA, 22 bp, Artificial Sequence
  chemically synthesized
agtcctctgtcttaatagaagc

SEQ ID NO: 60200 - DNA, 22 bp, Artificial Sequence
  chemically synthesized
gtcctctgtcttaatagaagca

SEQ ID NO: 60201 - DNA, 22 bp, Artificial Sequence
  chemically synthesized
tgtcttaatagaagcaaattat

SEQ ID NO: 60202 - DNA, 22 bp, Artificial Sequence
  chemically synthesized
tcttaatagaagcaaattatta

SEQ ID NO: 60203 - DNA, 22 bp, Artificial Sequence
  chemically synthesized
aatagaagcaaattattatctc

SEQ ID NO: 60204 - DNA, 22 bp, Artificial Sequence
  chemically synthesized
atagaagcaaattattatctct

SEQ ID NO: 60205 - DNA, 22 bp, Artificial Sequence
  chemically synthesized
ttatctctgctccttaggtaga

SEQ ID NO: 60206 - DNA, 22 bp, Artificial Sequence
  chemically synthesized
tctctgctccttaggtagagta

SEQ ID NO: 60207 - DNA, 22 bp, Artificial Sequence
  chemically synthesized
tgctccttaggtagagtagcta

SEQ ID NO: 60208 - DNA, 22 bp, Artificial Sequence
  chemically synthesized
ctccttaggtagagtagctaag

SEQ ID NO: 60209 - DNA, 22 bp, Artificial Sequence
  chemically synthesized
cttaggtagagtagctaaggct

SEQ ID NO: 60210 - DNA, 22 bp, Artificial Sequence
  chemically synthesized
aggtagagtagctaaggctcag

SEQ ID NO: 60211 - DNA, 22 bp, Artificial Sequence
  chemically synthesized
ggtagagtagctaaggctcaga

SEQ ID NO: 60212 - DNA, 22 bp, Artificial Sequence
  chemically synthesized
aggctcagaaagtaggccgggc

SEQ ID NO: 60213 - DNA, 22 bp, Artificial Sequence
  chemically synthesized
agaaagtaggccgggcgcggtg

SEQ ID NO: 60214 - DNA, 22 bp, Artificial Sequence
  chemically synthesized
acgcctgtaatcctagcacttt

SEQ ID NO: 60215 - DNA, 22 bp, Artificial Sequence
  chemically synthesized
taatcctagcactttgggaggc

SEQ ID NO: 60216 - DNA, 22 bp, Artificial Sequence
  chemically synthesized
gcactttgggaggccaacgcag

SEQ ID NO: 60217 - DNA, 22 bp, Artificial Sequence
  chemically synthesized
tgggaggccaacgcaggtggat

SEQ ID NO: 60218 - DNA, 22 bp, Artificial Sequence
  chemically synthesized
gggaggccaacgcaggtggatc

SEQ ID NO: 60219 - DNA, 22 bp, Artificial Sequence
  chemically synthesized
ggaggccaacgcaggtggatca

SEQ ID NO: 60220 - DNA, 22 bp, Artificial Sequence
  chemically synthesized
aggtcaggagtttgagaccagc

SEQ ID NO: 60221 - DNA, 22 bp, Artificial Sequence
  chemically synthesized
gagaccagcctggccaacatgg

SEQ ID NO: 60222 - DNA, 22 bp, Artificial Sequence
  chemically synthesized
agaccagcctggccaacatggt

SEQ ID NO: 60223 - DNA, 22 bp, Artificial Sequence
  chemically synthesized
gccaacatggtgaaacctcgtc

SEQ ID NO: 60224 - DNA, 22 bp, Artificial Sequence
  chemically synthesized
gtcactaataaaaaaatacaaa

SEQ ID NO: 60225 - DNA, 22 bp, Artificial Sequence
  chemically synthesized
ataaaaaaatacaaaaacttag

SEQ ID NO: 60226 - DNA, 22 bp, Artificial Sequence
  chemically synthesized
agccaggcatggtggcgggcgc

SEQ ID NO: 60227 - DNA, 22 bp, Artificial Sequence
  chemically synthesized
gccaggcatggtggcgggcgcc

SEQ ID NO: 60228 - DNA, 22 bp, Artificial Sequence
  chemically synthesized
taatcccagctacccaggaggc

SEQ ID NO: 60229 - DNA, 22 bp, Artificial Sequence
  chemically synthesized
cccaggaggctgcggcaggaga

SEQ ID NO: 60230 - DNA, 22 bp, Artificial Sequence
  chemically synthesized
cggcaggagaatcacttcaacc

SEQ ID NO: 60231 - DNA, 22 bp, Artificial Sequence
  chemically synthesized
caacccgggaggcagaggttgc

SEQ ID NO: 60232 - DNA, 22 bp, Artificial Sequence
  chemically synthesized
aacccgggaggcagaggttgca

SEQ ID NO: 60233 - DNA, 22 bp, Artificial Sequence
  chemically synthesized
cagtgagctgaaatcacaccac

SEQ ID NO: 60234 - DNA, 22 bp, Artificial Sequence
  chemically synthesized
aaatcacaccactgcactccag

SEQ ID NO: 60235 - DNA, 22 bp, Artificial Sequence
  chemically synthesized
cactccagccttggtgacagag

SEQ ID NO: 60236 - DNA, 22 bp, Artificial Sequence
  chemically synthesized
cagccttggtgacagagaaaga

SEQ ID NO: 60237 - DNA, 22 bp, Artificial Sequence
  chemically synthesized
ggtgacagagaaagattctgtc

SEQ ID NO: 60238 - DNA, 22 bp, Artificial Sequence
  chemically synthesized
gtgacagagaaagattctgtca

SEQ ID NO: 60239 - DNA, 22 bp, Artificial Sequence
  chemically synthesized
tgtcaggaaaaaaaaaaaaaag

SEQ ID NO: 60240 - DNA, 22 bp, Artificial Sequence
  chemically synthesized
tcaggaaaaaaaaaaaaaagtt

SEQ ID NO: 60241 - DNA, 22 bp, Artificial Sequence
  chemically synthesized
aaatgaattacccaaggtatat

SEQ ID NO: 60242 - DNA, 22 bp, Artificial Sequence
  chemically synthesized
aatgaattacccaaggtatata

SEQ ID NO: 60243 - DNA, 22 bp, Artificial Sequence
  chemically synthesized
cccaaggtatataattgttagt

SEQ ID NO: 60244 - DNA, 22 bp, Artificial Sequence
  chemically synthesized
ttagtgttagaaggaagaagaa

SEQ ID NO: 60245 - DNA, 22 bp, Artificial Sequence
  chemically synthesized
gtgttagaaggaagaagaaggg

SEQ ID NO: 60246 - DNA, 22 bp, Artificial Sequence
  chemically synthesized
gaaggaagaagaagggagggag

SEQ ID NO: 60247 - DNA, 22 bp, Artificial Sequence
  chemically synthesized
tatttatctatggggttccctg

SEQ ID NO: 60248 - DNA, 22 bp, Artificial Sequence
  chemically synthesized
atttatctatggggttccctgg

SEQ ID NO: 60249 - DNA, 22 bp, Artificial Sequence
  chemically synthesized
tttatctatggggttccctgga

SEQ ID NO: 60250 - DNA, 22 bp, Artificial Sequence
  chemically synthesized
atctatggggttccctggaaag

SEQ ID NO: 60251 - DNA, 22 bp, Artificial Sequence
  chemically synthesized
tctatggggttccctggaaagc

SEQ ID NO: 60252 - DNA, 22 bp, Artificial Sequence
  chemically synthesized
tggggttccctggaaagcaggc

SEQ ID NO: 60253 - DNA, 22 bp, Artificial Sequence
  chemically synthesized
cctggaaagcaggctgaaatgg

SEQ ID NO: 60254 - DNA, 22 bp, Artificial Sequence
  chemically synthesized
gaaagcaggctgaaatggagat

SEQ ID NO: 60255 - DNA, 22 bp, Artificial Sequence
  chemically synthesized
aaatggagattcacgtgcagga

SEQ ID NO: 60256 - DNA, 22 bp, Artificial Sequence
  chemically synthesized
acgtgcaggagtttagatactc

SEQ ID NO: 60257 - DNA, 22 bp, Artificial Sequence
  chemically synthesized
agatactctggggaactatact

SEQ ID NO: 60258 - DNA, 22 bp, Artificial Sequence
  chemically synthesized
gatactctggggaactatactt

SEQ ID NO: 60259 - DNA, 22 bp, Artificial Sequence
  chemically synthesized
tggggaactatacttgtagaag

SEQ ID NO: 60260 - DNA, 22 bp, Artificial Sequence
  chemically synthesized
gggaactatacttgtagaaggg

SEQ ID NO: 60261 - DNA, 22 bp, Artificial Sequence
  chemically synthesized
tacttgtagaagggaaggaaca

SEQ ID NO: 60262 - DNA, 22 bp, Artificial Sequence
  chemically synthesized
gtagaagggaaggaacaggaac

SEQ ID NO: 60263 - DNA, 22 bp, Artificial Sequence
  chemically synthesized
tagaagggaaggaacaggaaca

SEQ ID NO: 60264 - DNA, 22 bp, Artificial Sequence
  chemically synthesized
tgattctgcctcatccaacccc

SEQ ID NO: 60265 - DNA, 22 bp, Artificial Sequence
  chemically synthesized
tgcctcatccaaccccacagcg

SEQ ID NO: 60266 - DNA, 22 bp, Artificial Sequence
  chemically synthesized
cctcatccaaccccacagcgag

SEQ ID NO: 60267 - DNA, 22 bp, Artificial Sequence
  chemically synthesized
atccaaccccacagcgagctct

SEQ ID NO: 60268 - DNA, 22 bp, Artificial Sequence
  chemically synthesized
tgaagctggggatggctcctca

SEQ ID NO: 60269 - DNA, 22 bp, Artificial Sequence
  chemically synthesized
aagctggggatggctcctcaga

SEQ ID NO: 60270 - DNA, 22 bp, Artificial Sequence
  chemically synthesized
gggatggctcctcagagttggt

SEQ ID NO: 60271 - DNA, 22 bp, Artificial Sequence
  chemically synthesized
ctcagagttggtccaagttggg

SEQ ID NO: 60272 - DNA, 22 bp, Artificial Sequence
  chemically synthesized
agagttggtccaagttgggaca

SEQ ID NO: 60273 - DNA, 22 bp, Artificial Sequence
  chemically synthesized
gtccaagttgggacaagggaat

SEQ ID NO: 60274 - DNA, 22 bp, Artificial Sequence
  chemically synthesized
ggacaagggaatcagaccctgg

SEQ ID NO: 60275 - DNA, 22 bp, Artificial Sequence
  chemically synthesized
gggagagcgtaaccttgatcaa

SEQ ID NO: 60276 - DNA, 22 bp, Artificial Sequence
  chemically synthesized
gatcaaggcgactctctttagc

SEQ ID NO: 60277 - DNA, 22 bp, Artificial Sequence
  chemically synthesized
atcaaggcgactctctttagcc

SEQ ID NO: 60278 - DNA, 22 bp, Artificial Sequence
  chemically synthesized
tctttagcccagggcaatgcca

SEQ ID NO: 60279 - DNA, 22 bp, Artificial Sequence
  chemically synthesized
tttagcccagggcaatgccagg

SEQ ID NO: 60280 - DNA, 22 bp, Artificial Sequence
  chemically synthesized
tagcccagggcaatgccaggag

SEQ ID NO: 60281 - DNA, 22 bp, Artificial Sequence
  chemically synthesized
agcccagggcaatgccaggaga

SEQ ID NO: 60282 - DNA, 22 bp, Artificial Sequence
  chemically synthesized
gcccagggcaatgccaggagaa

SEQ ID NO: 60283 - DNA, 22 bp, Artificial Sequence
  chemically synthesized
agagcagaaagccatctaccat

SEQ ID NO: 60284 - DNA, 22 bp, Artificial Sequence
  chemically synthesized
ccatcacactctcaacagctac

SEQ ID NO: 60285 - DNA, 22 bp, Artificial Sequence
  chemically synthesized
tcaacagctacgaaataagtcc

SEQ ID NO: 60286 - DNA, 22 bp, Artificial Sequence
  chemically synthesized
aacagctacgaaataagtcctg

SEQ ID NO: 60287 - DNA, 22 bp, Artificial Sequence
  chemically synthesized
cgaaataagtcctgcagttcag

SEQ ID NO: 60288 - DNA, 22 bp, Artificial Sequence
  chemically synthesized
cagttcaggagggaggtctggg

SEQ ID NO: 60289 - DNA, 22 bp, Artificial Sequence
  chemically synthesized
aggagggaggtctgggcggcac

SEQ ID NO: 60290 - DNA, 22 bp, Artificial Sequence
  chemically synthesized
ggcggcacatctcaggaccctc

SEQ ID NO: 60291 - DNA, 22 bp, Artificial Sequence
  chemically synthesized
aggaccctctatctctcagggt

SEQ ID NO: 60292 - DNA, 22 bp, Artificial Sequence
  chemically synthesized
tatctctcagggtagaggaatt

SEQ ID NO: 60293 - DNA, 22 bp, Artificial Sequence
  chemically synthesized
tctctcagggtagaggaattaa

SEQ ID NO: 60294 - DNA, 22 bp, Artificial Sequence
  chemically synthesized
tcagggtagaggaattaagaat

SEQ ID NO: 60295 - DNA, 22 bp, Artificial Sequence
  chemically synthesized
agggtagaggaattaagaatgg

SEQ ID NO: 60296 - DNA, 22 bp, Artificial Sequence
  chemically synthesized
agaatgggatgggaaccagacg

SEQ ID NO: 60297 - DNA, 22 bp, Artificial Sequence
  chemically synthesized
acacctataatcccaacacttt

SEQ ID NO: 60298 - DNA, 22 bp, Artificial Sequence
  chemically synthesized
taatcccaacactttgggaggc

SEQ ID NO: 60299 - DNA, 22 bp, Artificial Sequence
  chemically synthesized
tgggaggccaagggtaggagga

SEQ ID NO: 60300 - DNA, 22 bp, Artificial Sequence
  chemically synthesized
gggaggccaagggtaggaggat

SEQ ID NO: 60301 - DNA, 22 bp, Artificial Sequence
  chemically synthesized
ggaggccaagggtaggaggatt

SEQ ID NO: 60302 - DNA, 22 bp, Artificial Sequence
  chemically synthesized
cttgagcccaagagttcaaaac

SEQ ID NO: 60303 - DNA, 22 bp, Artificial Sequence
  chemically synthesized
gagcccaagagttcaaaaccag

SEQ ID NO: 60304 - DNA, 22 bp, Artificial Sequence
  chemically synthesized
agcccaagagttcaaaaccagc

SEQ ID NO: 60305 - DNA, 22 bp, Artificial Sequence
  chemically synthesized
aaaaccagcctgggcaaaaaca

SEQ ID NO: 60306 - DNA, 22 bp, Artificial Sequence
  chemically synthesized
ggcaaaaacaatcaaacaaaca

SEQ ID NO: 60307 - DNA, 22 bp, Artificial Sequence
  chemically synthesized
aaaaaatttgctgtgtgtggtg

SEQ ID NO: 60308 - DNA, 22 bp, Artificial Sequence
  chemically synthesized
aaaaatttgctgtgtgtggtgg

SEQ ID NO: 60309 - DNA, 22 bp, Artificial Sequence
  chemically synthesized
gctgtgtgtggtggtgtgcacc

SEQ ID NO: 60310 - DNA, 22 bp, Artificial Sequence
  chemically synthesized
ctgtgtgtggtggtgtgcacct

SEQ ID NO: 60311 - DNA, 22 bp, Artificial Sequence
  chemically synthesized
tgtgtggtggtgtgcacctgtg

SEQ ID NO: 60312 - DNA, 22 bp, Artificial Sequence
  chemically synthesized
tggtcccagctactcagggggc

SEQ ID NO: 60313 - DNA, 22 bp, Artificial Sequence
  chemically synthesized
ctcagggggctgaggtgggagg

SEQ ID NO: 60314 - DNA, 22 bp, Artificial Sequence
  chemically synthesized
agggggctgaggtgggaggatt

SEQ ID NO: 60315 - DNA, 22 bp, Artificial Sequence
  chemically synthesized
aggtgggaggattgcttgagtc

SEQ ID NO: 60316 - DNA, 22 bp, Artificial Sequence
  chemically synthesized
cttgagtccaggaggtcgaggc

SEQ ID NO: 60317 - DNA, 22 bp, Artificial Sequence
  chemically synthesized
gagtccaggaggtcgaggctgc

SEQ ID NO: 60318 - DNA, 22 bp, Artificial Sequence
  chemically synthesized
agtccaggaggtcgaggctgca

SEQ ID NO: 60319 - DNA, 22 bp, Artificial Sequence
  chemically synthesized
cagtgagctatgatcatggcac

SEQ ID NO: 60320 - DNA, 22 bp, Artificial Sequence
  chemically synthesized
tgatcatggcactgcattgcag

SEQ ID NO: 60321 - DNA, 22 bp, Artificial Sequence
  chemically synthesized
cattgcagcctaggagacaaag

SEQ ID NO: 60322 - DNA, 22 bp, Artificial Sequence
  chemically synthesized
cagcctaggagacaaagcaaga

SEQ ID NO: 60323 - DNA, 22 bp, Artificial Sequence
  chemically synthesized
ggagacaaagcaagacactgtc

SEQ ID NO: 60324 - DNA, 22 bp, Artificial Sequence
  chemically synthesized
tctctaaaaaaacaaaaaacaa

SEQ ID NO: 60325 - DNA, 22 bp, Artificial Sequence
  chemically synthesized
taaaaaaacaaaaaacaaacaa

SEQ ID NO: 60326 - DNA, 22 bp, Artificial Sequence
  chemically synthesized
aaaaaacaaaaaacaaacaaat

SEQ ID NO: 60327 - DNA, 22 bp, Artificial Sequence
  chemically synthesized
caagcagggttaaatagcgtgg

SEQ ID NO: 60328 - DNA, 22 bp, Artificial Sequence
  chemically synthesized
aatagcgtggtcagagtaggac

SEQ ID NO: 60329 - DNA, 22 bp, Artificial Sequence
  chemically synthesized
actgagaatatgagatctgagt

SEQ ID NO: 60330 - DNA, 22 bp, Artificial Sequence
  chemically synthesized
agaatatgagatctgagtcaag

SEQ ID NO: 60331 - DNA, 22 bp, Artificial Sequence
  chemically synthesized
agtcaagtcttcaaggatgtga

SEQ ID NO: 60332 - DNA, 22 bp, Artificial Sequence
  chemically synthesized
caaggatgtgaggaagtaagtt

SEQ ID NO: 60333 - DNA, 22 bp, Artificial Sequence
  chemically synthesized
aaggatgtgaggaagtaagttt

SEQ ID NO: 60334 - DNA, 22 bp, Artificial Sequence
  chemically synthesized
ctggcagaagagctgtgaaggg

SEQ ID NO: 60335 - DNA, 22 bp, Artificial Sequence
  chemically synthesized
tggcagaagagctgtgaagggc

SEQ ID NO: 60336 - DNA, 22 bp, Artificial Sequence
  chemically synthesized
gcagaagagctgtgaagggctg

SEQ ID NO: 60337 - DNA, 22 bp, Artificial Sequence
  chemically synthesized
tgaagggctgtctggccagaga

SEQ ID NO: 60338 - DNA, 22 bp, Artificial Sequence
  chemically synthesized
tctggccagagaagattgcaat

SEQ ID NO: 60339 - DNA, 22 bp, Artificial Sequence
  chemically synthesized
gccagagaagattgcaatgcaa

SEQ ID NO: 60340 - DNA, 22 bp, Artificial Sequence
  chemically synthesized
caatgcaaaagccctgaggtgg

SEQ ID NO: 60341 - DNA, 22 bp, Artificial Sequence
  chemically synthesized
aggtgggaacgtgtttggtgtg

SEQ ID NO: 60342 - DNA, 22 bp, Artificial Sequence
  chemically synthesized
ggtgtgtttaaaggaaagcaat

SEQ ID NO: 60343 - DNA, 22 bp, Artificial Sequence
  chemically synthesized
gtgtgtttaaaggaaagcaatg

SEQ ID NO: 60344 - DNA, 22 bp, Artificial Sequence
  chemically synthesized
aaaggaaagcaatgaggccagt

SEQ ID NO: 60345 - DNA, 22 bp, Artificial Sequence
  chemically synthesized
aaggaaagcaatgaggccagtg

SEQ ID NO: 60346 - DNA, 22 bp, Artificial Sequence
  chemically synthesized
gtaattgtacgcccagtatgct

SEQ ID NO: 60347 - DNA, 22 bp, Artificial Sequence
  chemically synthesized
taattgtacgcccagtatgctg

SEQ ID NO: 60348 - DNA, 22 bp, Artificial Sequence
  chemically synthesized
tacgcccagtatgctgattctt

SEQ ID NO: 60349 - DNA, 22 bp, Artificial Sequence
  chemically synthesized
attctttgtgtaatctccagac

SEQ ID NO: 60350 - DNA, 22 bp, Artificial Sequence
  chemically synthesized
tttgtgtaatctccagactgta

SEQ ID NO: 60351 - DNA, 22 bp, Artificial Sequence
  chemically synthesized
tgtgtaatctccagactgtatt

SEQ ID NO: 60352 - DNA, 22 bp, Artificial Sequence
  chemically synthesized
gtgtaatctccagactgtatta

SEQ ID NO: 60353 - DNA, 22 bp, Artificial Sequence
  chemically synthesized
tgtaatctccagactgtattaa

SEQ ID NO: 60354 - DNA, 22 bp, Artificial Sequence
  chemically synthesized
cagactgtattaaactgcaaga

SEQ ID NO: 60355 - DNA, 22 bp, Artificial Sequence
  chemically synthesized
tattaaactgcaagagcagggc

SEQ ID NO: 60356 - DNA, 22 bp, Artificial Sequence
  chemically synthesized
aactgcaagagcagggcccctc

SEQ ID NO: 60357 - DNA, 22 bp, Artificial Sequence
  chemically synthesized
caagagcagggcccctctctgg

SEQ ID NO: 60358 - DNA, 22 bp, Artificial Sequence
  chemically synthesized
tctggctttgctcatcattgta

SEQ ID NO: 60359 - DNA, 22 bp, Artificial Sequence
  chemically synthesized
tggctttgctcatcattgtatt

SEQ ID NO: 60360 - DNA, 22 bp, Artificial Sequence
  chemically synthesized
gctttgctcatcattgtattcc

SEQ ID NO: 60361 - DNA, 22 bp, Artificial Sequence
  chemically synthesized
tgctcatcattgtattcccaga

SEQ ID NO: 60362 - DNA, 22 bp, Artificial Sequence
  chemically synthesized
gctcatcattgtattcccagag

SEQ ID NO: 60363 - DNA, 22 bp, Artificial Sequence
  chemically synthesized
ctcatcattgtattcccagagc

SEQ ID NO: 60364 - DNA, 22 bp, Artificial Sequence
  chemically synthesized
atcattgtattcccagagcctt

SEQ ID NO: 60365 - DNA, 22 bp, Artificial Sequence
  chemically synthesized
tattcccagagccttgcacaat

SEQ ID NO: 60366 - DNA, 22 bp, Artificial Sequence
  chemically synthesized
ccagagccttgcacaatgcttg

SEQ ID NO: 60367 - DNA, 22 bp, Artificial Sequence
  chemically synthesized
gcacaatgcttggtgcatagga

SEQ ID NO: 60368 - DNA, 22 bp, Artificial Sequence
  chemically synthesized
cacaatgcttggtgcataggag

SEQ ID NO: 60369 - DNA, 22 bp, Artificial Sequence
  chemically synthesized
ggtgcataggagatggaaattt

SEQ ID NO: 60370 - DNA, 22 bp, Artificial Sequence
  chemically synthesized
gtgcataggagatggaaatttg

SEQ ID NO: 60371 - DNA, 22 bp, Artificial Sequence
  chemically synthesized
gttaaataaatgaattatggat

SEQ ID NO: 60372 - DNA, 22 bp, Artificial Sequence
  chemically synthesized
ttaaataaatgaattatggata

SEQ ID NO: 60373 - DNA, 22 bp, Artificial Sequence
  chemically synthesized
aataaatgaattatggataacg

SEQ ID NO: 60374 - DNA, 22 bp, Artificial Sequence
  chemically synthesized
tggataacgaatggatggtaag

SEQ ID NO: 60375 - DNA, 22 bp, Artificial Sequence
  chemically synthesized
ggtggctgggtagatgatgcac

SEQ ID NO: 60376 - DNA, 22 bp, Artificial Sequence
  chemically synthesized
ggtagatgatgcactgtctccc

SEQ ID NO: 60377 - DNA, 22 bp, Artificial Sequence
  chemically synthesized
tctcccagatgaggaccttttc

SEQ ID NO: 60378 - DNA, 22 bp, Artificial Sequence
  chemically synthesized
ccagatgaggaccttttcacct

SEQ ID NO: 60379 - DNA, 22 bp, Artificial Sequence
  chemically synthesized
ttcacctttactccattctctt

SEQ ID NO: 60380 - DNA, 22 bp, Artificial Sequence
  chemically synthesized
tcacctttactccattctcttt

SEQ ID NO: 60381 - DNA, 22 bp, Artificial Sequence
  chemically synthesized
cacctttactccattctctttc

SEQ ID NO: 60382 - DNA, 22 bp, Artificial Sequence
  chemically synthesized
acctttactccattctctttcc

SEQ ID NO: 60383 - DNA, 22 bp, Artificial Sequence
  chemically synthesized
tactccattctctttcctgccc

SEQ ID NO: 60384 - DNA, 22 bp, Artificial Sequence
  chemically synthesized
actccattctctttcctgccct

SEQ ID NO: 60385 - DNA, 22 bp, Artificial Sequence
  chemically synthesized
ctccattctctttcctgccctt

SEQ ID NO: 60386 - DNA, 22 bp, Artificial Sequence
  chemically synthesized
cattctctttcctgccctttag

SEQ ID NO: 60387 - DNA, 22 bp, Artificial Sequence
  chemically synthesized
tctttcctgccctttagggagc

SEQ ID NO: 60388 - DNA, 22 bp, Artificial Sequence
  chemically synthesized
tttcctgccctttagggagccc

SEQ ID NO: 60389 - DNA, 22 bp, Artificial Sequence
  chemically synthesized
tcctgccctttagggagcccct

SEQ ID NO: 60390 - DNA, 22 bp, Artificial Sequence
  chemically synthesized
cctgccctttagggagcccctc

SEQ ID NO: 60391 - DNA, 22 bp, Artificial Sequence
  chemically synthesized
ctgccctttagggagcccctct

SEQ ID NO: 60392 - DNA, 22 bp, Artificial Sequence
  chemically synthesized
ccctttagggagcccctctggc

SEQ ID NO: 60393 - DNA, 22 bp, Artificial Sequence
  chemically synthesized
tagggagcccctctggccatgc

SEQ ID NO: 60394 - DNA, 22 bp, Artificial Sequence
  chemically synthesized
agggagcccctctggccatgcc

SEQ ID NO: 60395 - DNA, 22 bp, Artificial Sequence
  chemically synthesized
gggagcccctctggccatgcca

SEQ ID NO: 60396 - DNA, 22 bp, Artificial Sequence
  chemically synthesized
tggccatgccatgggcacagca

SEQ ID NO: 60397 - DNA, 22 bp, Artificial Sequence
  chemically synthesized
gccatgccatgggcacagcagg

SEQ ID NO: 60398 - DNA, 22 bp, Artificial Sequence
  chemically synthesized
cgtgatggtcacatctactctt

SEQ ID NO: 60399 - DNA, 22 bp, Artificial Sequence
  chemically synthesized
ctctttccatctttcagggaaa

SEQ ID NO: 60400 - DNA, 22 bp, Artificial Sequence
  chemically synthesized
tttccatctttcagggaaagat

SEQ ID NO: 60401 - DNA, 22 bp, Artificial Sequence
  chemically synthesized
tccatctttcagggaaagataa

SEQ ID NO: 60402 - DNA, 22 bp, Artificial Sequence
  chemically synthesized
ccatctttcagggaaagataaa

SEQ ID NO: 60403 - DNA, 22 bp, Artificial Sequence
  chemically synthesized
catctttcagggaaagataaag

SEQ ID NO: 60404 - DNA, 22 bp, Artificial Sequence
  chemically synthesized
tcagggaaagataaagccgacc

SEQ ID NO: 60405 - DNA, 22 bp, Artificial Sequence
  chemically synthesized
cagggaaagataaagccgacct

SEQ ID NO: 60406 - DNA, 22 bp, Artificial Sequence
  chemically synthesized
agggaaagataaagccgaccta

SEQ ID NO: 60407 - DNA, 22 bp, Artificial Sequence
  chemically synthesized
cagatttcggtaagaactcacc

SEQ ID NO: 60408 - DNA, 22 bp, Artificial Sequence
  chemically synthesized
cggtaagaactcaccactgggg

SEQ ID NO: 60409 - DNA, 22 bp, Artificial Sequence
  chemically synthesized
ggtaagaactcaccactggggt

SEQ ID NO: 60410 - DNA, 22 bp, Artificial Sequence
  chemically synthesized
accactggggtgtaggtggtgg

SEQ ID NO: 60411 - DNA, 22 bp, Artificial Sequence
  chemically synthesized
gggtgtaggtggtggagggcag

SEQ ID NO: 60412 - DNA, 22 bp, Artificial Sequence
  chemically synthesized
tctctgtagctgacacaccacg

SEQ ID NO: 60413 - DNA, 22 bp, Artificial Sequence
  chemically synthesized
tctgtagctgacacaccacgta

SEQ ID NO: 60414 - DNA, 22 bp, Artificial Sequence
  chemically synthesized
tgtagctgacacaccacgtatt

SEQ ID NO: 60415 - DNA, 22 bp, Artificial Sequence
  chemically synthesized
tagctgacacaccacgtattct

SEQ ID NO: 60416 - DNA, 22 bp, Artificial Sequence
  chemically synthesized
acacaccacgtattcttcctca

SEQ ID NO: 60417 - DNA, 22 bp, Artificial Sequence
  chemically synthesized
ttcctcacatccccctagcccg

SEQ ID NO: 60418 - DNA, 22 bp, Artificial Sequence
  chemically synthesized
cctcacatccccctagcccgct

SEQ ID NO: 60419 - DNA, 22 bp, Artificial Sequence
  chemically synthesized
ctcacatccccctagcccgctc

SEQ ID NO: 60420 - DNA, 22 bp, Artificial Sequence
  chemically synthesized
acatccccctagcccgctccca

SEQ ID NO: 60421 - DNA, 22 bp, Artificial Sequence
  chemically synthesized
gcccgctcccacacctgggcag

SEQ ID NO: 60422 - DNA, 22 bp, Artificial Sequence
  chemically synthesized
ccacacctgggcagccgctgat

SEQ ID NO: 60423 - DNA, 22 bp, Artificial Sequence
  chemically synthesized
ggcagccgctgattaagagttg

SEQ ID NO: 60424 - DNA, 22 bp, Artificial Sequence
  chemically synthesized
attaagagttgtggcactttgg

SEQ ID NO: 60425 - DNA, 22 bp, Artificial Sequence
  chemically synthesized
agagttgtggcactttggatag

SEQ ID NO: 60426 - DNA, 22 bp, Artificial Sequence
  chemically synthesized
tggcactttggatagggataaa

SEQ ID NO: 60427 - DNA, 22 bp, Artificial Sequence
  chemically synthesized
tggatagggataaacctcagag

SEQ ID NO: 60428 - DNA, 22 bp, Artificial Sequence
  chemically synthesized
ggatagggataaacctcagagt

SEQ ID NO: 60429 - DNA, 22 bp, Artificial Sequence
  chemically synthesized
gatagggataaacctcagagtc

SEQ ID NO: 60430 - DNA, 22 bp, Artificial Sequence
  chemically synthesized
agagtcagggaatgtttgggct

SEQ ID NO: 60431 - DNA, 22 bp, Artificial Sequence
  chemically synthesized
gggctgaaagggatccagtagt

SEQ ID NO: 60432 - DNA, 22 bp, Artificial Sequence
  chemically synthesized
ggctgaaagggatccagtagtg

SEQ ID NO: 60433 - DNA, 22 bp, Artificial Sequence
  chemically synthesized
aaagggatccagtagtgcaatc

SEQ ID NO: 60434 - DNA, 22 bp, Artificial Sequence
  chemically synthesized
ttttacagataaggaaacaaag

SEQ ID NO: 60435 - DNA, 22 bp, Artificial Sequence
  chemically synthesized
tacagataaggaaacaaagccc

SEQ ID NO: 60436 - DNA, 22 bp, Artificial Sequence
  chemically synthesized
acagataaggaaacaaagccca

SEQ ID NO: 60437 - DNA, 22 bp, Artificial Sequence
  chemically synthesized
cagataaggaaacaaagcccaa

SEQ ID NO: 60438 - DNA, 22 bp, Artificial Sequence
  chemically synthesized
ataaaaataaggtagtgaagta

SEQ ID NO: 60439 - DNA, 22 bp, Artificial Sequence
  chemically synthesized
taaaaataaggtagtgaagtag

SEQ ID NO: 60440 - DNA, 22 bp, Artificial Sequence
  chemically synthesized
aaataaaaacccatgtctgtac

SEQ ID NO: 60441 - DNA, 22 bp, Artificial Sequence
  chemically synthesized
aataaaaacccatgtctgtacc

SEQ ID NO: 60442 - DNA, 22 bp, Artificial Sequence
  chemically synthesized
taccaaccacagagtcacccat

SEQ ID NO: 60443 - DNA, 22 bp, Artificial Sequence
  chemically synthesized
aaataaccagagaaacagaaga

SEQ ID NO: 60444 - DNA, 22 bp, Artificial Sequence
  chemically synthesized
ctactacagagaattccgggtg

SEQ ID NO: 60445 - DNA, 22 bp, Artificial Sequence
  chemically synthesized
ctacagagaattccgggtgtgc

SEQ ID NO: 60446 - DNA, 22 bp, Artificial Sequence
  chemically synthesized
cagagaattccgggtgtgcagc

SEQ ID NO: 60447 - DNA, 22 bp, Artificial Sequence
  chemically synthesized
cgggtgtgcagccacagtgcaa

SEQ ID NO: 60448 - DNA, 22 bp, Artificial Sequence
  chemically synthesized
tttatttttatttttgagatgc

SEQ ID NO: 60449 - DNA, 22 bp, Artificial Sequence
  chemically synthesized
ttatttttatttttgagatgca

SEQ ID NO: 60450 - DNA, 22 bp, Artificial Sequence
  chemically synthesized
tatttttatttttgagatgcag

SEQ ID NO: 60451 - DNA, 22 bp, Artificial Sequence
  chemically synthesized
atttttatttttgagatgcagt

SEQ ID NO: 60452 - DNA, 22 bp, Artificial Sequence
  chemically synthesized
tttttatttttgagatgcagtc

SEQ ID NO: 60453 - DNA, 22 bp, Artificial Sequence
  chemically synthesized
ttatttttgagatgcagtctcg

SEQ ID NO: 60454 - DNA, 22 bp, Artificial Sequence
  chemically synthesized
tatttttgagatgcagtctcgc

SEQ ID NO: 60455 - DNA, 22 bp, Artificial Sequence
  chemically synthesized
atttttgagatgcagtctcgct

SEQ ID NO: 60456 - DNA, 22 bp, Artificial Sequence
  chemically synthesized
tttttgagatgcagtctcgctc

SEQ ID NO: 60457 - DNA, 22 bp, Artificial Sequence
  chemically synthesized
ttgagatgcagtctcgctctgt

SEQ ID NO: 60458 - DNA, 22 bp, Artificial Sequence
  chemically synthesized
tgagatgcagtctcgctctgtc

SEQ ID NO: 60459 - DNA, 22 bp, Artificial Sequence
  chemically synthesized
gagatgcagtctcgctctgtca

SEQ ID NO: 60460 - DNA, 22 bp, Artificial Sequence
  chemically synthesized
agatgcagtctcgctctgtcat

SEQ ID NO: 60461 - DNA, 22 bp, Artificial Sequence
  chemically synthesized
gctctgtcatccaggctgaagt

SEQ ID NO: 60462 - DNA, 22 bp, Artificial Sequence
  chemically synthesized
tgtcatccaggctgaagtgcag

SEQ ID NO: 60463 - DNA, 22 bp, Artificial Sequence
  chemically synthesized
tcatccaggctgaagtgcagtg

SEQ ID NO: 60464 - DNA, 22 bp, Artificial Sequence
  chemically synthesized
aagtgcagtggcacgatcatgt

SEQ ID NO: 60465 - DNA, 22 bp, Artificial Sequence
  chemically synthesized
gctgcaacctctgcctcccagg

SEQ ID NO: 60466 - DNA, 22 bp, Artificial Sequence
  chemically synthesized
caacctctgcctcccaggctca

SEQ ID NO: 60467 - DNA, 22 bp, Artificial Sequence
  chemically synthesized
tgcctcccaggctcaagcgatc

SEQ ID NO: 60468 - DNA, 22 bp, Artificial Sequence
  chemically synthesized
cctcccaggctcaagcgatcct

SEQ ID NO: 60469 - DNA, 22 bp, Artificial Sequence
  chemically synthesized
ccaggctcaagcgatcctccca

SEQ ID NO: 60470 - DNA, 22 bp, Artificial Sequence
  chemically synthesized
aagcgatcctcccacctcagcc

SEQ ID NO: 60471 - DNA, 22 bp, Artificial Sequence
  chemically synthesized
ccacctcagccatctgagtagc

SEQ ID NO: 60472 - DNA, 22 bp, Artificial Sequence
  chemically synthesized
agccatctgagtagctgggacc

SEQ ID NO: 60473 - DNA, 22 bp, Artificial Sequence
  chemically synthesized
agtagctgggaccacaggccac

SEQ ID NO: 60474 - DNA, 22 bp, Artificial Sequence
  chemically synthesized
ggaccacaggccacacaccaca

SEQ ID NO: 60475 - DNA, 22 bp, Artificial Sequence
  chemically synthesized
atttctcgtatctttttgtaga

SEQ ID NO: 60476 - DNA, 22 bp, Artificial Sequence
  chemically synthesized
ctcgtatctttttgtagagaca

SEQ ID NO: 60477 - DNA, 22 bp, Artificial Sequence
  chemically synthesized
tcgtatctttttgtagagacag

SEQ ID NO: 60478 - DNA, 22 bp, Artificial Sequence
  chemically synthesized
gtatctttttgtagagacagag

SEQ ID NO: 60479 - DNA, 22 bp, Artificial Sequence
  chemically synthesized
tttgtagagacagagttctgct

SEQ ID NO: 60480 - DNA, 22 bp, Artificial Sequence
  chemically synthesized
ttgtagagacagagttctgcta

SEQ ID NO: 60481 - DNA, 22 bp, Artificial Sequence
  chemically synthesized
tgtagagacagagttctgctat

SEQ ID NO: 60482 - DNA, 22 bp, Artificial Sequence
  chemically synthesized
gtagagacagagttctgctatg

SEQ ID NO: 60483 - DNA, 22 bp, Artificial Sequence
  chemically synthesized
tagagacagagttctgctatgt

SEQ ID NO: 60484 - DNA, 22 bp, Artificial Sequence
  chemically synthesized
tgctatgttgcccaggctcagg

SEQ ID NO: 60485 - DNA, 22 bp, Artificial Sequence
  chemically synthesized
ctatgttgcccaggctcaggct

SEQ ID NO: 60486 - DNA, 22 bp, Artificial Sequence
  chemically synthesized
tgttgcccaggctcaggctggt

SEQ ID NO: 60487 - DNA, 22 bp, Artificial Sequence
  chemically synthesized
cccaggctcaggctggtcttga

SEQ ID NO: 60488 - DNA, 22 bp, Artificial Sequence
  chemically synthesized
aggctggtcttgatctcaagca

SEQ ID NO: 60489 - DNA, 22 bp, Artificial Sequence
  chemically synthesized
gtcttgatctcaagcaattggc

SEQ ID NO: 60490 - DNA, 22 bp, Artificial Sequence
  chemically synthesized
gatctcaagcaattggcttgcc

SEQ ID NO: 60491 - DNA, 22 bp, Artificial Sequence
  chemically synthesized
atctcaagcaattggcttgcct

SEQ ID NO: 60492 - DNA, 22 bp, Artificial Sequence
  chemically synthesized
aagcaattggcttgcctcagcc

SEQ ID NO: 60493 - DNA, 22 bp, Artificial Sequence
  chemically synthesized
gcttgcctcagcctcctaaaat

SEQ ID NO: 60494 - DNA, 22 bp, Artificial Sequence
  chemically synthesized
gcctcagcctcctaaaatattg

SEQ ID NO: 60495 - DNA, 22 bp, Artificial Sequence
  chemically synthesized
cctcagcctcctaaaatattgg

SEQ ID NO: 60496 - DNA, 22 bp, Artificial Sequence
  chemically synthesized
agcctcctaaaatattgggatt

SEQ ID NO: 60497 - DNA, 22 bp, Artificial Sequence
  chemically synthesized
ctaaaatattgggattacaggc

SEQ ID NO: 60498 - DNA, 22 bp, Artificial Sequence
  chemically synthesized
aaatattgggattacaggcatg

SEQ ID NO: 60499 - DNA, 22 bp, Artificial Sequence
  chemically synthesized
ggattacaggcatgagccaccg

SEQ ID NO: 60500 - DNA, 22 bp, Artificial Sequence
  chemically synthesized
caggcatgagccaccgcgccag

SEQ ID NO: 60501 - DNA, 22 bp, Artificial Sequence
  chemically synthesized
aattatcaaacagataaaatag

SEQ ID NO: 60502 - DNA, 22 bp, Artificial Sequence
  chemically synthesized
attatcaaacagataaaatagg

SEQ ID NO: 60503 - DNA, 22 bp, Artificial Sequence
  chemically synthesized
tcaaacagataaaatagggaag

SEQ ID NO: 60504 - DNA, 22 bp, Artificial Sequence
  chemically synthesized
aaattcatatacacaagggtta

SEQ ID NO: 60505 - DNA, 22 bp, Artificial Sequence
  chemically synthesized
atatacacaagggttaaccact

SEQ ID NO: 60506 - DNA, 22 bp, Artificial Sequence
  chemically synthesized
accacttgccacaggcattttt

SEQ ID NO: 60507 - DNA, 22 bp, Artificial Sequence
  chemically synthesized
gccacaggcatttttttttttt

SEQ ID NO: 60508 - DNA, 22 bp, Artificial Sequence
  chemically synthesized
ccacaggcattttttttttttt

SEQ ID NO: 60509 - DNA, 22 bp, Artificial Sequence
  chemically synthesized
tttttttttttttgagacggaa

SEQ ID NO: 60510 - DNA, 22 bp, Artificial Sequence
  chemically synthesized
ttttttttttttgagacggaat

SEQ ID NO: 60511 - DNA, 22 bp, Artificial Sequence
  chemically synthesized
tttttttttttgagacggaatc

SEQ ID NO: 60512 - DNA, 22 bp, Artificial Sequence
  chemically synthesized
ttttttttttgagacggaatct

SEQ ID NO: 60513 - DNA, 22 bp, Artificial Sequence
  chemically synthesized
tttttttttgagacggaatctc

SEQ ID NO: 60514 - DNA, 22 bp, Artificial Sequence
  chemically synthesized
ttttttttgagacggaatctcg

SEQ ID NO: 60515 - DNA, 22 bp, Artificial Sequence
  chemically synthesized
tttttttgagacggaatctcgc

SEQ ID NO: 60516 - DNA, 22 bp, Artificial Sequence
  chemically synthesized
ttttttgagacggaatctcgct

SEQ ID NO: 60517 - DNA, 22 bp, Artificial Sequence
  chemically synthesized
tttttgagacggaatctcgctc

SEQ ID NO: 60518 - DNA, 22 bp, Artificial Sequence
  chemically synthesized
ttttgagacggaatctcgctct

SEQ ID NO: 60519 - DNA, 22 bp, Artificial Sequence
  chemically synthesized
tttgagacggaatctcgctctg

SEQ ID NO: 60520 - DNA, 22 bp, Artificial Sequence
  chemically synthesized
ttgagacggaatctcgctctgt

SEQ ID NO: 60521 - DNA, 22 bp, Artificial Sequence
  chemically synthesized
tgagacggaatctcgctctgtt

SEQ ID NO: 60522 - DNA, 22 bp, Artificial Sequence
  chemically synthesized
gagacggaatctcgctctgttg

SEQ ID NO: 60523 - DNA, 22 bp, Artificial Sequence
  chemically synthesized
agacggaatctcgctctgttgc

SEQ ID NO: 60524 - DNA, 22 bp, Artificial Sequence
  chemically synthesized
gctctgttgcccaggctggagt

SEQ ID NO: 60525 - DNA, 22 bp, Artificial Sequence
  chemically synthesized
tgttgcccaggctggagtgcag

SEQ ID NO: 60526 - DNA, 22 bp, Artificial Sequence
  chemically synthesized
ttgcccaggctggagtgcagtg

SEQ ID NO: 60527 - DNA, 22 bp, Artificial Sequence
  chemically synthesized
cccaggctggagtgcagtggcg

SEQ ID NO: 60528 - DNA, 22 bp, Artificial Sequence
  chemically synthesized
gagtgcagtggcgccatctcgc

SEQ ID NO: 60529 - DNA, 22 bp, Artificial Sequence
  chemically synthesized
gcctcactgcaacctccgcttc

SEQ ID NO: 60530 - DNA, 22 bp, Artificial Sequence
  chemically synthesized
actgcaacctccgcttcctggg

SEQ ID NO: 60531 - DNA, 22 bp, Artificial Sequence
  chemically synthesized
caacctccgcttcctgggttca

SEQ ID NO: 60532 - DNA, 22 bp, Artificial Sequence
  chemically synthesized
cgcttcctgggttcaagctatt

SEQ ID NO: 60533 - DNA, 22 bp, Artificial Sequence
  chemically synthesized
cctgggttcaagctattcttct

SEQ ID NO: 60534 - DNA, 22 bp, Artificial Sequence
  chemically synthesized
ctgggttcaagctattcttctg

SEQ ID NO: 60535 - DNA, 22 bp, Artificial Sequence
  chemically synthesized
ggttcaagctattcttctgcct

SEQ ID NO: 60536 - DNA, 22 bp, Artificial Sequence
  chemically synthesized
aagctattcttctgcctcagcc

SEQ ID NO: 60537 - DNA, 22 bp, Artificial Sequence
  chemically synthesized
ttcttctgcctcagcctaccga

SEQ ID NO: 60538 - DNA, 22 bp, Artificial Sequence
  chemically synthesized
ttctgcctcagcctaccgagta

SEQ ID NO: 60539 - DNA, 22 bp, Artificial Sequence
  chemically synthesized
ctgcctcagcctaccgagtagc

SEQ ID NO: 60540 - DNA, 22 bp, Artificial Sequence
  chemically synthesized
tgcctcagcctaccgagtagct

SEQ ID NO: 60541 - DNA, 22 bp, Artificial Sequence
  chemically synthesized
cctcagcctaccgagtagctgg

SEQ ID NO: 60542 - DNA, 22 bp, Artificial Sequence
  chemically synthesized
agcctaccgagtagctgggact

SEQ ID NO: 60543 - DNA, 22 bp, Artificial Sequence
  chemically synthesized
ccgagtagctgggactacaggc

SEQ ID NO: 60544 - DNA, 22 bp, Artificial Sequence
  chemically synthesized
ggactacaggcacgtgccacca

SEQ ID NO: 60545 - DNA, 22 bp, Artificial Sequence
  chemically synthesized
caggcacgtgccaccacacctg

SEQ ID NO: 60546 - DNA, 22 bp, Artificial Sequence
  chemically synthesized
gctaatttttttatttttagta

SEQ ID NO: 60547 - DNA, 22 bp, Artificial Sequence
  chemically synthesized
atttttttatttttagtagaga

SEQ ID NO: 60548 - DNA, 22 bp, Artificial Sequence
  chemically synthesized
ttttatttttagtagagatggg

SEQ ID NO: 60549 - DNA, 22 bp, Artificial Sequence
  chemically synthesized
tttatttttagtagagatgggg

SEQ ID NO: 60550 - DNA, 22 bp, Artificial Sequence
  chemically synthesized
ttatttttagtagagatggggt

SEQ ID NO: 60551 - DNA, 22 bp, Artificial Sequence
  chemically synthesized
tatttttagtagagatggggtt

SEQ ID NO: 60552 - DNA, 22 bp, Artificial Sequence
  chemically synthesized
atttttagtagagatggggttt

SEQ ID NO: 60553 - DNA, 22 bp, Artificial Sequence
  chemically synthesized
tttttagtagagatggggtttc

SEQ ID NO: 60554 - DNA, 22 bp, Artificial Sequence
  chemically synthesized
ttagtagagatggggtttcacc

SEQ ID NO: 60555 - DNA, 22 bp, Artificial Sequence
  chemically synthesized
tagtagagatggggtttcacca

SEQ ID NO: 60556 - DNA, 22 bp, Artificial Sequence
  chemically synthesized
agtagagatggggtttcaccat

SEQ ID NO: 60557 - DNA, 22 bp, Artificial Sequence
  chemically synthesized
gtagagatggggtttcaccata

SEQ ID NO: 60558 - DNA, 22 bp, Artificial Sequence
  chemically synthesized
caccatattggccaggctggtc

SEQ ID NO: 60559 - DNA, 22 bp, Artificial Sequence
  chemically synthesized
accatattggccaggctggtct

SEQ ID NO: 60560 - DNA, 22 bp, Artificial Sequence
  chemically synthesized
gccaggctggtcttgaactcct

SEQ ID NO: 60561 - DNA, 22 bp, Artificial Sequence
  chemically synthesized
gtcttgaactcctgacctagtg

SEQ ID NO: 60562 - DNA, 22 bp, Artificial Sequence
  chemically synthesized
gaactcctgacctagtgatcca

SEQ ID NO: 60563 - DNA, 22 bp, Artificial Sequence
  chemically synthesized
aactcctgacctagtgatccat

SEQ ID NO: 60564 - DNA, 22 bp, Artificial Sequence
  chemically synthesized
ctgacctagtgatccatccgcc

SEQ ID NO: 60565 - DNA, 22 bp, Artificial Sequence
  chemically synthesized
acctagtgatccatccgcctca

SEQ ID NO: 60566 - DNA, 22 bp, Artificial Sequence
  chemically synthesized
gtgatccatccgcctcagcctc

SEQ ID NO: 60567 - DNA, 22 bp, Artificial Sequence
  chemically synthesized
agcctcccaaagtgctgggatt

SEQ ID NO: 60568 - DNA, 22 bp, Artificial Sequence
  chemically synthesized
ccaaagtgctgggattgcaggc

SEQ ID NO: 60569 - DNA, 22 bp, Artificial Sequence
  chemically synthesized
ggattgcaggcatgagccaccg

SEQ ID NO: 60570 - DNA, 22 bp, Artificial Sequence
  chemically synthesized
caggcatgagccaccgcgcctg

SEQ ID NO: 60571 - DNA, 22 bp, Artificial Sequence
  chemically synthesized
gccttttttttttttttttgag

SEQ ID NO: 60572 - DNA, 22 bp, Artificial Sequence
  chemically synthesized
ttttttttttttttgagacgga

SEQ ID NO: 60573 - DNA, 22 bp, Artificial Sequence
  chemically synthesized
tttttttttttttgagacggag

SEQ ID NO: 60574 - DNA, 22 bp, Artificial Sequence
  chemically synthesized
ttttttttttttgagacggagt

SEQ ID NO: 60575 - DNA, 22 bp, Artificial Sequence
  chemically synthesized
tttttttttttgagacggagtt

SEQ ID NO: 60576 - DNA, 22 bp, Artificial Sequence
  chemically synthesized
ttttttttttgagacggagttt

SEQ ID NO: 60577 - DNA, 22 bp, Artificial Sequence
  chemically synthesized
tttttttttgagacggagtttt

SEQ ID NO: 60578 - DNA, 22 bp, Artificial Sequence
  chemically synthesized
ttttttttgagacggagttttg

SEQ ID NO: 60579 - DNA, 22 bp, Artificial Sequence
  chemically synthesized
tttttttgagacggagttttgc

SEQ ID NO: 60580 - DNA, 22 bp, Artificial Sequence
  chemically synthesized
ttttttgagacggagttttgct

SEQ ID NO: 60581 - DNA, 22 bp, Artificial Sequence
  chemically synthesized
tttttgagacggagttttgctc

SEQ ID NO: 60582 - DNA, 22 bp, Artificial Sequence
  chemically synthesized
ttttgagacggagttttgctct

SEQ ID NO: 60583 - DNA, 22 bp, Artificial Sequence
  chemically synthesized
tttgagacggagttttgctctt

SEQ ID NO: 60584 - DNA, 22 bp, Artificial Sequence
  chemically synthesized
ttgagacggagttttgctcttg

SEQ ID NO: 60585 - DNA, 22 bp, Artificial Sequence
  chemically synthesized
tgagacggagttttgctcttgt

SEQ ID NO: 60586 - DNA, 22 bp, Artificial Sequence
  chemically synthesized
gagacggagttttgctcttgtt

SEQ ID NO: 60587 - DNA, 22 bp, Artificial Sequence
  chemically synthesized
agacggagttttgctcttgttg

SEQ ID NO: 60588 - DNA, 22 bp, Artificial Sequence
  chemically synthesized
tgctcttgttgcccaggctaga

SEQ ID NO: 60589 - DNA, 22 bp, Artificial Sequence
  chemically synthesized
gctcttgttgcccaggctagag

SEQ ID NO: 60590 - DNA, 22 bp, Artificial Sequence
  chemically synthesized
ctcttgttgcccaggctagagt

SEQ ID NO: 60591 - DNA, 22 bp, Artificial Sequence
  chemically synthesized
ttgttgcccaggctagagtgca

SEQ ID NO: 60592 - DNA, 22 bp, Artificial Sequence
  chemically synthesized
gttgcccaggctagagtgcagt

SEQ ID NO: 60593 - DNA, 22 bp, Artificial Sequence
  chemically synthesized
ttgcccaggctagagtgcagtg

SEQ ID NO: 60594 - DNA, 22 bp, Artificial Sequence
  chemically synthesized
cccaggctagagtgcagtggcg

SEQ ID NO: 60595 - DNA, 22 bp, Artificial Sequence
  chemically synthesized
gagtgcagtggcgcagtctcgg

SEQ ID NO: 60596 - DNA, 22 bp, Artificial Sequence
  chemically synthesized
ggctcactgtaacctccacctc

SEQ ID NO: 60597 - DNA, 22 bp, Artificial Sequence
  chemically synthesized
actgtaacctccacctcctgag

SEQ ID NO: 60598 - DNA, 22 bp, Artificial Sequence
  chemically synthesized
taacctccacctcctgagttca

SEQ ID NO: 60599 - DNA, 22 bp, Artificial Sequence
  chemically synthesized
cacctcctgagttcaagcaatt

SEQ ID NO: 60600 - DNA, 22 bp, Artificial Sequence
  chemically synthesized
ctgagttcaagcaattctcctg

SEQ ID NO: 60601 - DNA, 22 bp, Artificial Sequence
  chemically synthesized
agttcaagcaattctcctgcct

SEQ ID NO: 60602 - DNA, 22 bp, Artificial Sequence
  chemically synthesized
aagcaattctcctgcctcagcc

SEQ ID NO: 60603 - DNA, 22 bp, Artificial Sequence
  chemically synthesized
tcctgcctcagcctctcaaata

SEQ ID NO: 60604 - DNA, 22 bp, Artificial Sequence
  chemically synthesized
ctgcctcagcctctcaaatagc

SEQ ID NO: 60605 - DNA, 22 bp, Artificial Sequence
  chemically synthesized
cctcagcctctcaaatagctgg

SEQ ID NO: 60606 - DNA, 22 bp, Artificial Sequence
  chemically synthesized
agcctctcaaatagctgggatt

SEQ ID NO: 60607 - DNA, 22 bp, Artificial Sequence
  chemically synthesized
tcaaatagctgggattacaggc

SEQ ID NO: 60608 - DNA, 22 bp, Artificial Sequence
  chemically synthesized
aaatagctgggattacaggcgt

SEQ ID NO: 60609 - DNA, 22 bp, Artificial Sequence
  chemically synthesized
ggattacaggcgtgagccaccc

SEQ ID NO: 60610 - DNA, 22 bp, Artificial Sequence
  chemically synthesized
caggcgtgagccaccccacctg

SEQ ID NO: 60611 - DNA, 22 bp, Artificial Sequence
  chemically synthesized
gctaattttgtaattttttttt

SEQ ID NO: 60612 - DNA, 22 bp, Artificial Sequence
  chemically synthesized
attttgtaattttttttttagt

SEQ ID NO: 60613 - DNA, 22 bp, Artificial Sequence
  chemically synthesized
tgtaattttttttttagtagag

SEQ ID NO: 60614 - DNA, 22 bp, Artificial Sequence
  chemically synthesized
gtaattttttttttagtagaga

SEQ ID NO: 60615 - DNA, 22 bp, Artificial Sequence
  chemically synthesized
taattttttttttagtagagat

SEQ ID NO: 60616 - DNA, 22 bp, Artificial Sequence
  chemically synthesized
tttttttagtagagatggggtt

SEQ ID NO: 60617 - DNA, 22 bp, Artificial Sequence
  chemically synthesized
ttttttagtagagatggggttt

SEQ ID NO: 60618 - DNA, 22 bp, Artificial Sequence
  chemically synthesized
tttttagtagagatggggtttc

SEQ ID NO: 60619 - DNA, 22 bp, Artificial Sequence
  chemically synthesized
ttttagtagagatggggtttca

SEQ ID NO: 60620 - DNA, 22 bp, Artificial Sequence
  chemically synthesized
tttagtagagatggggtttcac

SEQ ID NO: 60621 - DNA, 22 bp, Artificial Sequence
  chemically synthesized
ttagtagagatggggtttcacc

SEQ ID NO: 60622 - DNA, 22 bp, Artificial Sequence
  chemically synthesized
tagtagagatggggtttcacct

SEQ ID NO: 60623 - DNA, 22 bp, Artificial Sequence
  chemically synthesized
agtagagatggggtttcacctg

SEQ ID NO: 60624 - DNA, 22 bp, Artificial Sequence
  chemically synthesized
gtagagatggggtttcacctgt

SEQ ID NO: 60625 - DNA, 22 bp, Artificial Sequence
  chemically synthesized
cacctgttgatcaggctggtct

SEQ ID NO: 60626 - DNA, 22 bp, Artificial Sequence
  chemically synthesized
acctgttgatcaggctggtctc

SEQ ID NO: 60627 - DNA, 22 bp, Artificial Sequence
  chemically synthesized
ttgatcaggctggtctcaaact

SEQ ID NO: 60628 - DNA, 22 bp, Artificial Sequence
  chemically synthesized
atcaggctggtctcaaactcct

SEQ ID NO: 60629 - DNA, 22 bp, Artificial Sequence
  chemically synthesized
gtctcaaactcctgacctcaag

SEQ ID NO: 60630 - DNA, 22 bp, Artificial Sequence
  chemically synthesized
aaactcctgacctcaagtgatc

SEQ ID NO: 60631 - DNA, 22 bp, Artificial Sequence
  chemically synthesized
ctgacctcaagtgatccaccca

SEQ ID NO: 60632 - DNA, 22 bp, Artificial Sequence
  chemically synthesized
acctcaagtgatccacccacct

SEQ ID NO: 60633 - DNA, 22 bp, Artificial Sequence
  chemically synthesized
aagtgatccacccacctcggcc

SEQ ID NO: 60634 - DNA, 22 bp, Artificial Sequence
  chemically synthesized
ggcctcccaaagtgctgggatt

SEQ ID NO: 60635 - DNA, 22 bp, Artificial Sequence
  chemically synthesized
ccaaagtgctgggattacaagc

SEQ ID NO: 60636 - DNA, 22 bp, Artificial Sequence
  chemically synthesized
ggattacaagcataagccaccg

SEQ ID NO: 60637 - DNA, 22 bp, Artificial Sequence
  chemically synthesized
caagcataagccaccgtgcctg

SEQ ID NO: 60638 - DNA, 22 bp, Artificial Sequence
  chemically synthesized
gtcaattttgatcttttttaaa

SEQ ID NO: 60639 - DNA, 22 bp, Artificial Sequence
  chemically synthesized
tgatcttttttaaagagacagg

SEQ ID NO: 60640 - DNA, 22 bp, Artificial Sequence
  chemically synthesized
gatcttttttaaagagacaggg

SEQ ID NO: 60641 - DNA, 22 bp, Artificial Sequence
  chemically synthesized
atcttttttaaagagacagggg

SEQ ID NO: 60642 - DNA, 22 bp, Artificial Sequence
  chemically synthesized
ttttaaagagacaggggtcttg

SEQ ID NO: 60643 - DNA, 22 bp, Artificial Sequence
  chemically synthesized
tttaaagagacaggggtcttgc

SEQ ID NO: 60644 - DNA, 22 bp, Artificial Sequence
  chemically synthesized
ttaaagagacaggggtcttgct

SEQ ID NO: 60645 - DNA, 22 bp, Artificial Sequence
  chemically synthesized
taaagagacaggggtcttgcta

SEQ ID NO: 60646 - DNA, 22 bp, Artificial Sequence
  chemically synthesized
aaagagacaggggtcttgctat

SEQ ID NO: 60647 - DNA, 22 bp, Artificial Sequence
  chemically synthesized
aagagacaggggtcttgctatg

SEQ ID NO: 60648 - DNA, 22 bp, Artificial Sequence
  chemically synthesized
gctatgttgcccagactagtct

SEQ ID NO: 60649 - DNA, 22 bp, Artificial Sequence
  chemically synthesized
ctatgttgcccagactagtctt

SEQ ID NO: 60650 - DNA, 22 bp, Artificial Sequence
  chemically synthesized
tgttgcccagactagtcttgaa

SEQ ID NO: 60651 - DNA, 22 bp, Artificial Sequence
  chemically synthesized
cccagactagtcttgaactcct

SEQ ID NO: 60652 - DNA, 22 bp, Artificial Sequence
  chemically synthesized
gtcttgaactcctggcctcaag

SEQ ID NO: 60653 - DNA, 22 bp, Artificial Sequence
  chemically synthesized
gaactcctggcctcaagtgatc

SEQ ID NO: 60654 - DNA, 22 bp, Artificial Sequence
  chemically synthesized
aactcctggcctcaagtgatcc

SEQ ID NO: 60655 - DNA, 22 bp, Artificial Sequence
  chemically synthesized
ctggcctcaagtgatcctctca

SEQ ID NO: 60656 - DNA, 22 bp, Artificial Sequence
  chemically synthesized
gcctcaagtgatcctctcacct

SEQ ID NO: 60657 - DNA, 22 bp, Artificial Sequence
  chemically synthesized
aagtgatcctctcacctcggcc

SEQ ID NO: 60658 - DNA, 22 bp, Artificial Sequence
  chemically synthesized
tcacctcggcctcccaaagtat

SEQ ID NO: 60659 - DNA, 22 bp, Artificial Sequence
  chemically synthesized
acctcggcctcccaaagtattg

SEQ ID NO: 60660 - DNA, 22 bp, Artificial Sequence
  chemically synthesized
ggcctcccaaagtattgggatt

SEQ ID NO: 60661 - DNA, 22 bp, Artificial Sequence
  chemically synthesized
ccaaagtattgggattacaggt

SEQ ID NO: 60662 - DNA, 22 bp, Artificial Sequence
  chemically synthesized
ggattacaggtctgagccgctg

SEQ ID NO: 60663 - DNA, 22 bp, Artificial Sequence
  chemically synthesized
caggtctgagccgctgcaccca

SEQ ID NO: 60664 - DNA, 22 bp, Artificial Sequence
  chemically synthesized
agccgctgcacccagcccccaa

SEQ ID NO: 60665 - DNA, 22 bp, Artificial Sequence
  chemically synthesized
cacccagcccccaacaggcatc

SEQ ID NO: 60666 - DNA, 22 bp, Artificial Sequence
  chemically synthesized
tggacttttgagtactggcttt

SEQ ID NO: 60667 - DNA, 22 bp, Artificial Sequence
  chemically synthesized
ggacttttgagtactggcttta

SEQ ID NO: 60668 - DNA, 22 bp, Artificial Sequence
  chemically synthesized
gacttttgagtactggctttaa

SEQ ID NO: 60669 - DNA, 22 bp, Artificial Sequence
  chemically synthesized
ttgagtactggctttaatttac

SEQ ID NO: 60670 - DNA, 22 bp, Artificial Sequence
  chemically synthesized
tgagtactggctttaatttaca

SEQ ID NO: 60671 - DNA, 22 bp, Artificial Sequence
  chemically synthesized
gagtactggctttaatttacaa

SEQ ID NO: 60672 - DNA, 22 bp, Artificial Sequence
  chemically synthesized
agtactggctttaatttacaaa

SEQ ID NO: 60673 - DNA, 22 bp, Artificial Sequence
  chemically synthesized
gctttaatttacaaaaattcca

SEQ ID NO: 60674 - DNA, 22 bp, Artificial Sequence
  chemically synthesized
taatttacaaaaattccactga

SEQ ID NO: 60675 - DNA, 22 bp, Artificial Sequence
  chemically synthesized
aatttacaaaaattccactgag

SEQ ID NO: 60676 - DNA, 22 bp, Artificial Sequence
  chemically synthesized
atttacaaaaattccactgaga

SEQ ID NO: 60677 - DNA, 22 bp, Artificial Sequence
  chemically synthesized
acaaaaattccactgagagcac

SEQ ID NO: 60678 - DNA, 22 bp, Artificial Sequence
  chemically synthesized
caaaaattccactgagagcacc

SEQ ID NO: 60679 - DNA, 22 bp, Artificial Sequence
  chemically synthesized
cactgagagcacctaagtttgc

SEQ ID NO: 60680 - DNA, 22 bp, Artificial Sequence
  chemically synthesized
agagcacctaagtttgccaggc

SEQ ID NO: 60681 - DNA, 22 bp, Artificial Sequence
  chemically synthesized
agtttgccaggctccaacattt

SEQ ID NO: 60682 - DNA, 22 bp, Artificial Sequence
  chemically synthesized
gccaggctccaacatttctgca

SEQ ID NO: 60683 - DNA, 22 bp, Artificial Sequence
  chemically synthesized
ccaggctccaacatttctgcag

SEQ ID NO: 60684 - DNA, 22 bp, Artificial Sequence
  chemically synthesized
caacatttctgcaggggctgtt

SEQ ID NO: 60685 - DNA, 22 bp, Artificial Sequence
  chemically synthesized
ctgcaggggctgttttctttgc

SEQ ID NO: 60686 - DNA, 22 bp, Artificial Sequence
  chemically synthesized
tgcaggggctgttttctttgct

SEQ ID NO: 60687 - DNA, 22 bp, Artificial Sequence
  chemically synthesized
caggggctgttttctttgctga

SEQ ID NO: 60688 - DNA, 22 bp, Artificial Sequence
  chemically synthesized
ttttctttgctgaaggatctgc

SEQ ID NO: 60689 - DNA, 22 bp, Artificial Sequence
  chemically synthesized
tctttgctgaaggatctgcacc

SEQ ID NO: 60690 - DNA, 22 bp, Artificial Sequence
  chemically synthesized
ctttgctgaaggatctgcacct

SEQ ID NO: 60691 - DNA, 22 bp, Artificial Sequence
  chemically synthesized
tttgctgaaggatctgcacctg

SEQ ID NO: 60692 - DNA, 22 bp, Artificial Sequence
  chemically synthesized
tgctgaaggatctgcacctgtg

SEQ ID NO: 60693 - DNA, 22 bp, Artificial Sequence
  chemically synthesized
gctgaaggatctgcacctgtgt

SEQ ID NO: 60694 - DNA, 22 bp, Artificial Sequence
  chemically synthesized
ctgaaggatctgcacctgtgtt

SEQ ID NO: 60695 - DNA, 22 bp, Artificial Sequence
  chemically synthesized
aaggatctgcacctgtgttctg

SEQ ID NO: 60696 - DNA, 22 bp, Artificial Sequence
  chemically synthesized
cacctgtgttctgttatggttg

SEQ ID NO: 60697 - DNA, 22 bp, Artificial Sequence
  chemically synthesized
tgttctgttatggttgcctctt

SEQ ID NO: 60698 - DNA, 22 bp, Artificial Sequence
  chemically synthesized
tgttatggttgcctcttctgtt

SEQ ID NO: 60699 - DNA, 22 bp, Artificial Sequence
  chemically synthesized
ttatggttgcctcttctgttgc

SEQ ID NO: 60700 - DNA, 22 bp, Artificial Sequence
  chemically synthesized
tggttgcctcttctgttgcagg

SEQ ID NO: 60701 - DNA, 22 bp, Artificial Sequence
  chemically synthesized
cctcttctgttgcaggtgcttg

SEQ ID NO: 60702 - DNA, 22 bp, Artificial Sequence
  chemically synthesized
ttctgttgcaggtgcttgaatg

SEQ ID NO: 60703 - DNA, 22 bp, Artificial Sequence
  chemically synthesized
ctgttgcaggtgcttgaatgtc

SEQ ID NO: 60704 - DNA, 22 bp, Artificial Sequence
  chemically synthesized
tgttgcaggtgcttgaatgtca

SEQ ID NO: 60705 - DNA, 22 bp, Artificial Sequence
  chemically synthesized
ttgcaggtgcttgaatgtcatt

SEQ ID NO: 60706 - DNA, 22 bp, Artificial Sequence
  chemically synthesized
caggtgcttgaatgtcattttg

SEQ ID NO: 60707 - DNA, 22 bp, Artificial Sequence
  chemically synthesized
gaatgtcattttgtggttggga

SEQ ID NO: 60708 - DNA, 22 bp, Artificial Sequence
  chemically synthesized
aatgtcattttgtggttgggat

SEQ ID NO: 60709 - DNA, 22 bp, Artificial Sequence
  chemically synthesized
tgtggttgggattctgggctgt

SEQ ID NO: 60710 - DNA, 22 bp, Artificial Sequence
  chemically synthesized
gtggttgggattctgggctgtg

SEQ ID NO: 60711 - DNA, 22 bp, Artificial Sequence
  chemically synthesized
tggttgggattctgggctgtgc

SEQ ID NO: 60712 - DNA, 22 bp, Artificial Sequence
  chemically synthesized
ggattctgggctgtgcagctga

SEQ ID NO: 60713 - DNA, 22 bp, Artificial Sequence
  chemically synthesized
tgggctgtgcagctgaatgtct

SEQ ID NO: 60714 - DNA, 22 bp, Artificial Sequence
  chemically synthesized
ggctgtgcagctgaatgtctgt

SEQ ID NO: 60715 - DNA, 22 bp, Artificial Sequence
  chemically synthesized
tgcagctgaatgtctgtctgtc

SEQ ID NO: 60716 - DNA, 22 bp, Artificial Sequence
  chemically synthesized
aatgtctgtctgtcacgaatct

SEQ ID NO: 60717 - DNA, 22 bp, Artificial Sequence
  chemically synthesized
tctgtcacgaatctaccttgct

SEQ ID NO: 60718 - DNA, 22 bp, Artificial Sequence
  chemically synthesized
tcacgaatctaccttgctgctc

SEQ ID NO: 60719 - DNA, 22 bp, Artificial Sequence
  chemically synthesized
ccttgctgctcattttcctcat

SEQ ID NO: 60720 - DNA, 22 bp, Artificial Sequence
  chemically synthesized
gctgctcattttcctcatcaag

SEQ ID NO: 60721 - DNA, 22 bp, Artificial Sequence
  chemically synthesized
ctgctcattttcctcatcaagt

SEQ ID NO: 60722 - DNA, 22 bp, Artificial Sequence
  chemically synthesized
ctcattttcctcatcaagttgt

SEQ ID NO: 60723 - DNA, 22 bp, Artificial Sequence
  chemically synthesized
attttcctcatcaagttgttgc

SEQ ID NO: 60724 - DNA, 22 bp, Artificial Sequence
  chemically synthesized
tcctcatcaagttgttgctgga

SEQ ID NO: 60725 - DNA, 22 bp, Artificial Sequence
  chemically synthesized
cctcatcaagttgttgctggag

SEQ ID NO: 60726 - DNA, 22 bp, Artificial Sequence
  chemically synthesized
ctcatcaagttgttgctggagt

SEQ ID NO: 60727 - DNA, 22 bp, Artificial Sequence
  chemically synthesized
atcaagttgttgctggagtcct

SEQ ID NO: 60728 - DNA, 22 bp, Artificial Sequence
  chemically synthesized
ttgctggagtcctgtcaggtat

SEQ ID NO: 60729 - DNA, 22 bp, Artificial Sequence
  chemically synthesized
ctggagtcctgtcaggtatggg

SEQ ID NO: 60730 - DNA, 22 bp, Artificial Sequence
  chemically synthesized
gagtcctgtcaggtatgggctg

SEQ ID NO: 60731 - DNA, 22 bp, Artificial Sequence
  chemically synthesized
tcaggtatgggctgatctgact

SEQ ID NO: 60732 - DNA, 22 bp, Artificial Sequence
  chemically synthesized
atctgactcccttccttctccc

SEQ ID NO: 60733 - DNA, 22 bp, Artificial Sequence
  chemically synthesized
actcccttccttctcccccaaa

SEQ ID NO: 60734 - DNA, 22 bp, Artificial Sequence
  chemically synthesized
ccttccttctcccccaaacccc

SEQ ID NO: 60735 - DNA, 22 bp, Artificial Sequence
  chemically synthesized
ccttctcccccaaaccccattc

SEQ ID NO: 60736 - DNA, 22 bp, Artificial Sequence
  chemically synthesized
cttctcccccaaaccccattcc

SEQ ID NO: 60737 - DNA, 22 bp, Artificial Sequence
  chemically synthesized
ctcccccaaaccccattccgtt

SEQ ID NO: 60738 - DNA, 22 bp, Artificial Sequence
  chemically synthesized
tcccccaaaccccattccgttt

SEQ ID NO: 60739 - DNA, 22 bp, Artificial Sequence
  chemically synthesized
ccccaaaccccattccgtttct

SEQ ID NO: 60740 - DNA, 22 bp, Artificial Sequence
  chemically synthesized
cgtttctctccctaatcaggac

SEQ ID NO: 60741 - DNA, 22 bp, Artificial Sequence
  chemically synthesized
ctctccctaatcaggacaaaat

SEQ ID NO: 60742 - DNA, 22 bp, Artificial Sequence
  chemically synthesized
tctccctaatcaggacaaaatc

SEQ ID NO: 60743 - DNA, 22 bp, Artificial Sequence
  chemically synthesized
tccctaatcaggacaaaatccc

SEQ ID NO: 60744 - DNA, 22 bp, Artificial Sequence
  chemically synthesized
cctaatcaggacaaaatcccag

SEQ ID NO: 60745 - DNA, 22 bp, Artificial Sequence
  chemically synthesized
atcaggacaaaatcccagcatt

SEQ ID NO: 60746 - DNA, 22 bp, Artificial Sequence
  chemically synthesized
cagccacatcctgtgtgtaatc

SEQ ID NO: 60747 - DNA, 22 bp, Artificial Sequence
  chemically synthesized
tgtgtaatcagtactgttagca

SEQ ID NO: 60748 - DNA, 22 bp, Artificial Sequence
  chemically synthesized
ttagcatttctgtgggttgaaa

SEQ ID NO: 60749 - DNA, 22 bp, Artificial Sequence
  chemically synthesized
gcatttctgtgggttgaaagtc

SEQ ID NO: 60750 - DNA, 22 bp, Artificial Sequence
  chemically synthesized
ctgtgggttgaaagtcaagaat

SEQ ID NO: 60751 - DNA, 22 bp, Artificial Sequence
  chemically synthesized
tgtgggttgaaagtcaagaatg

SEQ ID NO: 60752 - DNA, 22 bp, Artificial Sequence
  chemically synthesized
tgggttgaaagtcaagaatgag

SEQ ID NO: 60753 - DNA, 22 bp, Artificial Sequence
  chemically synthesized
aaagtcaagaatgagcaacttg

SEQ ID NO: 60754 - DNA, 22 bp, Artificial Sequence
  chemically synthesized
gaaatgattaatttctataaga

SEQ ID NO: 60755 - DNA, 22 bp, Artificial Sequence
  chemically synthesized
aaatgattaatttctataagag

SEQ ID NO: 60756 - DNA, 22 bp, Artificial Sequence
  chemically synthesized
atttctataagagtgcccagat

SEQ ID NO: 60757 - DNA, 22 bp, Artificial Sequence
  chemically synthesized
ctataagagtgcccagatctat

SEQ ID NO: 60758 - DNA, 22 bp, Artificial Sequence
  chemically synthesized
tataagagtgcccagatctata

SEQ ID NO: 60759 - DNA, 22 bp, Artificial Sequence
  chemically synthesized
taagagtgcccagatctataga

SEQ ID NO: 60760 - DNA, 22 bp, Artificial Sequence
  chemically synthesized
tagaatgaattgtgtagaagtt

SEQ ID NO: 60761 - DNA, 22 bp, Artificial Sequence
  chemically synthesized
tgtagaagttaccatacatcaa

SEQ ID NO: 60762 - DNA, 22 bp, Artificial Sequence
  chemically synthesized
ccatacatcaaattaacgcacc

SEQ ID NO: 60763 - DNA, 22 bp, Artificial Sequence
  chemically synthesized
acgcaccaaattgaattagctt

SEQ ID NO: 60764 - DNA, 22 bp, Artificial Sequence
  chemically synthesized
aattagcttgaaatctcagagc

SEQ ID NO: 60765 - DNA, 22 bp, Artificial Sequence
  chemically synthesized
gcttgaaatctcagagcttttt

SEQ ID NO: 60766 - DNA, 22 bp, Artificial Sequence
  chemically synthesized
gaaatctcagagctttttacaa

SEQ ID NO: 60767 - DNA, 22 bp, Artificial Sequence
  chemically synthesized
aaatctcagagctttttacaat

SEQ ID NO: 60768 - DNA, 22 bp, Artificial Sequence
  chemically synthesized
agagctttttacaatctttatt

SEQ ID NO: 60769 - DNA, 22 bp, Artificial Sequence
  chemically synthesized
tttacaatctttatttcttact

SEQ ID NO: 60770 - DNA, 22 bp, Artificial Sequence
  chemically synthesized
ttacaatctttatttcttactg

SEQ ID NO: 60771 - DNA, 22 bp, Artificial Sequence
  chemically synthesized
tacaatctttatttcttactgg

SEQ ID NO: 60772 - DNA, 22 bp, Artificial Sequence
  chemically synthesized
acaatctttatttcttactggt

SEQ ID NO: 60773 - DNA, 22 bp, Artificial Sequence
  chemically synthesized
caatctttatttcttactggtc

SEQ ID NO: 60774 - DNA, 22 bp, Artificial Sequence
  chemically synthesized
tatttcttactggtcttcaaca

SEQ ID NO: 60775 - DNA, 22 bp, Artificial Sequence
  chemically synthesized
atttcttactggtcttcaacag

SEQ ID NO: 60776 - DNA, 22 bp, Artificial Sequence
  chemically synthesized
tttcttactggtcttcaacagg

SEQ ID NO: 60777 - DNA, 22 bp, Artificial Sequence
  chemically synthesized
cttactggtcttcaacaggccc

SEQ ID NO: 60778 - DNA, 22 bp, Artificial Sequence
  chemically synthesized
ttactggtcttcaacaggccct

SEQ ID NO: 60779 - DNA, 22 bp, Artificial Sequence
  chemically synthesized
actggtcttcaacaggccctaa

SEQ ID NO: 60780 - DNA, 22 bp, Artificial Sequence
  chemically synthesized
ctggtcttcaacaggccctaat

SEQ ID NO: 60781 - DNA, 22 bp, Artificial Sequence
  chemically synthesized
gtcttcaacaggccctaattta

SEQ ID NO: 60782 - DNA, 22 bp, Artificial Sequence
  chemically synthesized
caacaggccctaatttactttt

SEQ ID NO: 60783 - DNA, 22 bp, Artificial Sequence
  chemically synthesized
aacaggccctaatttacttttc

SEQ ID NO: 60784 - DNA, 22 bp, Artificial Sequence
  chemically synthesized
atttacttttcagggaatctgc

SEQ ID NO: 60785 - DNA, 22 bp, Artificial Sequence
  chemically synthesized
acttttcagggaatctgccaaa

SEQ ID NO: 60786 - DNA, 22 bp, Artificial Sequence
  chemically synthesized
cttttcagggaatctgccaaat

SEQ ID NO: 60787 - DNA, 22 bp, Artificial Sequence
  chemically synthesized
ttcagggaatctgccaaattta

SEQ ID NO: 60788 - DNA, 22 bp, Artificial Sequence
  chemically synthesized
tcagggaatctgccaaatttaa

SEQ ID NO: 60789 - DNA, 22 bp, Artificial Sequence
  chemically synthesized
cagggaatctgccaaatttaac

SEQ ID NO: 60790 - DNA, 22 bp, Artificial Sequence
  chemically synthesized
agggaatctgccaaatttaaca

SEQ ID NO: 60791 - DNA, 22 bp, Artificial Sequence
  chemically synthesized
ccaaatttaacaaattaacacg

SEQ ID NO: 60792 - DNA, 22 bp, Artificial Sequence
  chemically synthesized
aacaaattaacacgatgtccta

SEQ ID NO: 60793 - DNA, 22 bp, Artificial Sequence
  chemically synthesized
acaaattaacacgatgtcctag

SEQ ID NO: 60794 - DNA, 22 bp, Artificial Sequence
  chemically synthesized
acacgatgtcctaggaaagctg

SEQ ID NO: 60795 - DNA, 22 bp, Artificial Sequence
  chemically synthesized
ggaaagctgttcatttaaatac

SEQ ID NO: 60796 - DNA, 22 bp, Artificial Sequence
  chemically synthesized
ttcatttaaatacattcatttg

SEQ ID NO: 60797 - DNA, 22 bp, Artificial Sequence
  chemically synthesized
atttaaatacattcatttgcaa

SEQ ID NO: 60798 - DNA, 22 bp, Artificial Sequence
  chemically synthesized
aaatacattcatttgcaaacct

SEQ ID NO: 60799 - DNA, 22 bp, Artificial Sequence
  chemically synthesized
aatacattcatttgcaaaccta

SEQ ID NO: 60800 - DNA, 22 bp, Artificial Sequence
  chemically synthesized
atttgcaaacctaatagataac

SEQ ID NO: 60801 - DNA, 22 bp, Artificial Sequence
  chemically synthesized
gcaaacctaatagataactgca

SEQ ID NO: 60802 - DNA, 22 bp, Artificial Sequence
  chemically synthesized
caaacctaatagataactgcag

SEQ ID NO: 60803 - DNA, 22 bp, Artificial Sequence
  chemically synthesized
atagataactgcagttgatctc

SEQ ID NO: 60804 - DNA, 22 bp, Artificial Sequence
  chemically synthesized
cagttgatctcttttataggtt

SEQ ID NO: 60805 - DNA, 22 bp, Artificial Sequence
  chemically synthesized
atctcttttataggttcagagt

SEQ ID NO: 60806 - DNA, 22 bp, Artificial Sequence
  chemically synthesized
ttttataggttcagagttttga

SEQ ID NO: 60807 - DNA, 22 bp, Artificial Sequence
  chemically synthesized
ttataggttcagagttttgaat

SEQ ID NO: 60808 - DNA, 22 bp, Artificial Sequence
  chemically synthesized
tataggttcagagttttgaata

SEQ ID NO: 60809 - DNA, 22 bp, Artificial Sequence
  chemically synthesized
ataggttcagagttttgaatat

SEQ ID NO: 60810 - DNA, 22 bp, Artificial Sequence
  chemically synthesized
taggttcagagttttgaatatg

SEQ ID NO: 60811 - DNA, 22 bp, Artificial Sequence
  chemically synthesized
agagttttgaatatgttttttt

SEQ ID NO: 60812 - DNA, 22 bp, Artificial Sequence
  chemically synthesized
tgaatatgtttttttttgtttt

SEQ ID NO: 60813 - DNA, 22 bp, Artificial Sequence
  chemically synthesized
gaatatgtttttttttgttttt

SEQ ID NO: 60814 - DNA, 22 bp, Artificial Sequence
  chemically synthesized
aatatgtttttttttgtttttt

SEQ ID NO: 60815 - DNA, 22 bp, Artificial Sequence
  chemically synthesized
ttttttgttttttttttttgag

SEQ ID NO: 60816 - DNA, 22 bp, Artificial Sequence
  chemically synthesized
tttttgttttttttttttgaga

SEQ ID NO: 60817 - DNA, 22 bp, Artificial Sequence
  chemically synthesized
ttttgttttttttttttgagat

SEQ ID NO: 60818 - DNA, 22 bp, Artificial Sequence
  chemically synthesized
tttgttttttttttttgagatg

SEQ ID NO: 60819 - DNA, 22 bp, Artificial Sequence
  chemically synthesized
ttgttttttttttttgagatgg

SEQ ID NO: 60820 - DNA, 22 bp, Artificial Sequence
  chemically synthesized
tgttttttttttttgagatgga

SEQ ID NO: 60821 - DNA, 22 bp, Artificial Sequence
  chemically synthesized
gttttttttttttgagatggag

SEQ ID NO: 60822 - DNA, 22 bp, Artificial Sequence
  chemically synthesized
ttttttttttttgagatggagt

SEQ ID NO: 60823 - DNA, 22 bp, Artificial Sequence
  chemically synthesized
tttttttttgagatggagtctc

SEQ ID NO: 60824 - DNA, 22 bp, Artificial Sequence
  chemically synthesized
ttttttttgagatggagtctcg

SEQ ID NO: 60825 - DNA, 22 bp, Artificial Sequence
  chemically synthesized
tttttttgagatggagtctcgc

SEQ ID NO: 60826 - DNA, 22 bp, Artificial Sequence
  chemically synthesized
ttttttgagatggagtctcgct

SEQ ID NO: 60827 - DNA, 22 bp, Artificial Sequence
  chemically synthesized
tttttgagatggagtctcgctc

SEQ ID NO: 60828 - DNA, 22 bp, Artificial Sequence
  chemically synthesized
ttttgagatggagtctcgctct

SEQ ID NO: 60829 - DNA, 22 bp, Artificial Sequence
  chemically synthesized
tttgagatggagtctcgctctg

SEQ ID NO: 60830 - DNA, 22 bp, Artificial Sequence
  chemically synthesized
ttgagatggagtctcgctctgt

SEQ ID NO: 60831 - DNA, 22 bp, Artificial Sequence
  chemically synthesized
tgagatggagtctcgctctgtg

SEQ ID NO: 60832 - DNA, 22 bp, Artificial Sequence
  chemically synthesized
gagatggagtctcgctctgtga

SEQ ID NO: 60833 - DNA, 22 bp, Artificial Sequence
  chemically synthesized
agatggagtctcgctctgtgac

SEQ ID NO: 60834 - DNA, 22 bp, Artificial Sequence
  chemically synthesized
gctctgtgacccaggctagagt

SEQ ID NO: 60835 - DNA, 22 bp, Artificial Sequence
  chemically synthesized
tgtgacccaggctagagtgcag

SEQ ID NO: 60836 - DNA, 22 bp, Artificial Sequence
  chemically synthesized
tgacccaggctagagtgcagtg

SEQ ID NO: 60837 - DNA, 22 bp, Artificial Sequence
  chemically synthesized
gagtgcagtggtgcgatctcgg

SEQ ID NO: 60838 - DNA, 22 bp, Artificial Sequence
  chemically synthesized
ggctcactgcaagctccacctc

SEQ ID NO: 60839 - DNA, 22 bp, Artificial Sequence
  chemically synthesized
actgcaagctccacctcctggg

SEQ ID NO: 60840 - DNA, 22 bp, Artificial Sequence
  chemically synthesized
caagctccacctcctgggttca

SEQ ID NO: 60841 - DNA, 22 bp, Artificial Sequence
  chemically synthesized
cacctcctgggttcacgccatt

SEQ ID NO: 60842 - DNA, 22 bp, Artificial Sequence
  chemically synthesized
ctgggttcacgccattctcctg

SEQ ID NO: 60843 - DNA, 22 bp, Artificial Sequence
  chemically synthesized
ggttcacgccattctcctgcct

SEQ ID NO: 60844 - DNA, 22 bp, Artificial Sequence
  chemically synthesized
acgccattctcctgcctcagcc

SEQ ID NO: 60845 - DNA, 22 bp, Artificial Sequence
  chemically synthesized
tcctgcctcagcctctccgagt

SEQ ID NO: 60846 - DNA, 22 bp, Artificial Sequence
  chemically synthesized
ctgcctcagcctctccgagtag

SEQ ID NO: 60847 - DNA, 22 bp, Artificial Sequence
  chemically synthesized
cctcagcctctccgagtagctg

SEQ ID NO: 60848 - DNA, 22 bp, Artificial Sequence
  chemically synthesized
agcctctccgagtagctgggac

SEQ ID NO: 60849 - DNA, 22 bp, Artificial Sequence
  chemically synthesized
tccgagtagctgggactacagg

SEQ ID NO: 60850 - DNA, 22 bp, Artificial Sequence
  chemically synthesized
cgagtagctgggactacaggcg

SEQ ID NO: 60851 - DNA, 22 bp, Artificial Sequence
  chemically synthesized
ggactacaggcgcccgccacca

SEQ ID NO: 60852 - DNA, 22 bp, Artificial Sequence
  chemically synthesized
caggcgcccgccaccatgcccg

SEQ ID NO: 60853 - DNA, 22 bp, Artificial Sequence
  chemically synthesized
attttttgtatttttagcagag

SEQ ID NO: 60854 - DNA, 22 bp, Artificial Sequence
  chemically synthesized
tttgtatttttagcagagacgg

SEQ ID NO: 60855 - DNA, 22 bp, Artificial Sequence
  chemically synthesized
ttgtatttttagcagagacggg

SEQ ID NO: 60856 - DNA, 22 bp, Artificial Sequence
  chemically synthesized
tgtatttttagcagagacgggg

SEQ ID NO: 60857 - DNA, 22 bp, Artificial Sequence
  chemically synthesized
gtatttttagcagagacggggt

SEQ ID NO: 60858 - DNA, 22 bp, Artificial Sequence
  chemically synthesized
tatttttagcagagacggggtt

SEQ ID NO: 60859 - DNA, 22 bp, Artificial Sequence
  chemically synthesized
ttagcagagacggggtttcacc

SEQ ID NO: 60860 - DNA, 22 bp, Artificial Sequence
  chemically synthesized
tagcagagacggggtttcaccg

SEQ ID NO: 60861 - DNA, 22 bp, Artificial Sequence
  chemically synthesized
agcagagacggggtttcaccgt

SEQ ID NO: 60862 - DNA, 22 bp, Artificial Sequence
  chemically synthesized
gcagagacggggtttcaccgtg

SEQ ID NO: 60863 - DNA, 22 bp, Artificial Sequence
  chemically synthesized
caccgtggtcttgatctcctga

SEQ ID NO: 60864 - DNA, 22 bp, Artificial Sequence
  chemically synthesized
accgtggtcttgatctcctgac

SEQ ID NO: 60865 - DNA, 22 bp, Artificial Sequence
  chemically synthesized
gatctcctgacctcgtgatccg

SEQ ID NO: 60866 - DNA, 22 bp, Artificial Sequence
  chemically synthesized
atctcctgacctcgtgatccgc

SEQ ID NO: 60867 - DNA, 22 bp, Artificial Sequence
  chemically synthesized
ctgacctcgtgatccgcccgcc

SEQ ID NO: 60868 - DNA, 22 bp, Artificial Sequence
  chemically synthesized
acctcgtgatccgcccgcctcg

SEQ ID NO: 60869 - DNA, 22 bp, Artificial Sequence
  chemically synthesized
gtgatccgcccgcctcggcctc

SEQ ID NO: 60870 - DNA, 22 bp, Artificial Sequence
  chemically synthesized
ggcctcccaaagcgctgggatt

SEQ ID NO: 60871 - DNA, 22 bp, Artificial Sequence
  chemically synthesized
ccaaagcgctgggattacaagg

SEQ ID NO: 60872 - DNA, 22 bp, Artificial Sequence
  chemically synthesized
ggattacaagggtgagccaccg

SEQ ID NO: 60873 - DNA, 22 bp, Artificial Sequence
  chemically synthesized
caagggtgagccaccgcaccct

SEQ ID NO: 60874 - DNA, 22 bp, Artificial Sequence
  chemically synthesized
cctgaatatgtgttttcttaga

SEQ ID NO: 60875 - DNA, 22 bp, Artificial Sequence
  chemically synthesized
aatatgtgttttcttagatcca

SEQ ID NO: 60876 - DNA, 22 bp, Artificial Sequence
  chemically synthesized
tcttagatccaattaacaaggg

SEQ ID NO: 60877 - DNA, 22 bp, Artificial Sequence
  chemically synthesized
cttagatccaattaacaagggt

SEQ ID NO: 60878 - DNA, 22 bp, Artificial Sequence
  chemically synthesized
ttagatccaattaacaagggta

SEQ ID NO: 60879 - DNA, 22 bp, Artificial Sequence
  chemically synthesized
agatccaattaacaagggtaag

SEQ ID NO: 60880 - DNA, 22 bp, Artificial Sequence
  chemically synthesized
gatccaattaacaagggtaaga

SEQ ID NO: 60881 - DNA, 22 bp, Artificial Sequence
  chemically synthesized
acaagggtaagacaagatttaa

SEQ ID NO: 60882 - DNA, 22 bp, Artificial Sequence
  chemically synthesized
aagttaagcataagaaagattt

SEQ ID NO: 60883 - DNA, 22 bp, Artificial Sequence
  chemically synthesized
agttaagcataagaaagatttt

SEQ ID NO: 60884 - DNA, 22 bp, Artificial Sequence
  chemically synthesized
agcataagaaagattttgtggg

SEQ ID NO: 60885 - DNA, 22 bp, Artificial Sequence
  chemically synthesized
tgtgggaggcactggaatataa

SEQ ID NO: 60886 - DNA, 22 bp, Artificial Sequence
  chemically synthesized
gtgggaggcactggaatataag

SEQ ID NO: 60887 - DNA, 22 bp, Artificial Sequence
  chemically synthesized
tgggaggcactggaatataaga

SEQ ID NO: 60888 - DNA, 22 bp, Artificial Sequence
  chemically synthesized
gaatataagaccttaacaaaac

SEQ ID NO: 60889 - DNA, 22 bp, Artificial Sequence
  chemically synthesized
aacaaaactgtggaatttctcc

SEQ ID NO: 60890 - DNA, 22 bp, Artificial Sequence
  chemically synthesized
acaaaactgtggaatttctccc

SEQ ID NO: 60891 - DNA, 22 bp, Artificial Sequence
  chemically synthesized
tggaatttctcccctggagatt

SEQ ID NO: 60892 - DNA, 22 bp, Artificial Sequence
  chemically synthesized
ctcccctggagatttgtaagaa

SEQ ID NO: 60893 - DNA, 22 bp, Artificial Sequence
  chemically synthesized
tcccctggagatttgtaagaac

SEQ ID NO: 60894 - DNA, 22 bp, Artificial Sequence
  chemically synthesized
ccctggagatttgtaagaacgg

SEQ ID NO: 60895 - DNA, 22 bp, Artificial Sequence
  chemically synthesized
gagatttgtaagaacggaacat

SEQ ID NO: 60896 - DNA, 22 bp, Artificial Sequence
  chemically synthesized
gtaagaacggaacatagcagca

SEQ ID NO: 60897 - DNA, 22 bp, Artificial Sequence
  chemically synthesized
taagaacggaacatagcagcat

SEQ ID NO: 60898 - DNA, 22 bp, Artificial Sequence
  chemically synthesized
aaagaagaatgttgagaacaag

SEQ ID NO: 60899 - DNA, 22 bp, Artificial Sequence
  chemically synthesized
agaacaagggagataatggttt

SEQ ID NO: 60900 - DNA, 22 bp, Artificial Sequence
  chemically synthesized
catggtaatcacaaaagtaaca

SEQ ID NO: 60901 - DNA, 22 bp, Artificial Sequence
  chemically synthesized
atggtaatcacaaaagtaacac

SEQ ID NO: 60902 - DNA, 22 bp, Artificial Sequence
  chemically synthesized
agtactgggttccatgtttgag

SEQ ID NO: 60903 - DNA, 22 bp, Artificial Sequence
  chemically synthesized
gtactgggttccatgtttgagg

SEQ ID NO: 60904 - DNA, 22 bp, Artificial Sequence
  chemically synthesized
ggttccatgtttgaggaagaac

SEQ ID NO: 60905 - DNA, 22 bp, Artificial Sequence
  chemically synthesized
catgtttgaggaagaacctgga

SEQ ID NO: 60906 - DNA, 22 bp, Artificial Sequence
  chemically synthesized
gaggaagaacctggaagccata

SEQ ID NO: 60907 - DNA, 22 bp, Artificial Sequence
  chemically synthesized
aggaagaacctggaagccatat

SEQ ID NO: 60908 - DNA, 22 bp, Artificial Sequence
  chemically synthesized
gaagccatatcacatgaaaaac

SEQ ID NO: 60909 - DNA, 22 bp, Artificial Sequence
  chemically synthesized
ggaatgtttaggttagagagaa

SEQ ID NO: 60910 - DNA, 22 bp, Artificial Sequence
  chemically synthesized
aggttagagagaataactgtgt

SEQ ID NO: 60911 - DNA, 22 bp, Artificial Sequence
  chemically synthesized
ggttagagagaataactgtgtt

SEQ ID NO: 60912 - DNA, 22 bp, Artificial Sequence
  chemically synthesized
gagagaataactgtgttcaaat

SEQ ID NO: 60913 - DNA, 22 bp, Artificial Sequence
  chemically synthesized
tgttcaaatgtgtgacagaggg

SEQ ID NO: 60914 - DNA, 22 bp, Artificial Sequence
  chemically synthesized
aaatgtgtgacagagggactag

SEQ ID NO: 60915 - DNA, 22 bp, Artificial Sequence
  chemically synthesized
gattcatcacttactaactcct

SEQ ID NO: 60916 - DNA, 22 bp, Artificial Sequence
  chemically synthesized
atcacttactaactcctgcaga

SEQ ID NO: 60917 - DNA, 22 bp, Artificial Sequence
  chemically synthesized
actaactcctgcagaaagaact

SEQ ID NO: 60918 - DNA, 22 bp, Artificial Sequence
  chemically synthesized
ctaactcctgcagaaagaactg

SEQ ID NO: 60919 - DNA, 22 bp, Artificial Sequence
  chemically synthesized
actcctgcagaaagaactgaga

SEQ ID NO: 60920 - DNA, 22 bp, Artificial Sequence
  chemically synthesized
ctgcagaaagaactgagaaaaa

SEQ ID NO: 60921 - DNA, 22 bp, Artificial Sequence
  chemically synthesized
cagaaagaactgagaaaaatag

SEQ ID NO: 60922 - DNA, 22 bp, Artificial Sequence
  chemically synthesized
agaaaaatagacagtattagag

SEQ ID NO: 60923 - DNA, 22 bp, Artificial Sequence
  chemically synthesized
gagggggaccagtttcacacag

SEQ ID NO: 60924 - DNA, 22 bp, Artificial Sequence
  chemically synthesized
cacacagacaaggaagaactat

SEQ ID NO: 60925 - DNA, 22 bp, Artificial Sequence
  chemically synthesized
acacagacaaggaagaactatt

SEQ ID NO: 60926 - DNA, 22 bp, Artificial Sequence
  chemically synthesized
ttcagcaatcaattccgttcaa

SEQ ID NO: 60927 - DNA, 22 bp, Artificial Sequence
  chemically synthesized
agcaatcaattccgttcaaaga

SEQ ID NO: 60928 - DNA, 22 bp, Artificial Sequence
  chemically synthesized
cgttcaaagataaaatggactg

SEQ ID NO: 60929 - DNA, 22 bp, Artificial Sequence
  chemically synthesized
aaagataaaatggactgttata

SEQ ID NO: 60930 - DNA, 22 bp, Artificial Sequence
  chemically synthesized
ttatagtgggggtgagctccct

SEQ ID NO: 60931 - DNA, 22 bp, Artificial Sequence
  chemically synthesized
tagtgggggtgagctccctacc

SEQ ID NO: 60932 - DNA, 22 bp, Artificial Sequence
  chemically synthesized
cctacctctgagggtatttcaa

SEQ ID NO: 60933 - DNA, 22 bp, Artificial Sequence
  chemically synthesized
cctctgagggtatttcaagtag

SEQ ID NO: 60934 - DNA, 22 bp, Artificial Sequence
  chemically synthesized
tgagggtatttcaagtagagat

SEQ ID NO: 60935 - DNA, 22 bp, Artificial Sequence
  chemically synthesized
agggtatttcaagtagagatag

SEQ ID NO: 60936 - DNA, 22 bp, Artificial Sequence
  chemically synthesized
caagtagagataggaggacctc

SEQ ID NO: 60937 - DNA, 22 bp, Artificial Sequence
  chemically synthesized
aagtagagataggaggacctcc

SEQ ID NO: 60938 - DNA, 22 bp, Artificial Sequence
  chemically synthesized
ctggtaggaaatttgcatacgg

SEQ ID NO: 60939 - DNA, 22 bp, Artificial Sequence
  chemically synthesized
gtaggaaatttgcatacggtgg

SEQ ID NO: 60940 - DNA, 22 bp, Artificial Sequence
  chemically synthesized
gcatacggtgggagattgtacg

SEQ ID NO: 60941 - DNA, 22 bp, Artificial Sequence
  chemically synthesized
catacggtgggagattgtacgt

SEQ ID NO: 60942 - DNA, 22 bp, Artificial Sequence
  chemically synthesized
tacgtgatatggcacctccatc

SEQ ID NO: 60943 - DNA, 22 bp, Artificial Sequence
  chemically synthesized
catctgaaagagtctatattga

SEQ ID NO: 60944 - DNA, 22 bp, Artificial Sequence
  chemically synthesized
aaagagtctatattgagggcag

SEQ ID NO: 60945 - DNA, 22 bp, Artificial Sequence
  chemically synthesized
tattgagggcaggctggagtca

SEQ ID NO: 60946 - DNA, 22 bp, Artificial Sequence
  chemically synthesized
agggcaggctggagtcacacat

SEQ ID NO: 60947 - DNA, 22 bp, Artificial Sequence
  chemically synthesized
gagtcacacatgggaataagcc

SEQ ID NO: 60948 - DNA, 22 bp, Artificial Sequence
  chemically synthesized
ccatctgccatctgtgatttaa

SEQ ID NO: 60949 - DNA, 22 bp, Artificial Sequence
  chemically synthesized
ccatctgtgatttaattccaca

SEQ ID NO: 60950 - DNA, 22 bp, Artificial Sequence
  chemically synthesized
tgatttaattccacagtcgcag

SEQ ID NO: 60951 - DNA, 22 bp, Artificial Sequence
  chemically synthesized
aattccacagtcgcagaacgga

SEQ ID NO: 60952 - DNA, 22 bp, Artificial Sequence
  chemically synthesized
attccacagtcgcagaacggat

SEQ ID NO: 60953 - DNA, 22 bp, Artificial Sequence
  chemically synthesized
cacagtcgcagaacggatggca

SEQ ID NO: 60954 - DNA, 22 bp, Artificial Sequence
  chemically synthesized
ctccaaacccacctctagcaaa

SEQ ID NO: 60955 - DNA, 22 bp, Artificial Sequence
  chemically synthesized
caaacccacctctagcaaaggt

SEQ ID NO: 60956 - DNA, 22 bp, Artificial Sequence
  chemically synthesized
tagcaaaggtcccaaatccttc

SEQ ID NO: 60957 - DNA, 22 bp, Artificial Sequence
  chemically synthesized
gcaaaggtcccaaatccttcct

SEQ ID NO: 60958 - DNA, 22 bp, Artificial Sequence
  chemically synthesized
cctatctctcacagtcatgctt

SEQ ID NO: 60959 - DNA, 22 bp, Artificial Sequence
  chemically synthesized
ctatctctcacagtcatgcttt

SEQ ID NO: 60960 - DNA, 22 bp, Artificial Sequence
  chemically synthesized
tctctcacagtcatgctttctt

SEQ ID NO: 60961 - DNA, 22 bp, Artificial Sequence
  chemically synthesized
tcacagtcatgctttcttccac

SEQ ID NO: 60962 - DNA, 22 bp, Artificial Sequence
  chemically synthesized
acagtcatgctttcttccactc

SEQ ID NO: 60963 - DNA, 22 bp, Artificial Sequence
  chemically synthesized
tcttccactcaggcattgctgt

SEQ ID NO: 60964 - DNA, 22 bp, Artificial Sequence
  chemically synthesized
cttccactcaggcattgctgtt

SEQ ID NO: 60965 - DNA, 22 bp, Artificial Sequence
  chemically synthesized
ttccactcaggcattgctgttg

SEQ ID NO: 60966 - DNA, 22 bp, Artificial Sequence
  chemically synthesized
ccactcaggcattgctgttgca

SEQ ID NO: 60967 - DNA, 22 bp, Artificial Sequence
  chemically synthesized
cactcaggcattgctgttgcag

SEQ ID NO: 60968 - DNA, 22 bp, Artificial Sequence
  chemically synthesized
aggcattgctgttgcagaaact

SEQ ID NO: 60969 - DNA, 22 bp, Artificial Sequence
  chemically synthesized
ctgttgcagaaactttcagcca

SEQ ID NO: 60970 - DNA, 22 bp, Artificial Sequence
  chemically synthesized
ttgcagaaactttcagccacat

SEQ ID NO: 60971 - DNA, 22 bp, Artificial Sequence
  chemically synthesized
cagaaactttcagccacatcca

SEQ ID NO: 60972 - DNA, 22 bp, Artificial Sequence
  chemically synthesized
tcagccacatccacagcatcta

SEQ ID NO: 60973 - DNA, 22 bp, Artificial Sequence
  chemically synthesized
cagccacatccacagcatctat

SEQ ID NO: 60974 - DNA, 22 bp, Artificial Sequence
  chemically synthesized
agccacatccacagcatctata

SEQ ID NO: 60975 - DNA, 22 bp, Artificial Sequence
  chemically synthesized
taatgccagcctcaagaaatat

SEQ ID NO: 60976 - DNA, 22 bp, Artificial Sequence
  chemically synthesized
aagaaatattttctcattacct

SEQ ID NO: 60977 - DNA, 22 bp, Artificial Sequence
  chemically synthesized
tctcattaccttcttcctgttc

SEQ ID NO: 60978 - DNA, 22 bp, Artificial Sequence
  chemically synthesized
ctcattaccttcttcctgttca

SEQ ID NO: 60979 - DNA, 22 bp, Artificial Sequence
  chemically synthesized
tcattaccttcttcctgttcag

SEQ ID NO: 60980 - DNA, 22 bp, Artificial Sequence
  chemically synthesized
attaccttcttcctgttcagct

SEQ ID NO: 60981 - DNA, 22 bp, Artificial Sequence
  chemically synthesized
ccttcttcctgttcagcttcgc

SEQ ID NO: 60982 - DNA, 22 bp, Artificial Sequence
  chemically synthesized
cttcctgttcagcttcgccatc

SEQ ID NO: 60983 - DNA, 22 bp, Artificial Sequence
  chemically synthesized
ttcctgttcagcttcgccatcg

SEQ ID NO: 60984 - DNA, 22 bp, Artificial Sequence
  chemically synthesized
cctgttcagcttcgccatcgga

SEQ ID NO: 60985 - DNA, 22 bp, Artificial Sequence
  chemically synthesized
ctgttcagcttcgccatcggat

SEQ ID NO: 60986 - DNA, 22 bp, Artificial Sequence
  chemically synthesized
ttcagcttcgccatcggatttt

SEQ ID NO: 60987 - DNA, 22 bp, Artificial Sequence
  chemically synthesized
agcttcgccatcggattttatc

SEQ ID NO: 60988 - DNA, 22 bp, Artificial Sequence
  chemically synthesized
cgccatcggattttatctgctg

SEQ ID NO: 60989 - DNA, 22 bp, Artificial Sequence
  chemically synthesized
gccatcggattttatctgctgc

SEQ ID NO: 60990 - DNA, 22 bp, Artificial Sequence
  chemically synthesized
tatctgctgctcaagggactgg

SEQ ID NO: 60991 - DNA, 22 bp, Artificial Sequence
  chemically synthesized
atctgctgctcaagggactggg

SEQ ID NO: 60992 - DNA, 22 bp, Artificial Sequence
  chemically synthesized
tctgctgctcaagggactgggt

SEQ ID NO: 60993 - DNA, 22 bp, Artificial Sequence
  chemically synthesized
ctgctcaagggactgggtgtag

SEQ ID NO: 60994 - DNA, 22 bp, Artificial Sequence
  chemically synthesized
ctcaagggactgggtgtagacc

SEQ ID NO: 60995 - DNA, 22 bp, Artificial Sequence
  chemically synthesized
aagggactgggtgtagacctcc

SEQ ID NO: 60996 - DNA, 22 bp, Artificial Sequence
  chemically synthesized
ggtgtagacctcctgtggactc

SEQ ID NO: 60997 - DNA, 22 bp, Artificial Sequence
  chemically synthesized
ctgtggactctggagaaagccc

SEQ ID NO: 60998 - DNA, 22 bp, Artificial Sequence
  chemically synthesized
tggactctggagaaagcccaga

SEQ ID NO: 60999 - DNA, 22 bp, Artificial Sequence
  chemically synthesized
tggagaaagcccagaggtggtg

SEQ ID NO: 61000 - DNA, 22 bp, Artificial Sequence
  chemically synthesized
gagaaagcccagaggtggtgcg

SEQ ID NO: 61001 - DNA, 22 bp, Artificial Sequence
  chemically synthesized
acaccacaccctttgccagcct

SEQ ID NO: 61002 - DNA, 22 bp, Artificial Sequence
  chemically synthesized
tgccagcctcctcaagaacctg

SEQ ID NO: 61003 - DNA, 22 bp, Artificial Sequence
  chemically synthesized
gccagcctcctcaagaacctgg

SEQ ID NO: 61004 - DNA, 22 bp, Artificial Sequence
  chemically synthesized
ccagcctcctcaagaacctggg

SEQ ID NO: 61005 - DNA, 22 bp, Artificial Sequence
  chemically synthesized
ctcaagaacctgggcacgctct

SEQ ID NO: 61006 - DNA, 22 bp, Artificial Sequence
  chemically synthesized
aagaacctgggcacgctctttg

SEQ ID NO: 61007 - DNA, 22 bp, Artificial Sequence
  chemically synthesized
ggcacgctctttggcctggggc

SEQ ID NO: 61008 - DNA, 22 bp, Artificial Sequence
  chemically synthesized
tttggcctggggctggctctca

SEQ ID NO: 61009 - DNA, 22 bp, Artificial Sequence
  chemically synthesized
tggcctggggctggctctcaac

SEQ ID NO: 61010 - DNA, 22 bp, Artificial Sequence
  chemically synthesized
ggcctggggctggctctcaact

SEQ ID NO: 61011 - DNA, 22 bp, Artificial Sequence
  chemically synthesized
gcctggggctggctctcaactc

SEQ ID NO: 61012 - DNA, 22 bp, Artificial Sequence
  chemically synthesized
gggctggctctcaactccagca

SEQ ID NO: 61013 - DNA, 22 bp, Artificial Sequence
  chemically synthesized
gctctcaactccagcatgtaca

SEQ ID NO: 61014 - DNA, 22 bp, Artificial Sequence
  chemically synthesized
tcaactccagcatgtacaggga

SEQ ID NO: 61015 - DNA, 22 bp, Artificial Sequence
  chemically synthesized
aactccagcatgtacagggaga

SEQ ID NO: 61016 - DNA, 22 bp, Artificial Sequence
  chemically synthesized
cagcatgtacagggagagctgc

SEQ ID NO: 61017 - DNA, 22 bp, Artificial Sequence
  chemically synthesized
caaggggaaactcagcaagtgg

SEQ ID NO: 61018 - DNA, 22 bp, Artificial Sequence
  chemically synthesized
agcaagtggctcccattccgcc

SEQ ID NO: 61019 - DNA, 22 bp, Artificial Sequence
  chemically synthesized
ccattccgcctcagctctattg

SEQ ID NO: 61020 - DNA, 22 bp, Artificial Sequence
  chemically synthesized
cgcctcagctctattgtagcct

SEQ ID NO: 61021 - DNA, 22 bp, Artificial Sequence
  chemically synthesized
agctctattgtagcctccctcg

SEQ ID NO: 61022 - DNA, 22 bp, Artificial Sequence
  chemically synthesized
tattgtagcctccctcgtcctc

SEQ ID NO: 61023 - DNA, 22 bp, Artificial Sequence
  chemically synthesized
ttgtagcctccctcgtcctcct

SEQ ID NO: 61024 - DNA, 22 bp, Artificial Sequence
  chemically synthesized
tagcctccctcgtcctcctgca

SEQ ID NO: 61025 - DNA, 22 bp, Artificial Sequence
  chemically synthesized
cctcgtcctcctgcacgtcttt

SEQ ID NO: 61026 - DNA, 22 bp, Artificial Sequence
  chemically synthesized
gtcctcctgcacgtctttgact

SEQ ID NO: 61027 - DNA, 22 bp, Artificial Sequence
  chemically synthesized
ctgcacgtctttgactccttga

SEQ ID NO: 61028 - DNA, 22 bp, Artificial Sequence
  chemically synthesized
cacgtctttgactccttgaaac

SEQ ID NO: 61029 - DNA, 22 bp, Artificial Sequence
  chemically synthesized
tgactccttgaaacccccatcc

SEQ ID NO: 61030 - DNA, 22 bp, Artificial Sequence
  chemically synthesized
gactccttgaaacccccatccc

SEQ ID NO: 61031 - DNA, 22 bp, Artificial Sequence
  chemically synthesized
actccttgaaacccccatccca

SEQ ID NO: 61032 - DNA, 22 bp, Artificial Sequence
  chemically synthesized
cttgaaacccccatcccaagtc

SEQ ID NO: 61033 - DNA, 22 bp, Artificial Sequence
  chemically synthesized
gaaacccccatcccaagtcgag

SEQ ID NO: 61034 - DNA, 22 bp, Artificial Sequence
  chemically synthesized
aaacccccatcccaagtcgagc

SEQ ID NO: 61035 - DNA, 22 bp, Artificial Sequence
  chemically synthesized
gtcttctacgtcttgtccttct

SEQ ID NO: 61036 - DNA, 22 bp, Artificial Sequence
  chemically synthesized
ctacgtcttgtccttctgcaag

SEQ ID NO: 61037 - DNA, 22 bp, Artificial Sequence
  chemically synthesized
tacgtcttgtccttctgcaaga

SEQ ID NO: 61038 - DNA, 22 bp, Artificial Sequence
  chemically synthesized
cgtcttgtccttctgcaagagt

SEQ ID NO: 61039 - DNA, 22 bp, Artificial Sequence
  chemically synthesized
gtccttctgcaagagtgcggta

SEQ ID NO: 61040 - DNA, 22 bp, Artificial Sequence
  chemically synthesized
tccttctgcaagagtgcggtag

SEQ ID NO: 61041 - DNA, 22 bp, Artificial Sequence
  chemically synthesized
ctgcaagagtgcggtagtgccc

SEQ ID NO: 61042 - DNA, 22 bp, Artificial Sequence
  chemically synthesized
tgcaagagtgcggtagtgcccc

SEQ ID NO: 61043 - DNA, 22 bp, Artificial Sequence
  chemically synthesized
caagagtgcggtagtgcccctg

SEQ ID NO: 61044 - DNA, 22 bp, Artificial Sequence
  chemically synthesized
gcatccgtcagtgtcatcccct

SEQ ID NO: 61045 - DNA, 22 bp, Artificial Sequence
  chemically synthesized
ctgcctcgcccaggtcctgggc

SEQ ID NO: 61046 - DNA, 22 bp, Artificial Sequence
  chemically synthesized
cctcgcccaggtcctgggccag

SEQ ID NO: 61047 - DNA, 22 bp, Artificial Sequence
  chemically synthesized
gcccaggtcctgggccagccgc

SEQ ID NO: 61048 - DNA, 22 bp, Artificial Sequence
  chemically synthesized
ggccagccgcacaagaagtcgt

SEQ ID NO: 61049 - DNA, 22 bp, Artificial Sequence
  chemically synthesized
taagagatgtggagtcttcggt

SEQ ID NO: 61050 - DNA, 22 bp, Artificial Sequence
  chemically synthesized
cggtgtttaaagtcaacaacca

SEQ ID NO: 61051 - DNA, 22 bp, Artificial Sequence
  chemically synthesized
ggtgtttaaagtcaacaaccat

SEQ ID NO: 61052 - DNA, 22 bp, Artificial Sequence
  chemically synthesized
aaagtcaacaaccatgccaggg

SEQ ID NO: 61053 - DNA, 22 bp, Artificial Sequence
  chemically synthesized
aagtcaacaaccatgccaggga

SEQ ID NO: 61054 - DNA, 22 bp, Artificial Sequence
  chemically synthesized
aggaggactactatttgaagca

SEQ ID NO: 61055 - DNA, 22 bp, Artificial Sequence
  chemically synthesized
ctatttgaagcaatgggcactg

SEQ ID NO: 61056 - DNA, 22 bp, Artificial Sequence
  chemically synthesized
tttgaagcaatgggcactggta

SEQ ID NO: 61057 - DNA, 22 bp, Artificial Sequence
  chemically synthesized
gaagcaatgggcactggtattt

SEQ ID NO: 61058 - DNA, 22 bp, Artificial Sequence
  chemically synthesized
aagcaatgggcactggtatttg

SEQ ID NO: 61059 - DNA, 22 bp, Artificial Sequence
  chemically synthesized
gtatttggagcaagtgacatgc

SEQ ID NO: 61060 - DNA, 22 bp, Artificial Sequence
  chemically synthesized
ggagcaagtgacatgccatcca

SEQ ID NO: 61061 - DNA, 22 bp, Artificial Sequence
  chemically synthesized
gagcaagtgacatgccatccat

SEQ ID NO: 61062 - DNA, 22 bp, Artificial Sequence
  chemically synthesized
tgccgtcgtggaattaaatcac

SEQ ID NO: 61063 - DNA, 22 bp, Artificial Sequence
  chemically synthesized
ccgtcgtggaattaaatcacgg

SEQ ID NO: 61064 - DNA, 22 bp, Artificial Sequence
  chemically synthesized
aatcacggatggcagattggag

SEQ ID NO: 61065 - DNA, 22 bp, Artificial Sequence
  chemically synthesized
gagggtcgcctggcttattccc

SEQ ID NO: 61066 - DNA, 22 bp, Artificial Sequence
  chemically synthesized
gcttattcccatgtgtgactcc

SEQ ID NO: 61067 - DNA, 22 bp, Artificial Sequence
  chemically synthesized
attcccatgtgtgactccagcc

SEQ ID NO: 61068 - DNA, 22 bp, Artificial Sequence
  chemically synthesized
ttcccatgtgtgactccagcct

SEQ ID NO: 61069 - DNA, 22 bp, Artificial Sequence
  chemically synthesized
ccatgtgtgactccagcctgcc

SEQ ID NO: 61070 - DNA, 22 bp, Artificial Sequence
  chemically synthesized
cagcctgccctcagcacagact

SEQ ID NO: 61071 - DNA, 22 bp, Artificial Sequence
  chemically synthesized
ccctcagcacagactctttcag

SEQ ID NO: 61072 - DNA, 22 bp, Artificial Sequence
  chemically synthesized
agcacagactctttcagatgga

SEQ ID NO: 61073 - DNA, 22 bp, Artificial Sequence
  chemically synthesized
tttcagatggaggtgccatatc

SEQ ID NO: 61074 - DNA, 22 bp, Artificial Sequence
  chemically synthesized
tcagatggaggtgccatatcac

SEQ ID NO: 61075 - DNA, 22 bp, Artificial Sequence
  chemically synthesized
cagatggaggtgccatatcacg

SEQ ID NO: 61076 - DNA, 22 bp, Artificial Sequence
  chemically synthesized
agatggaggtgccatatcacgt

SEQ ID NO: 61077 - DNA, 22 bp, Artificial Sequence
  chemically synthesized
cccgccaggaggtcctcctctc

SEQ ID NO: 61078 - DNA, 22 bp, Artificial Sequence
  chemically synthesized
ccgccaggaggtcctcctctct

SEQ ID NO: 61079 - DNA, 22 bp, Artificial Sequence
  chemically synthesized
ctctctctacttgaatactctc

SEQ ID NO: 61080 - DNA, 22 bp, Artificial Sequence
  chemically synthesized
tctctacttgaatactctcaca

SEQ ID NO: 61081 - DNA, 22 bp, Artificial Sequence
  chemically synthesized
tctacttgaatactctcacaag

SEQ ID NO: 61082 - DNA, 22 bp, Artificial Sequence
  chemically synthesized
tacttgaatactctcacaagta

SEQ ID NO: 61083 - DNA, 22 bp, Artificial Sequence
  chemically synthesized
cttgaatactctcacaagtagg

SEQ ID NO: 61084 - DNA, 22 bp, Artificial Sequence
  chemically synthesized
gaatactctcacaagtagggag

SEQ ID NO: 61085 - DNA, 22 bp, Artificial Sequence
  chemically synthesized
aatactctcacaagtagggagc

SEQ ID NO: 61086 - DNA, 22 bp, Artificial Sequence
  chemically synthesized
tcacaagtagggagctcactcc

SEQ ID NO: 61087 - DNA, 22 bp, Artificial Sequence
  chemically synthesized
acaagtagggagctcactccca

SEQ ID NO: 61088 - DNA, 22 bp, Artificial Sequence
  chemically synthesized
actcccactggaacagcccatt

SEQ ID NO: 61089 - DNA, 22 bp, Artificial Sequence
  chemically synthesized
ccactggaacagcccattttat

SEQ ID NO: 61090 - DNA, 22 bp, Artificial Sequence
  chemically synthesized
gaacagcccattttatctttga

SEQ ID NO: 61091 - DNA, 22 bp, Artificial Sequence
  chemically synthesized
tatctttgaatggtcttctgcc

SEQ ID NO: 61092 - DNA, 22 bp, Artificial Sequence
  chemically synthesized
atctttgaatggtcttctgcca

SEQ ID NO: 61093 - DNA, 22 bp, Artificial Sequence
  chemically synthesized
tctttgaatggtcttctgccag

SEQ ID NO: 61094 - DNA, 22 bp, Artificial Sequence
  chemically synthesized
tgaatggtcttctgccagccca

SEQ ID NO: 61095 - DNA, 22 bp, Artificial Sequence
  chemically synthesized
gaatggtcttctgccagcccat

SEQ ID NO: 61096 - DNA, 22 bp, Artificial Sequence
  chemically synthesized
aatggtcttctgccagcccatt

SEQ ID NO: 61097 - DNA, 22 bp, Artificial Sequence
  chemically synthesized
ctgccagcccattttgaggcca

SEQ ID NO: 61098 - DNA, 22 bp, Artificial Sequence
  chemically synthesized
tgccagcccattttgaggccag

SEQ ID NO: 61099 - DNA, 22 bp, Artificial Sequence
  chemically synthesized
ccagcccattttgaggccagag

SEQ ID NO: 61100 - DNA, 22 bp, Artificial Sequence
  chemically synthesized
tgaggccagaggtgctgtcagc

SEQ ID NO: 61101 - DNA, 22 bp, Artificial Sequence
  chemically synthesized
gaggccagaggtgctgtcagct

SEQ ID NO: 61102 - DNA, 22 bp, Artificial Sequence
  chemically synthesized
aggccagaggtgctgtcagctc

SEQ ID NO: 61103 - DNA, 22 bp, Artificial Sequence
  chemically synthesized
tcagctcaggtggtcctctttt

SEQ ID NO: 61104 - DNA, 22 bp, Artificial Sequence
  chemically synthesized
aggtggtcctcttttacaatcc

SEQ ID NO: 61105 - DNA, 22 bp, Artificial Sequence
  chemically synthesized
ttttacaatcctaatcatattg

SEQ ID NO: 61106 - DNA, 22 bp, Artificial Sequence
  chemically synthesized
ttacaatcctaatcatattggg

SEQ ID NO: 61107 - DNA, 22 bp, Artificial Sequence
  chemically synthesized
tacaatcctaatcatattgggt

SEQ ID NO: 61108 - DNA, 22 bp, Artificial Sequence
  chemically synthesized
acaatcctaatcatattgggta

SEQ ID NO: 61109 - DNA, 22 bp, Artificial Sequence
  chemically synthesized
caatcctaatcatattgggtaa

SEQ ID NO: 61110 - DNA, 22 bp, Artificial Sequence
  chemically synthesized
atcatattgggtaatgtttttg

SEQ ID NO: 61111 - DNA, 22 bp, Artificial Sequence
  chemically synthesized
ggtaatgtttttgaaaagctaa

SEQ ID NO: 61112 - DNA, 22 bp, Artificial Sequence
  chemically synthesized
ttgaaaagctaatgaagctatt

SEQ ID NO: 61113 - DNA, 22 bp, Artificial Sequence
  chemically synthesized
tgaaaagctaatgaagctattg

SEQ ID NO: 61114 - DNA, 22 bp, Artificial Sequence
  chemically synthesized
gaaaagctaatgaagctattga

SEQ ID NO: 61115 - DNA, 22 bp, Artificial Sequence
  chemically synthesized
aaaagctaatgaagctattgag

SEQ ID NO: 61116 - DNA, 22 bp, Artificial Sequence
  chemically synthesized
atgaagctattgagaaagacct

SEQ ID NO: 61117 - DNA, 22 bp, Artificial Sequence
  chemically synthesized
ttgagaaagacctgttgctaga

SEQ ID NO: 61118 - DNA, 22 bp, Artificial Sequence
  chemically synthesized
agaaagacctgttgctagaagt

SEQ ID NO: 61119 - DNA, 22 bp, Artificial Sequence
  chemically synthesized
ttgctagaagttgggttgttct

SEQ ID NO: 61120 - DNA, 22 bp, Artificial Sequence
  chemically synthesized
ctagaagttgggttgttctgga

SEQ ID NO: 61121 - DNA, 22 bp, Artificial Sequence
  chemically synthesized
gaagttgggttgttctggattt

SEQ ID NO: 61122 - DNA, 22 bp, Artificial Sequence
  chemically synthesized
ggttgttctggattttcccctg

SEQ ID NO: 61123 - DNA, 22 bp, Artificial Sequence
  chemically synthesized
ttctggattttcccctgaagac

SEQ ID NO: 61124 - DNA, 22 bp, Artificial Sequence
  chemically synthesized
tggattttcccctgaagactta

SEQ ID NO: 61125 - DNA, 22 bp, Artificial Sequence
  chemically synthesized
gattttcccctgaagacttact

SEQ ID NO: 61126 - DNA, 22 bp, Artificial Sequence
  chemically synthesized
tcccctgaagacttacttattc

SEQ ID NO: 61127 - DNA, 22 bp, Artificial Sequence
  chemically synthesized
cccctgaagacttacttattct

SEQ ID NO: 61128 - DNA, 22 bp, Artificial Sequence
  chemically synthesized
ccctgaagacttacttattctt

SEQ ID NO: 61129 - DNA, 22 bp, Artificial Sequence
  chemically synthesized
aagacttacttattcttccgtc

SEQ ID NO: 61130 - DNA, 22 bp, Artificial Sequence
  chemically synthesized
acttattcttccgtcacatata

SEQ ID NO: 61131 - DNA, 22 bp, Artificial Sequence
  chemically synthesized
cttattcttccgtcacatatac

SEQ ID NO: 61132 - DNA, 22 bp, Artificial Sequence
  chemically synthesized
attcttccgtcacatatacaaa

SEQ ID NO: 61133 - DNA, 22 bp, Artificial Sequence
  chemically synthesized
ttcttccgtcacatatacaaaa

SEQ ID NO: 61134 - DNA, 22 bp, Artificial Sequence
  chemically synthesized
ttccgtcacatatacaaaagca

SEQ ID NO: 61135 - DNA, 22 bp, Artificial Sequence
  chemically synthesized
ccgtcacatatacaaaagcaag

SEQ ID NO: 61136 - DNA, 22 bp, Artificial Sequence
  chemically synthesized
cgtcacatatacaaaagcaaga

SEQ ID NO: 61137 - DNA, 22 bp, Artificial Sequence
  chemically synthesized
ccaggtagggccagctcacaag

SEQ ID NO: 61138 - DNA, 22 bp, Artificial Sequence
  chemically synthesized
caggtagggccagctcacaagc

SEQ ID NO: 61139 - DNA, 22 bp, Artificial Sequence
  chemically synthesized
acaagcccaggctggagatcct

SEQ ID NO: 61140 - DNA, 22 bp, Artificial Sequence
  chemically synthesized
gagatcctaactgagaattttc

SEQ ID NO: 61141 - DNA, 22 bp, Artificial Sequence
  chemically synthesized
actgagaattttctacctgtgt

SEQ ID NO: 61142 - DNA, 22 bp, Artificial Sequence
  chemically synthesized
agaattttctacctgtgttcat

SEQ ID NO: 61143 - DNA, 22 bp, Artificial Sequence
  chemically synthesized
tctacctgtgttcattcttacc

SEQ ID NO: 61144 - DNA, 22 bp, Artificial Sequence
  chemically synthesized
ctacctgtgttcattcttaccg

SEQ ID NO: 61145 - DNA, 22 bp, Artificial Sequence
  chemically synthesized
tacctgtgttcattcttaccga

SEQ ID NO: 61146 - DNA, 22 bp, Artificial Sequence
  chemically synthesized
cctgtgttcattcttaccgaga

SEQ ID NO: 61147 - DNA, 22 bp, Artificial Sequence
  chemically synthesized
tgttcattcttaccgagaaaag

SEQ ID NO: 61148 - DNA, 22 bp, Artificial Sequence
  chemically synthesized
attcttaccgagaaaaggagaa

SEQ ID NO: 61149 - DNA, 22 bp, Artificial Sequence
  chemically synthesized
ttaccgagaaaaggagaaagga

SEQ ID NO: 61150 - DNA, 22 bp, Artificial Sequence
  chemically synthesized
accgagaaaaggagaaaggagc

SEQ ID NO: 61151 - DNA, 22 bp, Artificial Sequence
  chemically synthesized
ccgagaaaaggagaaaggagct

SEQ ID NO: 61152 - DNA, 22 bp, Artificial Sequence
  chemically synthesized
tgaatctgataggaaaagaagg

SEQ ID NO: 61153 - DNA, 22 bp, Artificial Sequence
  chemically synthesized
aatctgataggaaaagaaggct

SEQ ID NO: 61154 - DNA, 22 bp, Artificial Sequence
  chemically synthesized
ataggaaaagaaggctgcctaa

SEQ ID NO: 61155 - DNA, 22 bp, Artificial Sequence
  chemically synthesized
cctaaggaggagtttttagtat

SEQ ID NO: 61156 - DNA, 22 bp, Artificial Sequence
  chemically synthesized
aggaggagtttttagtatgtgg

SEQ ID NO: 61157 - DNA, 22 bp, Artificial Sequence
  chemically synthesized
ttagtatgtggcgtatcatgca

SEQ ID NO: 61158 - DNA, 22 bp, Artificial Sequence
  chemically synthesized
tagtatgtggcgtatcatgcaa

SEQ ID NO: 61159 - DNA, 22 bp, Artificial Sequence
  chemically synthesized
agtatgtggcgtatcatgcaag

SEQ ID NO: 61160 - DNA, 22 bp, Artificial Sequence
  chemically synthesized
gtatgtggcgtatcatgcaagt

SEQ ID NO: 61161 - DNA, 22 bp, Artificial Sequence
  chemically synthesized
tgccaagccatgtctaaatggc

SEQ ID NO: 61162 - DNA, 22 bp, Artificial Sequence
  chemically synthesized
aatggctttaattatatagtaa

SEQ ID NO: 61163 - DNA, 22 bp, Artificial Sequence
  chemically synthesized
taattatatagtaatgcactct

SEQ ID NO: 61164 - DNA, 22 bp, Artificial Sequence
  chemically synthesized
aattatatagtaatgcactctc

SEQ ID NO: 61165 - DNA, 22 bp, Artificial Sequence
  chemically synthesized
attatatagtaatgcactctca

SEQ ID NO: 61166 - DNA, 22 bp, Artificial Sequence
  chemically synthesized
tatagtaatgcactctcagtaa

SEQ ID NO: 61167 - DNA, 22 bp, Artificial Sequence
  chemically synthesized
tcagtaatgggggaccagctta

SEQ ID NO: 61168 - DNA, 22 bp, Artificial Sequence
  chemically synthesized
agtaatgggggaccagcttaag

SEQ ID NO: 61169 - DNA, 22 bp, Artificial Sequence
  chemically synthesized
aagtataattaatagatggtta

SEQ ID NO: 61170 - DNA, 22 bp, Artificial Sequence
  chemically synthesized
agtataattaatagatggttag

SEQ ID NO: 61171 - DNA, 22 bp, Artificial Sequence
  chemically synthesized
atagatggttagtggggtaatt

SEQ ID NO: 61172 - DNA, 22 bp, Artificial Sequence
  chemically synthesized
gtggggtaattctgcttctagt

SEQ ID NO: 61173 - DNA, 22 bp, Artificial Sequence
  chemically synthesized
tgcttctagtattttttttact

SEQ ID NO: 61174 - DNA, 22 bp, Artificial Sequence
  chemically synthesized
cttctagtattttttttactgt

SEQ ID NO: 61175 - DNA, 22 bp, Artificial Sequence
  chemically synthesized
ctagtattttttttactgtgca

SEQ ID NO: 61176 - DNA, 22 bp, Artificial Sequence
  chemically synthesized
tagtattttttttactgtgcat

SEQ ID NO: 61177 - DNA, 22 bp, Artificial Sequence
  chemically synthesized
gtattttttttactgtgcatac

SEQ ID NO: 61178 - DNA, 22 bp, Artificial Sequence
  chemically synthesized
tttttactgtgcatacatgttc

SEQ ID NO: 61179 - DNA, 22 bp, Artificial Sequence
  chemically synthesized
ttttactgtgcatacatgttca

SEQ ID NO: 61180 - DNA, 22 bp, Artificial Sequence
  chemically synthesized
tttactgtgcatacatgttcat

SEQ ID NO: 61181 - DNA, 22 bp, Artificial Sequence
  chemically synthesized
ttactgtgcatacatgttcatc

SEQ ID NO: 61182 - DNA, 22 bp, Artificial Sequence
  chemically synthesized
tactgtgcatacatgttcatcg

SEQ ID NO: 61183 - DNA, 22 bp, Artificial Sequence
  chemically synthesized
actgtgcatacatgttcatcgt

SEQ ID NO: 61184 - DNA, 22 bp, Artificial Sequence
  chemically synthesized
ctgtgcatacatgttcatcgta

SEQ ID NO: 61185 - DNA, 22 bp, Artificial Sequence
  chemically synthesized
tgcatacatgttcatcgtattt

SEQ ID NO: 61186 - DNA, 22 bp, Artificial Sequence
  chemically synthesized
atcgtatttccttggatttctg

SEQ ID NO: 61187 - DNA, 22 bp, Artificial Sequence
  chemically synthesized
ccttggatttctgaatggctgc

SEQ ID NO: 61188 - DNA, 22 bp, Artificial Sequence
  chemically synthesized
cttggatttctgaatggctgca

SEQ ID NO: 61189 - DNA, 22 bp, Artificial Sequence
  chemically synthesized
ggatttctgaatggctgcagtg

SEQ ID NO: 61190 - DNA, 22 bp, Artificial Sequence
  chemically synthesized
gatttctgaatggctgcagtga

SEQ ID NO: 61191 - DNA, 22 bp, Artificial Sequence
  chemically synthesized
ctgaatggctgcagtgacccag

SEQ ID NO: 61192 - DNA, 22 bp, Artificial Sequence
  chemically synthesized
tgaatggctgcagtgacccaga

SEQ ID NO: 61193 - DNA, 22 bp, Artificial Sequence
  chemically synthesized
aatggctgcagtgacccagata

SEQ ID NO: 61194 - DNA, 22 bp, Artificial Sequence
  chemically synthesized
cagtgacccagatattgcacta

SEQ ID NO: 61195 - DNA, 22 bp, Artificial Sequence
  chemically synthesized
cactaggtcaaaacattcaggt

SEQ ID NO: 61196 - DNA, 22 bp, Artificial Sequence
  chemically synthesized
ggtcaaaacattcaggtatagc

SEQ ID NO: 61197 - DNA, 22 bp, Artificial Sequence
  chemically synthesized
aggtatagctgacatctcctct

SEQ ID NO: 61198 - DNA, 22 bp, Artificial Sequence
  chemically synthesized
acatctcctctatcacattaca

SEQ ID NO: 61199 - DNA, 22 bp, Artificial Sequence
  chemically synthesized
ctctatcacattacatcatcct

SEQ ID NO: 61200 - DNA, 22 bp, Artificial Sequence
  chemically synthesized
tatcacattacatcatcctcct

SEQ ID NO: 61201 - DNA, 22 bp, Artificial Sequence
  chemically synthesized
tcacattacatcatcctcctta

SEQ ID NO: 61202 - DNA, 22 bp, Artificial Sequence
  chemically synthesized
catcatcctccttataagccca

SEQ ID NO: 61203 - DNA, 22 bp, Artificial Sequence
  chemically synthesized
cttataagcccagctctgcttt

SEQ ID NO: 61204 - DNA, 22 bp, Artificial Sequence
  chemically synthesized
ataagcccagctctgctttttc

SEQ ID NO: 61205 - DNA, 22 bp, Artificial Sequence
  chemically synthesized
taagcccagctctgctttttcc

SEQ ID NO: 61206 - DNA, 22 bp, Artificial Sequence
  chemically synthesized
tgctttttccagattcttccac

SEQ ID NO: 61207 - DNA, 22 bp, Artificial Sequence
  chemically synthesized
ctttttccagattcttccactg

SEQ ID NO: 61208 - DNA, 22 bp, Artificial Sequence
  chemically synthesized
tttccagattcttccactggct

SEQ ID NO: 61209 - DNA, 22 bp, Artificial Sequence
  chemically synthesized
ttccagattcttccactggctc

SEQ ID NO: 61210 - DNA, 22 bp, Artificial Sequence
  chemically synthesized
tccagattcttccactggctcc

SEQ ID NO: 61211 - DNA, 22 bp, Artificial Sequence
  chemically synthesized
ccagattcttccactggctcca

SEQ ID NO: 61212 - DNA, 22 bp, Artificial Sequence
  chemically synthesized
cagattcttccactggctccac

SEQ ID NO: 61213 - DNA, 22 bp, Artificial Sequence
  chemically synthesized
ttccactggctccacatccacc

SEQ ID NO: 61214 - DNA, 22 bp, Artificial Sequence
  chemically synthesized
ccactggctccacatccacccc

SEQ ID NO: 61215 - DNA, 22 bp, Artificial Sequence
  chemically synthesized
cactggctccacatccacccca

SEQ ID NO: 61216 - DNA, 22 bp, Artificial Sequence
  chemically synthesized
gctccacatccaccccactgga

SEQ ID NO: 61217 - DNA, 22 bp, Artificial Sequence
  chemically synthesized
cacatccaccccactggatctt

SEQ ID NO: 61218 - DNA, 22 bp, Artificial Sequence
  chemically synthesized
gatcttcagaaggctagagggc

SEQ ID NO: 61219 - DNA, 22 bp, Artificial Sequence
  chemically synthesized
cagaaggctagagggcgactct

SEQ ID NO: 61220 - DNA, 22 bp, Artificial Sequence
  chemically synthesized
agaaggctagagggcgactctg

SEQ ID NO: 61221 - DNA, 22 bp, Artificial Sequence
  chemically synthesized
gagggcgactctggtggtgctt

SEQ ID NO: 61222 - DNA, 22 bp, Artificial Sequence
  chemically synthesized
tggtggtgcttttgtatgtttc

SEQ ID NO: 61223 - DNA, 22 bp, Artificial Sequence
  chemically synthesized
gtggtgcttttgtatgtttcaa

SEQ ID NO: 61224 - DNA, 22 bp, Artificial Sequence
  chemically synthesized
ttgtatgtttcaattaggctct

SEQ ID NO: 61225 - DNA, 22 bp, Artificial Sequence
  chemically synthesized
tgtatgtttcaattaggctctg

SEQ ID NO: 61226 - DNA, 22 bp, Artificial Sequence
  chemically synthesized
gtatgtttcaattaggctctga

SEQ ID NO: 61227 - DNA, 22 bp, Artificial Sequence
  chemically synthesized
tatgtttcaattaggctctgaa

SEQ ID NO: 61228 - DNA, 22 bp, Artificial Sequence
  chemically synthesized
caattaggctctgaaatcttgg

SEQ ID NO: 61229 - DNA, 22 bp, Artificial Sequence
  chemically synthesized
aattaggctctgaaatcttggg

SEQ ID NO: 61230 - DNA, 22 bp, Artificial Sequence
  chemically synthesized
ggctctgaaatcttgggcaaaa

SEQ ID NO: 61231 - DNA, 22 bp, Artificial Sequence
  chemically synthesized
tgaaatcttgggcaaaatgaca

SEQ ID NO: 61232 - DNA, 22 bp, Artificial Sequence
  chemically synthesized
aaatcttgggcaaaatgacaag

SEQ ID NO: 61233 - DNA, 22 bp, Artificial Sequence
  chemically synthesized
gggcaaaatgacaaggggaggg

SEQ ID NO: 61234 - DNA, 22 bp, Artificial Sequence
  chemically synthesized
ggcaaaatgacaaggggagggc

SEQ ID NO: 61235 - DNA, 22 bp, Artificial Sequence
  chemically synthesized
ctctctcaggtcactccagtgt

SEQ ID NO: 61236 - DNA, 22 bp, Artificial Sequence
  chemically synthesized
tctcaggtcactccagtgttac

SEQ ID NO: 61237 - DNA, 22 bp, Artificial Sequence
  chemically synthesized
tcaggtcactccagtgttactt

SEQ ID NO: 61238 - DNA, 22 bp, Artificial Sequence
  chemically synthesized
aggtcactccagtgttactttt

SEQ ID NO: 61239 - DNA, 22 bp, Artificial Sequence
  chemically synthesized
cagtgttacttttaattcctag

SEQ ID NO: 61240 - DNA, 22 bp, Artificial Sequence
  chemically synthesized
cttttaattcctagagggtaaa

SEQ ID NO: 61241 - DNA, 22 bp, Artificial Sequence
  chemically synthesized
ttaattcctagagggtaaatat

SEQ ID NO: 61242 - DNA, 22 bp, Artificial Sequence
  chemically synthesized
taattcctagagggtaaatatg

SEQ ID NO: 61243 - DNA, 22 bp, Artificial Sequence
  chemically synthesized
aattcctagagggtaaatatga

SEQ ID NO: 61244 - DNA, 22 bp, Artificial Sequence
  chemically synthesized
attcctagagggtaaatatgac

SEQ ID NO: 61245 - DNA, 22 bp, Artificial Sequence
  chemically synthesized
ctagagggtaaatatgactcct

SEQ ID NO: 61246 - DNA, 22 bp, Artificial Sequence
  chemically synthesized
gagggtaaatatgactcctttc

SEQ ID NO: 61247 - DNA, 22 bp, Artificial Sequence
  chemically synthesized
ctttctctatcccaagccaacc

SEQ ID NO: 61248 - DNA, 22 bp, Artificial Sequence
  chemically synthesized
tctctatcccaagccaaccaag

SEQ ID NO: 61249 - DNA, 22 bp, Artificial Sequence
  chemically synthesized
ctctatcccaagccaaccaaga

SEQ ID NO: 61250 - DNA, 22 bp, Artificial Sequence
  chemically synthesized
tctatcccaagccaaccaagag

SEQ ID NO: 61251 - DNA, 22 bp, Artificial Sequence
  chemically synthesized
tatcccaagccaaccaagagca

SEQ ID NO: 61252 - DNA, 22 bp, Artificial Sequence
  chemically synthesized
tcccaagccaaccaagagcaca

SEQ ID NO: 61253 - DNA, 22 bp, Artificial Sequence
  chemically synthesized
ttaaaggaaaagtcaacatctt

SEQ ID NO: 61254 - DNA, 22 bp, Artificial Sequence
  chemically synthesized
aaaggaaaagtcaacatcttct

SEQ ID NO: 61255 - DNA, 22 bp, Artificial Sequence
  chemically synthesized
aaggaaaagtcaacatcttctc

SEQ ID NO: 61256 - DNA, 22 bp, Artificial Sequence
  chemically synthesized
ctctctttttttttttttttga

SEQ ID NO: 61257 - DNA, 22 bp, Artificial Sequence
  chemically synthesized
tctctttttttttttttttgag

SEQ ID NO: 61258 - DNA, 22 bp, Artificial Sequence
  chemically synthesized
tctttttttttttttttgagac

SEQ ID NO: 61259 - DNA, 22 bp, Artificial Sequence
  chemically synthesized
tttttttttttttttgagacag

SEQ ID NO: 61260 - DNA, 22 bp, Artificial Sequence
  chemically synthesized
tttttttttttttgagacaggg

SEQ ID NO: 61261 - DNA, 22 bp, Artificial Sequence
  chemically synthesized
ttttttttttttgagacagggt

SEQ ID NO: 61262 - DNA, 22 bp, Artificial Sequence
  chemically synthesized
tttttttttttgagacagggtc

SEQ ID NO: 61263 - DNA, 22 bp, Artificial Sequence
  chemically synthesized
ttttttttttgagacagggtct

SEQ ID NO: 61264 - DNA, 22 bp, Artificial Sequence
  chemically synthesized
tttttttttgagacagggtctc

SEQ ID NO: 61265 - DNA, 22 bp, Artificial Sequence
  chemically synthesized
ttttttttgagacagggtctca

SEQ ID NO: 61266 - DNA, 22 bp, Artificial Sequence
  chemically synthesized
tttttttgagacagggtctcac

SEQ ID NO: 61267 - DNA, 22 bp, Artificial Sequence
  chemically synthesized
ttttttgagacagggtctcact

SEQ ID NO: 61268 - DNA, 22 bp, Artificial Sequence
  chemically synthesized
tttttgagacagggtctcacta

SEQ ID NO: 61269 - DNA, 22 bp, Artificial Sequence
  chemically synthesized
ttttgagacagggtctcactat

SEQ ID NO: 61270 - DNA, 22 bp, Artificial Sequence
  chemically synthesized
tttgagacagggtctcactatg

SEQ ID NO: 61271 - DNA, 22 bp, Artificial Sequence
  chemically synthesized
ttgagacagggtctcactatgt

SEQ ID NO: 61272 - DNA, 22 bp, Artificial Sequence
  chemically synthesized
tgagacagggtctcactatgtt

SEQ ID NO: 61273 - DNA, 22 bp, Artificial Sequence
  chemically synthesized
gagacagggtctcactatgttg

SEQ ID NO: 61274 - DNA, 22 bp, Artificial Sequence
  chemically synthesized
agacagggtctcactatgttgc

SEQ ID NO: 61275 - DNA, 22 bp, Artificial Sequence
  chemically synthesized
actatgttgcccaggctgctct

SEQ ID NO: 61276 - DNA, 22 bp, Artificial Sequence
  chemically synthesized
tgttgcccaggctgctcttgaa

SEQ ID NO: 61277 - DNA, 22 bp, Artificial Sequence
  chemically synthesized
cccaggctgctcttgaattcct

SEQ ID NO: 61278 - DNA, 22 bp, Artificial Sequence
  chemically synthesized
ctcttgaattcctgggctcaag

SEQ ID NO: 61279 - DNA, 22 bp, Artificial Sequence
  chemically synthesized
ttgaattcctgggctcaagcag

SEQ ID NO: 61280 - DNA, 22 bp, Artificial Sequence
  chemically synthesized
gaattcctgggctcaagcagtc

SEQ ID NO: 61281 - DNA, 22 bp, Artificial Sequence
  chemically synthesized
aattcctgggctcaagcagtcc

SEQ ID NO: 61282 - DNA, 22 bp, Artificial Sequence
  chemically synthesized
ctgggctcaagcagtcctccca

SEQ ID NO: 61283 - DNA, 22 bp, Artificial Sequence
  chemically synthesized
ggctcaagcagtcctcccaccc

SEQ ID NO: 61284 - DNA, 22 bp, Artificial Sequence
  chemically synthesized
aagcagtcctcccaccctacca

SEQ ID NO: 61285 - DNA, 22 bp, Artificial Sequence
  chemically synthesized
ccaccctaccacagcgtcccgc

SEQ ID NO: 61286 - DNA, 22 bp, Artificial Sequence
  chemically synthesized
ccacagcgtcccgcgtagctgg

SEQ ID NO: 61287 - DNA, 22 bp, Artificial Sequence
  chemically synthesized
ggactacaggtgcaagccacta

SEQ ID NO: 61288 - DNA, 22 bp, Artificial Sequence
  chemically synthesized
caggtgcaagccactatgtcca

SEQ ID NO: 61289 - DNA, 22 bp, Artificial Sequence
  chemically synthesized
tgtccagctagccaactcctcc

SEQ ID NO: 61290 - DNA, 22 bp, Artificial Sequence
  chemically synthesized
gccaactcctccttgcctgctt

SEQ ID NO: 61291 - DNA, 22 bp, Artificial Sequence
  chemically synthesized
ctccttgcctgcttttcttttt

SEQ ID NO: 61292 - DNA, 22 bp, Artificial Sequence
  chemically synthesized
cttgcctgcttttctttttttt

SEQ ID NO: 61293 - DNA, 22 bp, Artificial Sequence
  chemically synthesized
gcctgcttttctttttttttct

SEQ ID NO: 61294 - DNA, 22 bp, Artificial Sequence
  chemically synthesized
cctgcttttctttttttttctt

SEQ ID NO: 61295 - DNA, 22 bp, Artificial Sequence
  chemically synthesized
cttttctttttttttctttttt

SEQ ID NO: 61296 - DNA, 22 bp, Artificial Sequence
  chemically synthesized
ttctttttttttctttttttga

SEQ ID NO: 61297 - DNA, 22 bp, Artificial Sequence
  chemically synthesized
tctttttttttctttttttgag

SEQ ID NO: 61298 - DNA, 22 bp, Artificial Sequence
  chemically synthesized
ctttttttttctttttttgaga

SEQ ID NO: 61299 - DNA, 22 bp, Artificial Sequence
  chemically synthesized
tttttttttctttttttgagac

SEQ ID NO: 61300 - DNA, 22 bp, Artificial Sequence
  chemically synthesized
tttttttctttttttgagacgg

SEQ ID NO: 61301 - DNA, 22 bp, Artificial Sequence
  chemically synthesized
ttttttctttttttgagacggc

SEQ ID NO: 61302 - DNA, 22 bp, Artificial Sequence
  chemically synthesized
tttttctttttttgagacggcg

SEQ ID NO: 61303 - DNA, 22 bp, Artificial Sequence
  chemically synthesized
ttttctttttttgagacggcgc

SEQ ID NO: 61304 - DNA, 22 bp, Artificial Sequence
  chemically synthesized
tttctttttttgagacggcgca

SEQ ID NO: 61305 - DNA, 22 bp, Artificial Sequence
  chemically synthesized
ttctttttttgagacggcgcac

SEQ ID NO: 61306 - DNA, 22 bp, Artificial Sequence
  chemically synthesized
tctttttttgagacggcgcacc

SEQ ID NO: 61307 - DNA, 22 bp, Artificial Sequence
  chemically synthesized
ctttttttgagacggcgcacct

SEQ ID NO: 61308 - DNA, 22 bp, Artificial Sequence
  chemically synthesized
tttttttgagacggcgcaccta

SEQ ID NO: 61309 - DNA, 22 bp, Artificial Sequence
  chemically synthesized
tttttgagacggcgcacctatc

SEQ ID NO: 61310 - DNA, 22 bp, Artificial Sequence
  chemically synthesized
ttttgagacggcgcacctatca

SEQ ID NO: 61311 - DNA, 22 bp, Artificial Sequence
  chemically synthesized
tttgagacggcgcacctatcac

SEQ ID NO: 61312 - DNA, 22 bp, Artificial Sequence
  chemically synthesized
ttgagacggcgcacctatcacc

SEQ ID NO: 61313 - DNA, 22 bp, Artificial Sequence
  chemically synthesized
tgagacggcgcacctatcaccc

SEQ ID NO: 61314 - DNA, 22 bp, Artificial Sequence
  chemically synthesized
gagacggcgcacctatcaccca

SEQ ID NO: 61315 - DNA, 22 bp, Artificial Sequence
  chemically synthesized
agacggcgcacctatcacccag

SEQ ID NO: 61316 - DNA, 22 bp, Artificial Sequence
  chemically synthesized
tcacccaggctggagtggagtg

SEQ ID NO: 61317 - DNA, 22 bp, Artificial Sequence
  chemically synthesized
gagtggagtggcacgatcttgg

SEQ ID NO: 61318 - DNA, 22 bp, Artificial Sequence
  chemically synthesized
ggctcactgcaacctcttcctc

SEQ ID NO: 61319 - DNA, 22 bp, Artificial Sequence
  chemically synthesized
gctcactgcaacctcttcctcc

SEQ ID NO: 61320 - DNA, 22 bp, Artificial Sequence
  chemically synthesized
actgcaacctcttcctcctggt

SEQ ID NO: 61321 - DNA, 22 bp, Artificial Sequence
  chemically synthesized
caacctcttcctcctggttcaa

SEQ ID NO: 61322 - DNA, 22 bp, Artificial Sequence
  chemically synthesized
ttcctcctggttcaagcgattc

SEQ ID NO: 61323 - DNA, 22 bp, Artificial Sequence
  chemically synthesized
cctcctggttcaagcgattctc

SEQ ID NO: 61324 - DNA, 22 bp, Artificial Sequence
  chemically synthesized
ctcctggttcaagcgattctca

SEQ ID NO: 61325 - DNA, 22 bp, Artificial Sequence
  chemically synthesized
ctggttcaagcgattctcatgt

SEQ ID NO: 61326 - DNA, 22 bp, Artificial Sequence
  chemically synthesized
gttcaagcgattctcatgtctc

SEQ ID NO: 61327 - DNA, 22 bp, Artificial Sequence
  chemically synthesized
aagcgattctcatgtctcagcc

SEQ ID NO: 61328 - DNA, 22 bp, Artificial Sequence
  chemically synthesized
tcatgtctcagcctcctcagta

SEQ ID NO: 61329 - DNA, 22 bp, Artificial Sequence
  chemically synthesized
atgtctcagcctcctcagtagc

SEQ ID NO: 61330 - DNA, 22 bp, Artificial Sequence
  chemically synthesized
agcctcctcagtagctaggact

SEQ ID NO: 61331 - DNA, 22 bp, Artificial Sequence
  chemically synthesized
ctcagtagctaggactaccggc

SEQ ID NO: 61332 - DNA, 22 bp, Artificial Sequence
  chemically synthesized
agtagctaggactaccggcgtg

SEQ ID NO: 61333 - DNA, 22 bp, Artificial Sequence
  chemically synthesized
ggactaccggcgtgcaccacca

SEQ ID NO: 61334 - DNA, 22 bp, Artificial Sequence
  chemically synthesized
ccggcgtgcaccaccatgccag

SEQ ID NO: 61335 - DNA, 22 bp, Artificial Sequence
  chemically synthesized
atttttatatttttagaatttt

SEQ ID NO: 61336 - DNA, 22 bp, Artificial Sequence
  chemically synthesized
ttatatttttagaattttagaa

SEQ ID NO: 61337 - DNA, 22 bp, Artificial Sequence
  chemically synthesized
tatatttttagaattttagaag

SEQ ID NO: 61338 - DNA, 22 bp, Artificial Sequence
  chemically synthesized
atatttttagaattttagaaga

SEQ ID NO: 61339 - DNA, 22 bp, Artificial Sequence
  chemically synthesized
tatttttagaattttagaagag

SEQ ID NO: 61340 - DNA, 22 bp, Artificial Sequence
  chemically synthesized
ttagaattttagaagagatggg

SEQ ID NO: 61341 - DNA, 22 bp, Artificial Sequence
  chemically synthesized
tagaattttagaagagatggga

SEQ ID NO: 61342 - DNA, 22 bp, Artificial Sequence
  chemically synthesized
agaattttagaagagatgggat

SEQ ID NO: 61343 - DNA, 22 bp, Artificial Sequence
  chemically synthesized
gaattttagaagagatgggatt

SEQ ID NO: 61344 - DNA, 22 bp, Artificial Sequence
  chemically synthesized
tagaagagatgggatttcatca

SEQ ID NO: 61345 - DNA, 22 bp, Artificial Sequence
  chemically synthesized
agaagagatgggatttcatcat

SEQ ID NO: 61346 - DNA, 22 bp, Artificial Sequence
  chemically synthesized
gaagagatgggatttcatcatg

SEQ ID NO: 61347 - DNA, 22 bp, Artificial Sequence
  chemically synthesized
catcatgttggccaggctggtc

SEQ ID NO: 61348 - DNA, 22 bp, Artificial Sequence
  chemically synthesized
atcatgttggccaggctggtct

SEQ ID NO: 61349 - DNA, 22 bp, Artificial Sequence
  chemically synthesized
gccaggctggtctcgaactcct

SEQ ID NO: 61350 - DNA, 22 bp, Artificial Sequence
  chemically synthesized
gtctcgaactcctgacctcaag

SEQ ID NO: 61351 - DNA, 22 bp, Artificial Sequence
  chemically synthesized
gaactcctgacctcaagtgatc

SEQ ID NO: 61352 - DNA, 22 bp, Artificial Sequence
  chemically synthesized
ctgacctcaagtgatccacctg

SEQ ID NO: 61353 - DNA, 22 bp, Artificial Sequence
  chemically synthesized
acctcaagtgatccacctgcct

SEQ ID NO: 61354 - DNA, 22 bp, Artificial Sequence
  chemically synthesized
aagtgatccacctgccttggcc

SEQ ID NO: 61355 - DNA, 22 bp, Artificial Sequence
  chemically synthesized
ccttggcctcccaaggtgctag

SEQ ID NO: 61356 - DNA, 22 bp, Artificial Sequence
  chemically synthesized
ggcctcccaaggtgctaggatt

SEQ ID NO: 61357 - DNA, 22 bp, Artificial Sequence
  chemically synthesized
gcctcccaaggtgctaggatta

SEQ ID NO: 61358 - DNA, 22 bp, Artificial Sequence
  chemically synthesized
ccaaggtgctaggattacaggc

SEQ ID NO: 61359 - DNA, 22 bp, Artificial Sequence
  chemically synthesized
ggattacaggcatgagccaccg

SEQ ID NO: 61360 - DNA, 22 bp, Artificial Sequence
  chemically synthesized
caggcatgagccaccgcaccgg

SEQ ID NO: 61361 - DNA, 22 bp, Artificial Sequence
  chemically synthesized
cttgcctgtttttcaatctcat

SEQ ID NO: 61362 - DNA, 22 bp, Artificial Sequence
  chemically synthesized
gcctgtttttcaatctcatctg

SEQ ID NO: 61363 - DNA, 22 bp, Artificial Sequence
  chemically synthesized
cctgtttttcaatctcatctga

SEQ ID NO: 61364 - DNA, 22 bp, Artificial Sequence
  chemically synthesized
tttttcaatctcatctgatatg

SEQ ID NO: 61365 - DNA, 22 bp, Artificial Sequence
  chemically synthesized
ttcaatctcatctgatatgcag

SEQ ID NO: 61366 - DNA, 22 bp, Artificial Sequence
  chemically synthesized
tcaatctcatctgatatgcaga

SEQ ID NO: 61367 - DNA, 22 bp, Artificial Sequence
  chemically synthesized
caatctcatctgatatgcagag

SEQ ID NO: 61368 - DNA, 22 bp, Artificial Sequence
  chemically synthesized
aatctcatctgatatgcagagt

SEQ ID NO: 61369 - DNA, 22 bp, Artificial Sequence
  chemically synthesized
atctgatatgcagagtatttct

SEQ ID NO: 61370 - DNA, 22 bp, Artificial Sequence
  chemically synthesized
atatgcagagtatttctgcccc

SEQ ID NO: 61371 - DNA, 22 bp, Artificial Sequence
  chemically synthesized
ctgccccacccacctacccccc

SEQ ID NO: 61372 - DNA, 22 bp, Artificial Sequence
  chemically synthesized
tgccccacccacctacccccca

SEQ ID NO: 61373 - DNA, 22 bp, Artificial Sequence
  chemically synthesized
ccccacccacctaccccccaaa

SEQ ID NO: 61374 - DNA, 22 bp, Artificial Sequence
  chemically synthesized
ccccccaaaaaaagctgaagcc

SEQ ID NO: 61375 - DNA, 22 bp, Artificial Sequence
  chemically synthesized
aagcctatttatttgaaagtcc

SEQ ID NO: 61376 - DNA, 22 bp, Artificial Sequence
  chemically synthesized
tttatttgaaagtccttgtttt

SEQ ID NO: 61377 - DNA, 22 bp, Artificial Sequence
  chemically synthesized
atttgaaagtccttgtttttgc

SEQ ID NO: 61378 - DNA, 22 bp, Artificial Sequence
  chemically synthesized
tttgaaagtccttgtttttgct

SEQ ID NO: 61379 - DNA, 22 bp, Artificial Sequence
  chemically synthesized
gaaagtccttgtttttgctact

SEQ ID NO: 61380 - DNA, 22 bp, Artificial Sequence
  chemically synthesized
aaagtccttgtttttgctacta

SEQ ID NO: 61381 - DNA, 22 bp, Artificial Sequence
  chemically synthesized
gtttttgctactaattatatag

SEQ ID NO: 61382 - DNA, 22 bp, Artificial Sequence
  chemically synthesized
tttttgctactaattatatagt

SEQ ID NO: 61383 - DNA, 22 bp, Artificial Sequence
  chemically synthesized
ttgctactaattatatagtata

SEQ ID NO: 61384 - DNA, 22 bp, Artificial Sequence
  chemically synthesized
tgctactaattatatagtatac

SEQ ID NO: 61385 - DNA, 22 bp, Artificial Sequence
  chemically synthesized
gctactaattatatagtatacc

SEQ ID NO: 61386 - DNA, 22 bp, Artificial Sequence
  chemically synthesized
ctactaattatatagtatacca

SEQ ID NO: 61387 - DNA, 22 bp, Artificial Sequence
  chemically synthesized
ctaattatatagtataccatac

SEQ ID NO: 61388 - DNA, 22 bp, Artificial Sequence
  chemically synthesized
attatatagtataccatacatt

SEQ ID NO: 61389 - DNA, 22 bp, Artificial Sequence
  chemically synthesized
tatagtataccatacattatca

SEQ ID NO: 61390 - DNA, 22 bp, Artificial Sequence
  chemically synthesized
tcattcaaaacaaccatcctgc

SEQ ID NO: 61391 - DNA, 22 bp, Artificial Sequence
  chemically synthesized
aaaacaaccatcctgctcataa

SEQ ID NO: 61392 - DNA, 22 bp, Artificial Sequence
  chemically synthesized
ctcataacatctttgaaaagaa

SEQ ID NO: 61393 - DNA, 22 bp, Artificial Sequence
  chemically synthesized
ataacatctttgaaaagaaaaa

SEQ ID NO: 61394 - DNA, 22 bp, Artificial Sequence
  chemically synthesized
tgaaaagaaaaatatatatgtg

SEQ ID NO: 61395 - DNA, 22 bp, Artificial Sequence
  chemically synthesized
gaaaagaaaaatatatatgtgc

SEQ ID NO: 61396 - DNA, 22 bp, Artificial Sequence
  chemically synthesized
aaaagaaaaatatatatgtgca

SEQ ID NO: 61397 - DNA, 22 bp, Artificial Sequence
  chemically synthesized
tattaaagcaacattttattta

SEQ ID NO: 61398 - DNA, 22 bp, Artificial Sequence
  chemically synthesized
attaaagcaacattttatttaa

SEQ ID NO: 61399 - DNA, 22 bp, Artificial Sequence
  chemically synthesized
ttaaagcaacattttatttaag

SEQ ID NO: 61400 - DNA, 22 bp, Artificial Sequence
  chemically synthesized
aagcaacattttatttaagaat

SEQ ID NO: 61401 - DNA, 22 bp, Artificial Sequence
  chemically synthesized
tatttaagaataaagtcttgtt

SEQ ID NO: 61402 - DNA, 22 bp, Artificial Sequence
  chemically synthesized
atttaagaataaagtcttgtta

SEQ ID NO: 61403 - DNA, 22 bp, Artificial Sequence
  chemically synthesized
tttaagaataaagtcttgttaa

SEQ ID NO: 61404 - DNA, 22 bp, Artificial Sequence
  chemically synthesized
aagaataaagtcttgttaatta

SEQ ID NO: 61405 - DNA, 22 bp, Artificial Sequence
  chemically synthesized
agaataaagtcttgttaattac

SEQ ID NO: 61406 - DNA, 22 bp, Artificial Sequence
  chemically synthesized
gttaattactatattttagatg

SEQ ID NO: 61407 - DNA, 22 bp, Artificial Sequence
  chemically synthesized
ttaattactatattttagatgc

SEQ ID NO: 61408 - DNA, 22 bp, Artificial Sequence
  chemically synthesized
attactatattttagatgcaat

SEQ ID NO: 61409 - DNA, 22 bp, Artificial Sequence
  chemically synthesized
ctatattttagatgcaatgtga

SEQ ID NO: 61410 - DNA, 22 bp, Artificial Sequence
  chemically synthesized
tattttagatgcaatgtgatct

SEQ ID NO: 61411 - DNA, 22 bp, Artificial Sequence
  chemically synthesized
tagatgcaatgtgatctgaagt

SEQ ID NO: 61412 - DNA, 22 bp, Artificial Sequence
  chemically synthesized
agatgcaatgtgatctgaagtt

SEQ ID NO: 61413 - DNA, 22 bp, Artificial Sequence
  chemically synthesized
gatgcaatgtgatctgaagttt

SEQ ID NO: 61414 - DNA, 22 bp, Artificial Sequence
  chemically synthesized
aagtttctaattctggcccaac

SEQ ID NO: 61415 - DNA, 22 bp, Artificial Sequence
  chemically synthesized
ctaattctggcccaactaaatt

SEQ ID NO: 61416 - DNA, 22 bp, Artificial Sequence
  chemically synthesized
taattctggcccaactaaattt

SEQ ID NO: 61417 - DNA, 22 bp, Artificial Sequence
  chemically synthesized
attctggcccaactaaatttct

SEQ ID NO: 61418 - DNA, 22 bp, Artificial Sequence
  chemically synthesized
tggcccaactaaatttctagct

SEQ ID NO: 61419 - DNA, 22 bp, Artificial Sequence
  chemically synthesized
gcccaactaaatttctagctct

SEQ ID NO: 61420 - DNA, 22 bp, Artificial Sequence
  chemically synthesized
aatttctagctctgtttcccta

SEQ ID NO: 61421 - DNA, 22 bp, Artificial Sequence
  chemically synthesized
ctagctctgtttccctaaacaa

SEQ ID NO: 61422 - DNA, 22 bp, Artificial Sequence
  chemically synthesized
tagctctgtttccctaaacaaa

SEQ ID NO: 61423 - DNA, 22 bp, Artificial Sequence
  chemically synthesized
gctctgtttccctaaacaaata

SEQ ID NO: 61424 - DNA, 22 bp, Artificial Sequence
  chemically synthesized
tgtttccctaaacaaataattt

SEQ ID NO: 61425 - DNA, 22 bp, Artificial Sequence
  chemically synthesized
tttccctaaacaaataatttgg

SEQ ID NO: 61426 - DNA, 22 bp, Artificial Sequence
  chemically synthesized
ccctaaacaaataatttggttt

SEQ ID NO: 61427 - DNA, 22 bp, Artificial Sequence
  chemically synthesized
cctaaacaaataatttggtttc

SEQ ID NO: 61428 - DNA, 22 bp, Artificial Sequence
  chemically synthesized
aacaaataatttggtttctctg

SEQ ID NO: 61429 - DNA, 22 bp, Artificial Sequence
  chemically synthesized
ggtttctctgtgcctgcatttt

SEQ ID NO: 61430 - DNA, 22 bp, Artificial Sequence
  chemically synthesized
gtttctctgtgcctgcattttc

SEQ ID NO: 61431 - DNA, 22 bp, Artificial Sequence
  chemically synthesized
ctctgtgcctgcattttccctt

SEQ ID NO: 61432 - DNA, 22 bp, Artificial Sequence
  chemically synthesized
tctgtgcctgcattttcccttt

SEQ ID NO: 61433 - DNA, 22 bp, Artificial Sequence
  chemically synthesized
tgtgcctgcattttccctttgg

SEQ ID NO: 61434 - DNA, 22 bp, Artificial Sequence
  chemically synthesized
tgcctgcattttccctttggag

SEQ ID NO: 61435 - DNA, 22 bp, Artificial Sequence
  chemically synthesized
cattttccctttggagaagaaa

SEQ ID NO: 61436 - DNA, 22 bp, Artificial Sequence
  chemically synthesized
tccctttggagaagaaaagtgc

SEQ ID NO: 61437 - DNA, 22 bp, Artificial Sequence
  chemically synthesized
ccctttggagaagaaaagtgct

SEQ ID NO: 61438 - DNA, 22 bp, Artificial Sequence
  chemically synthesized
cctttggagaagaaaagtgctc

SEQ ID NO: 61439 - DNA, 22 bp, Artificial Sequence
  chemically synthesized
tggagaagaaaagtgctctctc

SEQ ID NO: 61440 - DNA, 22 bp, Artificial Sequence
  chemically synthesized
ggagaagaaaagtgctctctct

SEQ ID NO: 61441 - DNA, 22 bp, Artificial Sequence
  chemically synthesized
gagaagaaaagtgctctctctt

SEQ ID NO: 61442 - DNA, 22 bp, Artificial Sequence
  chemically synthesized
tctcttgagttgaccgagagtc

SEQ ID NO: 61443 - DNA, 22 bp, Artificial Sequence
  chemically synthesized
tcttgagttgaccgagagtccc

SEQ ID NO: 61444 - DNA, 22 bp, Artificial Sequence
  chemically synthesized
ttgagttgaccgagagtcccat

SEQ ID NO: 61445 - DNA, 22 bp, Artificial Sequence
  chemically synthesized
gagttgaccgagagtcccatta

SEQ ID NO: 61446 - DNA, 22 bp, Artificial Sequence
  chemically synthesized
agttgaccgagagtcccattag

SEQ ID NO: 61447 - DNA, 22 bp, Artificial Sequence
  chemically synthesized
accgagagtcccattagggata

SEQ ID NO: 61448 - DNA, 22 bp, Artificial Sequence
  chemically synthesized
gggatagggagacttaaatgca

SEQ ID NO: 61449 - DNA, 22 bp, Artificial Sequence
  chemically synthesized
aaatgcatccacaggggcacag

SEQ ID NO: 61450 - DNA, 22 bp, Artificial Sequence
  chemically synthesized
aatgcatccacaggggcacagg

SEQ ID NO: 61451 - DNA, 22 bp, Artificial Sequence
  chemically synthesized
agcacataaacggaggcccaaa

SEQ ID NO: 61452 - DNA, 22 bp, Artificial Sequence
  chemically synthesized
agagttggccaagaatgaacat

SEQ ID NO: 61453 - DNA, 22 bp, Artificial Sequence
  chemically synthesized
gccaagaatgaacattggctac

SEQ ID NO: 61454 - DNA, 22 bp, Artificial Sequence
  chemically synthesized
gctaccagaccacaagtcagca

SEQ ID NO: 61455 - DNA, 22 bp, Artificial Sequence
  chemically synthesized
ccagaccacaagtcagcatgag

SEQ ID NO: 61456 - DNA, 22 bp, Artificial Sequence
  chemically synthesized
ctctatggcatcaaattgcaac

SEQ ID NO: 61457 - DNA, 22 bp, Artificial Sequence
  chemically synthesized
tatggcatcaaattgcaacttg

SEQ ID NO: 61458 - DNA, 22 bp, Artificial Sequence
  chemically synthesized
tggcatcaaattgcaacttgag

SEQ ID NO: 61459 - DNA, 22 bp, Artificial Sequence
  chemically synthesized
caacttgagagtagatgggcag

SEQ ID NO: 61460 - DNA, 22 bp, Artificial Sequence
  chemically synthesized
gagagtagatgggcagggtcac

SEQ ID NO: 61461 - DNA, 22 bp, Artificial Sequence
  chemically synthesized
agagtagatgggcagggtcact

SEQ ID NO: 61462 - DNA, 22 bp, Artificial Sequence
  chemically synthesized
tcaaattaagcaatcagggcac

SEQ ID NO: 61463 - DNA, 22 bp, Artificial Sequence
  chemically synthesized
agcaatcagggcacacaagttg

SEQ ID NO: 61464 - DNA, 22 bp, Artificial Sequence
  chemically synthesized
cagtaacacaacaagactaggc

SEQ ID NO: 61465 - DNA, 22 bp, Artificial Sequence
  chemically synthesized
ggccagctctggaatccagtaa

SEQ ID NO: 61466 - DNA, 22 bp, Artificial Sequence
  chemically synthesized
tggaatccagtaactcagtgtc

SEQ ID NO: 61467 - DNA, 22 bp, Artificial Sequence
  chemically synthesized
gaatccagtaactcagtgtcag

SEQ ID NO: 61468 - DNA, 22 bp, Artificial Sequence
  chemically synthesized
agtgtcagcaaggttttgggtt

SEQ ID NO: 61469 - DNA, 22 bp, Artificial Sequence
  chemically synthesized
tgggttatagttcaagaaagtc

SEQ ID NO: 61470 - DNA, 22 bp, Artificial Sequence
  chemically synthesized
gggttatagttcaagaaagtct

SEQ ID NO: 61471 - DNA, 22 bp, Artificial Sequence
  chemically synthesized
ggttatagttcaagaaagtcta

SEQ ID NO: 61472 - DNA, 22 bp, Artificial Sequence
  chemically synthesized
tagttcaagaaagtctaaacag

SEQ ID NO: 61473 - DNA, 22 bp, Artificial Sequence
  chemically synthesized
aagaaagtctaaacagagccag

SEQ ID NO: 61474 - DNA, 22 bp, Artificial Sequence
  chemically synthesized
aacagagccagtcacagcacca

SEQ ID NO: 61475 - DNA, 22 bp, Artificial Sequence
  chemically synthesized
aagggagctattgcaggtttct

SEQ ID NO: 61476 - DNA, 22 bp, Artificial Sequence
  chemically synthesized
ttgcaggtttctctgctaagag

SEQ ID NO: 61477 - DNA, 22 bp, Artificial Sequence
  chemically synthesized
caggtttctctgctaagagatt

SEQ ID NO: 61478 - DNA, 22 bp, Artificial Sequence
  chemically synthesized
ctctgctaagagatttatttca

SEQ ID NO: 61479 - DNA, 22 bp, Artificial Sequence
  chemically synthesized
tctgctaagagatttatttcat

SEQ ID NO: 61480 - DNA, 22 bp, Artificial Sequence
  chemically synthesized
tgctaagagatttatttcatcc

SEQ ID NO: 61481 - DNA, 22 bp, Artificial Sequence
  chemically synthesized
ctaagagatttatttcatcctg

SEQ ID NO: 61482 - DNA, 22 bp, Artificial Sequence
  chemically synthesized
agagatttatttcatcctgggt

SEQ ID NO: 61483 - DNA, 22 bp, Artificial Sequence
  chemically synthesized
atttcatcctgggtgcagggtt

SEQ ID NO: 61484 - DNA, 22 bp, Artificial Sequence
  chemically synthesized
tttcatcctgggtgcagggttc

SEQ ID NO: 61485 - DNA, 22 bp, Artificial Sequence
  chemically synthesized
catcctgggtgcagggttcgac

SEQ ID NO: 61486 - DNA, 22 bp, Artificial Sequence
  chemically synthesized
atcctgggtgcagggttcgacc

SEQ ID NO: 61487 - DNA, 22 bp, Artificial Sequence
  chemically synthesized
ggtgcagggttcgacctccaaa

SEQ ID NO: 61488 - DNA, 22 bp, Artificial Sequence
  chemically synthesized
gacctccaaaggcctcaaatca

SEQ ID NO: 61489 - DNA, 22 bp, Artificial Sequence
  chemically synthesized
caaaggcctcaaatcatcaccg

SEQ ID NO: 61490 - DNA, 22 bp, Artificial Sequence
  chemically synthesized
aaatcatcaccgtatcaatgga

SEQ ID NO: 61491 - DNA, 22 bp, Artificial Sequence
  chemically synthesized
cctgagggtaagctccgctatt

SEQ ID NO: 61492 - DNA, 22 bp, Artificial Sequence
  chemically synthesized
ctgagggtaagctccgctattt

SEQ ID NO: 61493 - DNA, 22 bp, Artificial Sequence
  chemically synthesized
agggtaagctccgctatttcac

SEQ ID NO: 61494 - DNA, 22 bp, Artificial Sequence
  chemically synthesized
cgctatttcacacctgaactcc

SEQ ID NO: 61495 - DNA, 22 bp, Artificial Sequence
  chemically synthesized
tttcacacctgaactccggagt

SEQ ID NO: 61496 - DNA, 22 bp, Artificial Sequence
  chemically synthesized
cacacctgaactccggagtctg

SEQ ID NO: 61497 - DNA, 22 bp, Artificial Sequence
  chemically synthesized
acacctgaactccggagtctgt

SEQ ID NO: 61498 - DNA, 22 bp, Artificial Sequence
  chemically synthesized
aactccggagtctgtatattca

SEQ ID NO: 61499 - DNA, 22 bp, Artificial Sequence
  chemically synthesized
cggagtctgtatattcagggaa

SEQ ID NO: 61500 - DNA, 22 bp, Artificial Sequence
  chemically synthesized
tatattcagggaagattgcatt

SEQ ID NO: 61501 - DNA, 22 bp, Artificial Sequence
  chemically synthesized
agggaagattgcattctcctac

SEQ ID NO: 61502 - DNA, 22 bp, Artificial Sequence
  chemically synthesized
cattctcctactggatttgggc

SEQ ID NO: 61503 - DNA, 22 bp, Artificial Sequence
  chemically synthesized
tcctactggatttgggctctca

SEQ ID NO: 61504 - DNA, 22 bp, Artificial Sequence
  chemically synthesized
ctactggatttgggctctcaga

SEQ ID NO: 61505 - DNA, 22 bp, Artificial Sequence
  chemically synthesized
ctggatttgggctctcagaggg

SEQ ID NO: 61506 - DNA, 22 bp, Artificial Sequence
  chemically synthesized
gatttgggctctcagagggcgt

SEQ ID NO: 61507 - DNA, 22 bp, Artificial Sequence
  chemically synthesized
gggctctcagagggcgttgtgg

SEQ ID NO: 61508 - DNA, 22 bp, Artificial Sequence
  chemically synthesized
ggctctcagagggcgttgtggg

SEQ ID NO: 61509 - DNA, 22 bp, Artificial Sequence
  chemically synthesized
tcagagggcgttgtgggaacca

SEQ ID NO: 61510 - DNA, 22 bp, Artificial Sequence
  chemically synthesized
agagggcgttgtgggaaccagg

SEQ ID NO: 61511 - DNA, 22 bp, Artificial Sequence
  chemically synthesized
tgggaaccaggcccctcacaga

SEQ ID NO: 61512 - DNA, 22 bp, Artificial Sequence
  chemically synthesized
acagaatcaaatggtcccaacc

SEQ ID NO: 61513 - DNA, 22 bp, Artificial Sequence
  chemically synthesized
ttttttttttttaatagagatg

SEQ ID NO: 61514 - DNA, 22 bp, Artificial Sequence
  chemically synthesized
tttttttttttaatagagatgg

SEQ ID NO: 61515 - DNA, 22 bp, Artificial Sequence
  chemically synthesized
ttttttttttaatagagatggg

SEQ ID NO: 61516 - DNA, 22 bp, Artificial Sequence
  chemically synthesized
tttttttttaatagagatgggg

SEQ ID NO: 61517 - DNA, 22 bp, Artificial Sequence
  chemically synthesized
ttttttttaatagagatggggg

SEQ ID NO: 61518 - DNA, 22 bp, Artificial Sequence
  chemically synthesized
tttttttaatagagatgggggt

SEQ ID NO: 61519 - DNA, 22 bp, Artificial Sequence
  chemically synthesized
ttttttaatagagatgggggtc

SEQ ID NO: 61520 - DNA, 22 bp, Artificial Sequence
  chemically synthesized
tttttaatagagatgggggtct

SEQ ID NO: 61521 - DNA, 22 bp, Artificial Sequence
  chemically synthesized
ttttaatagagatgggggtctc

SEQ ID NO: 61522 - DNA, 22 bp, Artificial Sequence
  chemically synthesized
tttaatagagatgggggtctca

SEQ ID NO: 61523 - DNA, 22 bp, Artificial Sequence
  chemically synthesized
ttaatagagatgggggtctcac

SEQ ID NO: 61524 - DNA, 22 bp, Artificial Sequence
  chemically synthesized
taatagagatgggggtctcact

SEQ ID NO: 61525 - DNA, 22 bp, Artificial Sequence
  chemically synthesized
aatagagatgggggtctcacta

SEQ ID NO: 61526 - DNA, 22 bp, Artificial Sequence
  chemically synthesized
atagagatgggggtctcactat

SEQ ID NO: 61527 - DNA, 22 bp, Artificial Sequence
  chemically synthesized
actatgctgcccaggctggtct

SEQ ID NO: 61528 - DNA, 22 bp, Artificial Sequence
  chemically synthesized
tgctgcccaggctggtcttgaa

SEQ ID NO: 61529 - DNA, 22 bp, Artificial Sequence
  chemically synthesized
cccaggctggtcttgaactcct

SEQ ID NO: 61530 - DNA, 22 bp, Artificial Sequence
  chemically synthesized
gtcttgaactcctgggttcaag

SEQ ID NO: 61531 - DNA, 22 bp, Artificial Sequence
  chemically synthesized
gaactcctgggttcaagtgatc

SEQ ID NO: 61532 - DNA, 22 bp, Artificial Sequence
  chemically synthesized
aactcctgggttcaagtgatcc

SEQ ID NO: 61533 - DNA, 22 bp, Artificial Sequence
  chemically synthesized
ctgggttcaagtgatcctcctg

SEQ ID NO: 61534 - DNA, 22 bp, Artificial Sequence
  chemically synthesized
ggttcaagtgatcctcctgcct

SEQ ID NO: 61535 - DNA, 22 bp, Artificial Sequence
  chemically synthesized
aagtgatcctcctgcctcagcc

SEQ ID NO: 61536 - DNA, 22 bp, Artificial Sequence
  chemically synthesized
ctgcctcagcctcccaaagtgc

SEQ ID NO: 61537 - DNA, 22 bp, Artificial Sequence
  chemically synthesized
cctcagcctcccaaagtgctgg

SEQ ID NO: 61538 - DNA, 22 bp, Artificial Sequence
  chemically synthesized
agcctcccaaagtgctgggatt

SEQ ID NO: 61539 - DNA, 22 bp, Artificial Sequence
  chemically synthesized
ccaaagtgctgggattacagtg

SEQ ID NO: 61540 - DNA, 22 bp, Artificial Sequence
  chemically synthesized
ggattacagtgtgagccactgc

SEQ ID NO: 61541 - DNA, 22 bp, Artificial Sequence
  chemically synthesized
cagtgtgagccactgcgcttgg

SEQ ID NO: 61542 - DNA, 22 bp, Artificial Sequence
  chemically synthesized
cgcttggccagaaatggttttg

SEQ ID NO: 61543 - DNA, 22 bp, Artificial Sequence
  chemically synthesized
ggccagaaatggttttgatctg

SEQ ID NO: 61544 - DNA, 22 bp, Artificial Sequence
  chemically synthesized
gccagaaatggttttgatctgt

SEQ ID NO: 61545 - DNA, 22 bp, Artificial Sequence
  chemically synthesized
tgatctgtctgaactgaaccct

SEQ ID NO: 61546 - DNA, 22 bp, Artificial Sequence
  chemically synthesized
gatctgtctgaactgaacccta

SEQ ID NO: 61547 - DNA, 22 bp, Artificial Sequence
  chemically synthesized
atctgtctgaactgaaccctac

SEQ ID NO: 61548 - DNA, 22 bp, Artificial Sequence
  chemically synthesized
tctgaactgaaccctactgctt

SEQ ID NO: 61549 - DNA, 22 bp, Artificial Sequence
  chemically synthesized
aactgaaccctactgcttaggc

SEQ ID NO: 61550 - DNA, 22 bp, Artificial Sequence
  chemically synthesized
aaccctactgcttaggcatagc

SEQ ID NO: 61551 - DNA, 22 bp, Artificial Sequence
  chemically synthesized
ctgcttaggcatagccccatcc

SEQ ID NO: 61552 - DNA, 22 bp, Artificial Sequence
  chemically synthesized
cttaggcatagccccatccttg

SEQ ID NO: 61553 - DNA, 22 bp, Artificial Sequence
  chemically synthesized
aggcatagccccatccttgata

SEQ ID NO: 61554 - DNA, 22 bp, Artificial Sequence
  chemically synthesized
ggcatagccccatccttgataa

SEQ ID NO: 61555 - DNA, 22 bp, Artificial Sequence
  chemically synthesized
gataatctatttgctcccaagg

SEQ ID NO: 61556 - DNA, 22 bp, Artificial Sequence
  chemically synthesized
ataatctatttgctcccaagga

SEQ ID NO: 61557 - DNA, 22 bp, Artificial Sequence
  chemically synthesized
tttgctcccaaggaccaagtcc

SEQ ID NO: 61558 - DNA, 22 bp, Artificial Sequence
  chemically synthesized
gctcccaaggaccaagtccaag

SEQ ID NO: 61559 - DNA, 22 bp, Artificial Sequence
  chemically synthesized
ctcccaaggaccaagtccaaga

SEQ ID NO: 61560 - DNA, 22 bp, Artificial Sequence
  chemically synthesized
ccaaggaccaagtccaagatcc

SEQ ID NO: 61561 - DNA, 22 bp, Artificial Sequence
  chemically synthesized
acaagaaaggtctgccagaaag

SEQ ID NO: 61562 - DNA, 22 bp, Artificial Sequence
  chemically synthesized
caagaaaggtctgccagaaagt

SEQ ID NO: 61563 - DNA, 22 bp, Artificial Sequence
  chemically synthesized
ccagaaagtaaatactgccccc

SEQ ID NO: 61564 - DNA, 22 bp, Artificial Sequence
  chemically synthesized
cccccactccctgaagtttatg

SEQ ID NO: 61565 - DNA, 22 bp, Artificial Sequence
  chemically synthesized
cctgaagtttatgaggttgata

SEQ ID NO: 61566 - DNA, 22 bp, Artificial Sequence
  chemically synthesized
aagtttatgaggttgataagaa

SEQ ID NO: 61567 - DNA, 22 bp, Artificial Sequence
  chemically synthesized
atgaggttgataagaaaacata

SEQ ID NO: 61568 - DNA, 22 bp, Artificial Sequence
  chemically synthesized
tgaggttgataagaaaacataa

SEQ ID NO: 61569 - DNA, 22 bp, Artificial Sequence
  chemically synthesized
ataagaaaacataacagataaa

SEQ ID NO: 61570 - DNA, 22 bp, Artificial Sequence
  chemically synthesized
attgagtgctaactttatgcca

SEQ ID NO: 61571 - DNA, 22 bp, Artificial Sequence
  chemically synthesized
ttgagtgctaactttatgccag

SEQ ID NO: 61572 - DNA, 22 bp, Artificial Sequence
  chemically synthesized
agtgctaactttatgccagatt

SEQ ID NO: 61573 - DNA, 22 bp, Artificial Sequence
  chemically synthesized
actttatgccagattctgttct

SEQ ID NO: 61574 - DNA, 22 bp, Artificial Sequence
  chemically synthesized
tatgccagattctgttctatgt

SEQ ID NO: 61575 - DNA, 22 bp, Artificial Sequence
  chemically synthesized
atgccagattctgttctatgta

SEQ ID NO: 61576 - DNA, 22 bp, Artificial Sequence
  chemically synthesized
tgccagattctgttctatgtac

SEQ ID NO: 61577 - DNA, 22 bp, Artificial Sequence
  chemically synthesized
tgttctatgtactttatttata

SEQ ID NO: 61578 - DNA, 22 bp, Artificial Sequence
  chemically synthesized
ttctatgtactttatttataca

SEQ ID NO: 61579 - DNA, 22 bp, Artificial Sequence
  chemically synthesized
tatgtactttatttatacaatt

SEQ ID NO: 61580 - DNA, 22 bp, Artificial Sequence
  chemically synthesized
tgtactttatttatacaattaa

SEQ ID NO: 61581 - DNA, 22 bp, Artificial Sequence
  chemically synthesized
tatttatacaattaactcgctt

SEQ ID NO: 61582 - DNA, 22 bp, Artificial Sequence
  chemically synthesized
atttatacaattaactcgctta

SEQ ID NO: 61583 - DNA, 22 bp, Artificial Sequence
  chemically synthesized
tttatacaattaactcgcttag

SEQ ID NO: 61584 - DNA, 22 bp, Artificial Sequence
  chemically synthesized
atacaattaactcgcttagttc

SEQ ID NO: 61585 - DNA, 22 bp, Artificial Sequence
  chemically synthesized
tacaattaactcgcttagttct

SEQ ID NO: 61586 - DNA, 22 bp, Artificial Sequence
  chemically synthesized
actcgcttagttctcccaacat

SEQ ID NO: 61587 - DNA, 22 bp, Artificial Sequence
  chemically synthesized
gcttagttctcccaacatctct

SEQ ID NO: 61588 - DNA, 22 bp, Artificial Sequence
  chemically synthesized
agttctcccaacatctctgtga

SEQ ID NO: 61589 - DNA, 22 bp, Artificial Sequence
  chemically synthesized
gttctcccaacatctctgtgag

SEQ ID NO: 61590 - DNA, 22 bp, Artificial Sequence
  chemically synthesized
tcccaacatctctgtgagttgg

SEQ ID NO: 61591 - DNA, 22 bp, Artificial Sequence
  chemically synthesized
ccaacatctctgtgagttggct

SEQ ID NO: 61592 - DNA, 22 bp, Artificial Sequence
  chemically synthesized
tgtgagttggctactgtcattt

SEQ ID NO: 61593 - DNA, 22 bp, Artificial Sequence
  chemically synthesized
tgagttggctactgtcatttat

SEQ ID NO: 61594 - DNA, 22 bp, Artificial Sequence
  chemically synthesized
gctactgtcatttatccttata

SEQ ID NO: 61595 - DNA, 22 bp, Artificial Sequence
  chemically synthesized
ctgtcatttatccttatattac

SEQ ID NO: 61596 - DNA, 22 bp, Artificial Sequence
  chemically synthesized
tcatttatccttatattacaaa

SEQ ID NO: 61597 - DNA, 22 bp, Artificial Sequence
  chemically synthesized
atccttatattacaaataggtc

SEQ ID NO: 61598 - DNA, 22 bp, Artificial Sequence
  chemically synthesized
tccttatattacaaataggtcc

SEQ ID NO: 61599 - DNA, 22 bp, Artificial Sequence
  chemically synthesized
atattacaaataggtccagagg

SEQ ID NO: 61600 - DNA, 22 bp, Artificial Sequence
  chemically synthesized
tattacaaataggtccagaggg

SEQ ID NO: 61601 - DNA, 22 bp, Artificial Sequence
  chemically synthesized
caaataggtccagaggggttag

SEQ ID NO: 61602 - DNA, 22 bp, Artificial Sequence
  chemically synthesized
gtcatcttgtccagaatggtgg

SEQ ID NO: 61603 - DNA, 22 bp, Artificial Sequence
  chemically synthesized
gtccagaatggtggaaccaggt

SEQ ID NO: 61604 - DNA, 22 bp, Artificial Sequence
  chemically synthesized
tccagaatggtggaaccaggtt

SEQ ID NO: 61605 - DNA, 22 bp, Artificial Sequence
  chemically synthesized
aggatcaggcagtctgggctgg

SEQ ID NO: 61606 - DNA, 22 bp, Artificial Sequence
  chemically synthesized
ggctgggcatggtggctcacat

SEQ ID NO: 61607 - DNA, 22 bp, Artificial Sequence
  chemically synthesized
ggcatggtggctcacatctgta

SEQ ID NO: 61608 - DNA, 22 bp, Artificial Sequence
  chemically synthesized
acatctgtaatcccagcacttt

SEQ ID NO: 61609 - DNA, 22 bp, Artificial Sequence
  chemically synthesized
taatcccagcactttgggaggc

SEQ ID NO: 61610 - DNA, 22 bp, Artificial Sequence
  chemically synthesized
tgggaggctgaggtggcagatt

SEQ ID NO: 61611 - DNA, 22 bp, Artificial Sequence
  chemically synthesized
gggaggctgaggtggcagattg

SEQ ID NO: 61612 - DNA, 22 bp, Artificial Sequence
  chemically synthesized
ggaggctgaggtggcagattgc

SEQ ID NO: 61613 - DNA, 22 bp, Artificial Sequence
  chemically synthesized
aggtggcagattgcctgagctc

SEQ ID NO: 61614 - DNA, 22 bp, Artificial Sequence
  chemically synthesized
cctgagctcaggagttcgagac

SEQ ID NO: 61615 - DNA, 22 bp, Artificial Sequence
  chemically synthesized
agctcaggagttcgagaccagc

SEQ ID NO: 61616 - DNA, 22 bp, Artificial Sequence
  chemically synthesized
aggagttcgagaccagcctggg

SEQ ID NO: 61617 - DNA, 22 bp, Artificial Sequence
  chemically synthesized
gagaccagcctgggcaacatgg

SEQ ID NO: 61618 - DNA, 22 bp, Artificial Sequence
  chemically synthesized
ggcaacatggtgagacccccgt

SEQ ID NO: 61619 - DNA, 22 bp, Artificial Sequence
  chemically synthesized
taccaaaaatacaaaacattag

SEQ ID NO: 61620 - DNA, 22 bp, Artificial Sequence
  chemically synthesized
gccaagcgtggtggtgcatgcc

SEQ ID NO: 61621 - DNA, 22 bp, Artificial Sequence
  chemically synthesized
tggtcctaactactcaggtggc

SEQ ID NO: 61622 - DNA, 22 bp, Artificial Sequence
  chemically synthesized
actactcaggtggctgaggtgg

SEQ ID NO: 61623 - DNA, 22 bp, Artificial Sequence
  chemically synthesized
ctcaggtggctgaggtgggaga

SEQ ID NO: 61624 - DNA, 22 bp, Artificial Sequence
  chemically synthesized
aggtggctgaggtgggagaatc

SEQ ID NO: 61625 - DNA, 22 bp, Artificial Sequence
  chemically synthesized
aggtgggagaatcccttgagct

SEQ ID NO: 61626 - DNA, 22 bp, Artificial Sequence
  chemically synthesized
gagctcagaggttgcagtgagc

SEQ ID NO: 61627 - DNA, 22 bp, Artificial Sequence
  chemically synthesized
agctcagaggttgcagtgagcc

SEQ ID NO: 61628 - DNA, 22 bp, Artificial Sequence
  chemically synthesized
agaggttgcagtgagccaagat

SEQ ID NO: 61629 - DNA, 22 bp, Artificial Sequence
  chemically synthesized
cagtgagccaagattatgccac

SEQ ID NO: 61630 - DNA, 22 bp, Artificial Sequence
  chemically synthesized
tgccactgcactccagcctggg

SEQ ID NO: 61631 - DNA, 22 bp, Artificial Sequence
  chemically synthesized
cactccagcctgggtgacagag

SEQ ID NO: 61632 - DNA, 22 bp, Artificial Sequence
  chemically synthesized
cagcctgggtgacagagtgaga

SEQ ID NO: 61633 - DNA, 22 bp, Artificial Sequence
  chemically synthesized
ggtgacagagtgagaccctgtc

SEQ ID NO: 61634 - DNA, 22 bp, Artificial Sequence
  chemically synthesized
tctcagaaaaaaaaaaaaaaaa

SEQ ID NO: 61635 - DNA, 22 bp, Artificial Sequence
  chemically synthesized
agaaaaaaaaaaaaaaaagaag

SEQ ID NO: 61636 - DNA, 22 bp, Artificial Sequence
  chemically synthesized
ggctgggtgctgtggctcgcgc

SEQ ID NO: 61637 - DNA, 22 bp, Artificial Sequence
  chemically synthesized
ggtgctgtggctcgcgcctgta

SEQ ID NO: 61638 - DNA, 22 bp, Artificial Sequence
  chemically synthesized
tggctcgcgcctgtaatcccag

SEQ ID NO: 61639 - DNA, 22 bp, Artificial Sequence
  chemically synthesized
gcgcctgtaatcccagatacaa

SEQ ID NO: 61640 - DNA, 22 bp, Artificial Sequence
  chemically synthesized
taatcccagatacaaaataatc

SEQ ID NO: 61641 - DNA, 22 bp, Artificial Sequence
  chemically synthesized
tgtaatatatcctgcttattag

SEQ ID NO: 61642 - DNA, 22 bp, Artificial Sequence
  chemically synthesized
gtaatatatcctgcttattaga

SEQ ID NO: 61643 - DNA, 22 bp, Artificial Sequence
  chemically synthesized
taatatatcctgcttattagac

SEQ ID NO: 61644 - DNA, 22 bp, Artificial Sequence
  chemically synthesized
cttattagacagaacattttga

SEQ ID NO: 61645 - DNA, 22 bp, Artificial Sequence
  chemically synthesized
attagacagaacattttgatca

SEQ ID NO: 61646 - DNA, 22 bp, Artificial Sequence
  chemically synthesized
ttagacagaacattttgatcac

SEQ ID NO: 61647 - DNA, 22 bp, Artificial Sequence
  chemically synthesized
gacagaacattttgatcactca

SEQ ID NO: 61648 - DNA, 22 bp, Artificial Sequence
  chemically synthesized
tgatcactcatctgttccctaa

SEQ ID NO: 61649 - DNA, 22 bp, Artificial Sequence
  chemically synthesized
gatcactcatctgttccctaag

SEQ ID NO: 61650 - DNA, 22 bp, Artificial Sequence
  chemically synthesized
atcactcatctgttccctaagt

SEQ ID NO: 61651 - DNA, 22 bp, Artificial Sequence
  chemically synthesized
atctgttccctaagttatagat

SEQ ID NO: 61652 - DNA, 22 bp, Artificial Sequence
  chemically synthesized
ttccctaagttatagatttacg

SEQ ID NO: 61653 - DNA, 22 bp, Artificial Sequence
  chemically synthesized
cctaagttatagatttacgtcc

SEQ ID NO: 61654 - DNA, 22 bp, Artificial Sequence
  chemically synthesized
agttatagatttacgtccactt

SEQ ID NO: 61655 - DNA, 22 bp, Artificial Sequence
  chemically synthesized
tagatttacgtccactttagaa

SEQ ID NO: 61656 - DNA, 22 bp, Artificial Sequence
  chemically synthesized
acgtccactttagaaatggctt

SEQ ID NO: 61657 - DNA, 22 bp, Artificial Sequence
  chemically synthesized
cgtccactttagaaatggcttg

SEQ ID NO: 61658 - DNA, 22 bp, Artificial Sequence
  chemically synthesized
tagaaatggcttgtgaggcaag

SEQ ID NO: 61659 - DNA, 22 bp, Artificial Sequence
  chemically synthesized
agaaatggcttgtgaggcaagt

SEQ ID NO: 61660 - DNA, 22 bp, Artificial Sequence
  chemically synthesized
gaaatggcttgtgaggcaagtt

SEQ ID NO: 61661 - DNA, 22 bp, Artificial Sequence
  chemically synthesized
gtgaggcaagtttaagtgaccg

SEQ ID NO: 61662 - DNA, 22 bp, Artificial Sequence
  chemically synthesized
tgaggcaagtttaagtgaccga

SEQ ID NO: 61663 - DNA, 22 bp, Artificial Sequence
  chemically synthesized
aagtgaccgatgacagttttaa

SEQ ID NO: 61664 - DNA, 22 bp, Artificial Sequence
  chemically synthesized
agtgaccgatgacagttttaaa

SEQ ID NO: 61665 - DNA, 22 bp, Artificial Sequence
  chemically synthesized
taaagcaaggtccatgtcatgt

SEQ ID NO: 61666 - DNA, 22 bp, Artificial Sequence
  chemically synthesized
aaagcaaggtccatgtcatgtt

SEQ ID NO: 61667 - DNA, 22 bp, Artificial Sequence
  chemically synthesized
aagcaaggtccatgtcatgtta

SEQ ID NO: 61668 - DNA, 22 bp, Artificial Sequence
  chemically synthesized
tggcataatttggtagaatgtt

SEQ ID NO: 61669 - DNA, 22 bp, Artificial Sequence
  chemically synthesized
ggtagaatgttctagtagtgta

SEQ ID NO: 61670 - DNA, 22 bp, Artificial Sequence
  chemically synthesized
gtagaatgttctagtagtgtat

SEQ ID NO: 61671 - DNA, 22 bp, Artificial Sequence
  chemically synthesized
tagtagtgtatcagttttcagg

SEQ ID NO: 61672 - DNA, 22 bp, Artificial Sequence
  chemically synthesized
gtagtgtatcagttttcaggtg

SEQ ID NO: 61673 - DNA, 22 bp, Artificial Sequence
  chemically synthesized
tcaggtggtaggcttgaggatg

SEQ ID NO: 61674 - DNA, 22 bp, Artificial Sequence
  chemically synthesized
caggtggtaggcttgaggatga

SEQ ID NO: 61675 - DNA, 22 bp, Artificial Sequence
  chemically synthesized
aggtggtaggcttgaggatgat

SEQ ID NO: 61676 - DNA, 22 bp, Artificial Sequence
  chemically synthesized
gaggatgatacacacacacaca

SEQ ID NO: 61677 - DNA, 22 bp, Artificial Sequence
  chemically synthesized
aggatgatacacacacacacac

SEQ ID NO: 61678 - DNA, 22 bp, Artificial Sequence
  chemically synthesized
tattattgcccaaagaaaatag

SEQ ID NO: 61679 - DNA, 22 bp, Artificial Sequence
  chemically synthesized
ttattgcccaaagaaaatagac

SEQ ID NO: 61680 - DNA, 22 bp, Artificial Sequence
  chemically synthesized
ttgcccaaagaaaatagaccca

SEQ ID NO: 61681 - DNA, 22 bp, Artificial Sequence
  chemically synthesized
cccaaagaaaatagacccatta

SEQ ID NO: 61682 - DNA, 22 bp, Artificial Sequence
  chemically synthesized
aggaagtccaacttctgctgcg

SEQ ID NO: 61683 - DNA, 22 bp, Artificial Sequence
  chemically synthesized
ctgctgcgtggaccagtgctgc

SEQ ID NO: 61684 - DNA, 22 bp, Artificial Sequence
  chemically synthesized
tgctgcgtggaccagtgctgcc

SEQ ID NO: 61685 - DNA, 22 bp, Artificial Sequence
  chemically synthesized
ctgcgtggaccagtgctgccac

SEQ ID NO: 61686 - DNA, 22 bp, Artificial Sequence
  chemically synthesized
cgtggaccagtgctgccacatc

SEQ ID NO: 61687 - DNA, 22 bp, Artificial Sequence
  chemically synthesized
ccacatcacacatagaccaaag

SEQ ID NO: 61688 - DNA, 22 bp, Artificial Sequence
  chemically synthesized
aggtttttgtggttttggttat

SEQ ID NO: 61689 - DNA, 22 bp, Artificial Sequence
  chemically synthesized
ggtttttgtggttttggttatt

SEQ ID NO: 61690 - DNA, 22 bp, Artificial Sequence
  chemically synthesized
ttgtggttttggttatttattt

SEQ ID NO: 61691 - DNA, 22 bp, Artificial Sequence
  chemically synthesized
tgtggttttggttatttatttt

SEQ ID NO: 61692 - DNA, 22 bp, Artificial Sequence
  chemically synthesized
gtggttttggttatttatttta

SEQ ID NO: 61693 - DNA, 22 bp, Artificial Sequence
  chemically synthesized
tggttttggttatttattttat

SEQ ID NO: 61694 - DNA, 22 bp, Artificial Sequence
  chemically synthesized
tggttatttattttatcttttt

SEQ ID NO: 61695 - DNA, 22 bp, Artificial Sequence
  chemically synthesized
ggttatttattttatcttttta

SEQ ID NO: 61696 - DNA, 22 bp, Artificial Sequence
  chemically synthesized
gttatttattttatctttttat

SEQ ID NO: 61697 - DNA, 22 bp, Artificial Sequence
  chemically synthesized
tttattttatctttttatttta

SEQ ID NO: 61698 - DNA, 22 bp, Artificial Sequence
  chemically synthesized
attttatctttttattttattt

SEQ ID NO: 61699 - DNA, 22 bp, Artificial Sequence
  chemically synthesized
ttttatctttttattttatttt

SEQ ID NO: 61700 - DNA, 22 bp, Artificial Sequence
  chemically synthesized
tatctttttattttattttatc

SEQ ID NO: 61701 - DNA, 22 bp, Artificial Sequence
  chemically synthesized
atctttttattttattttatct

SEQ ID NO: 61702 - DNA, 22 bp, Artificial Sequence
  chemically synthesized
tctttttattttattttatctt

SEQ ID NO: 61703 - DNA, 22 bp, Artificial Sequence
  chemically synthesized
tttattttattttatcttattt

SEQ ID NO: 61704 - DNA, 22 bp, Artificial Sequence
  chemically synthesized
ttattttattttatcttatttt

SEQ ID NO: 61705 - DNA, 22 bp, Artificial Sequence
  chemically synthesized
tattttattttatcttatttta

SEQ ID NO: 61706 - DNA, 22 bp, Artificial Sequence
  chemically synthesized
attttattttatcttattttat

SEQ ID NO: 61707 - DNA, 22 bp, Artificial Sequence
  chemically synthesized
ttttattttatcttattttatt

SEQ ID NO: 61708 - DNA, 22 bp, Artificial Sequence
  chemically synthesized
tattttatcttattttatttta

SEQ ID NO: 61709 - DNA, 22 bp, Artificial Sequence
  chemically synthesized
attttatcttattttattttat

SEQ ID NO: 61710 - DNA, 22 bp, Artificial Sequence
  chemically synthesized
ttttatcttattttattttatt

SEQ ID NO: 61711 - DNA, 22 bp, Artificial Sequence
  chemically synthesized
tatcttattttattttatttta

SEQ ID NO: 61712 - DNA, 22 bp, Artificial Sequence
  chemically synthesized
atcttattttattttattttat

SEQ ID NO: 61713 - DNA, 22 bp, Artificial Sequence
  chemically synthesized
tcttattttattttattttatt

SEQ ID NO: 61714 - DNA, 22 bp, Artificial Sequence
  chemically synthesized
attttattttattttattttat

SEQ ID NO: 61715 - DNA, 22 bp, Artificial Sequence
  chemically synthesized
ttttattttattttattttatt

SEQ ID NO: 61716 - DNA, 22 bp, Artificial Sequence
  chemically synthesized
tattttattttattttattatt

SEQ ID NO: 61717 - DNA, 22 bp, Artificial Sequence
  chemically synthesized
attttattttattttattattt

SEQ ID NO: 61718 - DNA, 22 bp, Artificial Sequence
  chemically synthesized
ttttattttattttattatttg

SEQ ID NO: 61719 - DNA, 22 bp, Artificial Sequence
  chemically synthesized
tattttattttattatttgaga

SEQ ID NO: 61720 - DNA, 22 bp, Artificial Sequence
  chemically synthesized
attttattttattatttgagat

SEQ ID NO: 61721 - DNA, 22 bp, Artificial Sequence
  chemically synthesized
ttttattttattatttgagatg

SEQ ID NO: 61722 - DNA, 22 bp, Artificial Sequence
  chemically synthesized
tattttattatttgagatggag

SEQ ID NO: 61723 - DNA, 22 bp, Artificial Sequence
  chemically synthesized
attttattatttgagatggagt

SEQ ID NO: 61724 - DNA, 22 bp, Artificial Sequence
  chemically synthesized
ttttattatttgagatggagtc

SEQ ID NO: 61725 - DNA, 22 bp, Artificial Sequence
  chemically synthesized
tattatttgagatggagtctca

SEQ ID NO: 61726 - DNA, 22 bp, Artificial Sequence
  chemically synthesized
attatttgagatggagtctcac

SEQ ID NO: 61727 - DNA, 22 bp, Artificial Sequence
  chemically synthesized
ttatttgagatggagtctcact

SEQ ID NO: 61728 - DNA, 22 bp, Artificial Sequence
  chemically synthesized
tttgagatggagtctcactctg

SEQ ID NO: 61729 - DNA, 22 bp, Artificial Sequence
  chemically synthesized
gagatggagtctcactctgtca

SEQ ID NO: 61730 - DNA, 22 bp, Artificial Sequence
  chemically synthesized
agatggagtctcactctgtcac

SEQ ID NO: 61731 - DNA, 22 bp, Artificial Sequence
  chemically synthesized
actctgtcacccaggctggggt

SEQ ID NO: 61732 - DNA, 22 bp, Artificial Sequence
  chemically synthesized
tgtcacccaggctggggtgcaa

SEQ ID NO: 61733 - DNA, 22 bp, Artificial Sequence
  chemically synthesized
tcacccaggctggggtgcaatg

SEQ ID NO: 61734 - DNA, 22 bp, Artificial Sequence
  chemically synthesized
gggtgcaatggcgcaatctcag

SEQ ID NO: 61735 - DNA, 22 bp, Artificial Sequence
  chemically synthesized
agctcactgcaacctccaactc

SEQ ID NO: 61736 - DNA, 22 bp, Artificial Sequence
  chemically synthesized
actgcaacctccaactcctggg

SEQ ID NO: 61737 - DNA, 22 bp, Artificial Sequence
  chemically synthesized
caacctccaactcctggggctc

SEQ ID NO: 61738 - DNA, 22 bp, Artificial Sequence
  chemically synthesized
caactcctggggctcaaatgat

SEQ ID NO: 61739 - DNA, 22 bp, Artificial Sequence
  chemically synthesized
ctggggctcaaatgatcctcca

SEQ ID NO: 61740 - DNA, 22 bp, Artificial Sequence
  chemically synthesized
gggctcaaatgatcctccagcc

SEQ ID NO: 61741 - DNA, 22 bp, Artificial Sequence
  chemically synthesized
aaatgatcctccagcctcagcc

SEQ ID NO: 61742 - DNA, 22 bp, Artificial Sequence
  chemically synthesized
cagcctcagcctcccgaatagc

SEQ ID NO: 61743 - DNA, 22 bp, Artificial Sequence
  chemically synthesized
agcctcccgaatagctgggact

SEQ ID NO: 61744 - DNA, 22 bp, Artificial Sequence
  chemically synthesized
ccgaatagctgggactacagat

SEQ ID NO: 61745 - DNA, 22 bp, Artificial Sequence
  chemically synthesized
ggactacagatgcgtaccacca

SEQ ID NO: 61746 - DNA, 22 bp, Artificial Sequence
  chemically synthesized
cagatgcgtaccaccatgcctg

SEQ ID NO: 61747 - DNA, 22 bp, Artificial Sequence
  chemically synthesized
gctaatttttttattttttgta

SEQ ID NO: 61748 - DNA, 22 bp, Artificial Sequence
  chemically synthesized
atttttttattttttgtagaga

SEQ ID NO: 61749 - DNA, 22 bp, Artificial Sequence
  chemically synthesized
ttttattttttgtagagacagg

SEQ ID NO: 61750 - DNA, 22 bp, Artificial Sequence
  chemically synthesized
tttattttttgtagagacaggg

SEQ ID NO: 61751 - DNA, 22 bp, Artificial Sequence
  chemically synthesized
ttattttttgtagagacagggt

SEQ ID NO: 61752 - DNA, 22 bp, Artificial Sequence
  chemically synthesized
tattttttgtagagacagggtc

SEQ ID NO: 61753 - DNA, 22 bp, Artificial Sequence
  chemically synthesized
attttttgtagagacagggtct

SEQ ID NO: 61754 - DNA, 22 bp, Artificial Sequence
  chemically synthesized
ttttttgtagagacagggtctc

SEQ ID NO: 61755 - DNA, 22 bp, Artificial Sequence
  chemically synthesized
tttgtagagacagggtctcaag

SEQ ID NO: 61756 - DNA, 22 bp, Artificial Sequence
  chemically synthesized
ttgtagagacagggtctcaagc

SEQ ID NO: 61757 - DNA, 22 bp, Artificial Sequence
  chemically synthesized
tgtagagacagggtctcaagca

SEQ ID NO: 61758 - DNA, 22 bp, Artificial Sequence
  chemically synthesized
gtagagacagggtctcaagcat

SEQ ID NO: 61759 - DNA, 22 bp, Artificial Sequence
  chemically synthesized
tagagacagggtctcaagcatc

SEQ ID NO: 61760 - DNA, 22 bp, Artificial Sequence
  chemically synthesized
aagcatcctcccgccttagcct

SEQ ID NO: 61761 - DNA, 22 bp, Artificial Sequence
  chemically synthesized
ccgccttagcctcccaaagtgc

SEQ ID NO: 61762 - DNA, 22 bp, Artificial Sequence
  chemically synthesized
agcctcccaaagtgctgggata

SEQ ID NO: 61763 - DNA, 22 bp, Artificial Sequence
  chemically synthesized
gcctcccaaagtgctgggataa

SEQ ID NO: 61764 - DNA, 22 bp, Artificial Sequence
  chemically synthesized
ccaaagtgctgggataacaggc

SEQ ID NO: 61765 - DNA, 22 bp, Artificial Sequence
  chemically synthesized
ggataacaggcatgagctgctg

SEQ ID NO: 61766 - DNA, 22 bp, Artificial Sequence
  chemically synthesized
ctgcactcagccatgtttttga

SEQ ID NO: 61767 - DNA, 22 bp, Artificial Sequence
  chemically synthesized
cactcagccatgtttttgattt

SEQ ID NO: 61768 - DNA, 22 bp, Artificial Sequence
  chemically synthesized
agccatgtttttgatttttaac

SEQ ID NO: 61769 - DNA, 22 bp, Artificial Sequence
  chemically synthesized
ttgatttttaacaaaattgtaa

SEQ ID NO: 61770 - DNA, 22 bp, Artificial Sequence
  chemically synthesized
tgatttttaacaaaattgtaac

SEQ ID NO: 61771 - DNA, 22 bp, Artificial Sequence
  chemically synthesized
gatttttaacaaaattgtaaca

SEQ ID NO: 61772 - DNA, 22 bp, Artificial Sequence
  chemically synthesized
atttttaacaaaattgtaacac

SEQ ID NO: 61773 - DNA, 22 bp, Artificial Sequence
  chemically synthesized
ttaacaaaattgtaacacctta

SEQ ID NO: 61774 - DNA, 22 bp, Artificial Sequence
  chemically synthesized
taacaaaattgtaacaccttaa

SEQ ID NO: 61775 - DNA, 22 bp, Artificial Sequence
  chemically synthesized
aacaaaattgtaacaccttaaa

SEQ ID NO: 61776 - DNA, 22 bp, Artificial Sequence
  chemically synthesized
acaaaattgtaacaccttaaaa

SEQ ID NO: 61777 - DNA, 22 bp, Artificial Sequence
  chemically synthesized
taacaccttaaaaaaaatgtat

SEQ ID NO: 61778 - DNA, 22 bp, Artificial Sequence
  chemically synthesized
aaaaaaaatgtataacaaggcc

SEQ ID NO: 61779 - DNA, 22 bp, Artificial Sequence
  chemically synthesized
aaaaaaatgtataacaaggccg

SEQ ID NO: 61780 - DNA, 22 bp, Artificial Sequence
  chemically synthesized
atgcctgtaatcccagcacttt

SEQ ID NO: 61781 - DNA, 22 bp, Artificial Sequence
  chemically synthesized
taatcccagcactttgggaagc

SEQ ID NO: 61782 - DNA, 22 bp, Artificial Sequence
  chemically synthesized
tgggaagccaaggcaggcagat

SEQ ID NO: 61783 - DNA, 22 bp, Artificial Sequence
  chemically synthesized
gggaagccaaggcaggcagatc

SEQ ID NO: 61784 - DNA, 22 bp, Artificial Sequence
  chemically synthesized
ggaagccaaggcaggcagatca

SEQ ID NO: 61785 - DNA, 22 bp, Artificial Sequence
  chemically synthesized
agatcaggagttcgacctgacc

SEQ ID NO: 61786 - DNA, 22 bp, Artificial Sequence
  chemically synthesized
gacctgaccaacatggtgaaac

SEQ ID NO: 61787 - DNA, 22 bp, Artificial Sequence
  chemically synthesized
accaacatggtgaaaccgcgtc

SEQ ID NO: 61788 - DNA, 22 bp, Artificial Sequence
  chemically synthesized
tactaaaaatacaaaaaattag

SEQ ID NO: 61789 - DNA, 22 bp, Artificial Sequence
  chemically synthesized
ctaaaaatacaaaaaattagcc

SEQ ID NO: 61790 - DNA, 22 bp, Artificial Sequence
  chemically synthesized
aaaatacaaaaaattagccaga

SEQ ID NO: 61791 - DNA, 22 bp, Artificial Sequence
  chemically synthesized
gccagacgtggtggcacatgca

SEQ ID NO: 61792 - DNA, 22 bp, Artificial Sequence
  chemically synthesized
cttgagaggctgagacaggaga

SEQ ID NO: 61793 - DNA, 22 bp, Artificial Sequence
  chemically synthesized
gagaggctgagacaggagaact

SEQ ID NO: 61794 - DNA, 22 bp, Artificial Sequence
  chemically synthesized
agaggctgagacaggagaactg

SEQ ID NO: 61795 - DNA, 22 bp, Artificial Sequence
  chemically synthesized
agacaggagaactgcttgaacc

SEQ ID NO: 61796 - DNA, 22 bp, Artificial Sequence
  chemically synthesized
cttgaaccggggaggcagaggt

SEQ ID NO: 61797 - DNA, 22 bp, Artificial Sequence
  chemically synthesized
gaaccggggaggcagaggttgc

SEQ ID NO: 61798 - DNA, 22 bp, Artificial Sequence
  chemically synthesized
aaccggggaggcagaggttgca

SEQ ID NO: 61799 - DNA, 22 bp, Artificial Sequence
  chemically synthesized
cagtgagcccagatcacaccat

SEQ ID NO: 61800 - DNA, 22 bp, Artificial Sequence
  chemically synthesized
cactccaacctgggcaacaaga

SEQ ID NO: 61801 - DNA, 22 bp, Artificial Sequence
  chemically synthesized
caacctgggcaacaagagtgaa

SEQ ID NO: 61802 - DNA, 22 bp, Artificial Sequence
  chemically synthesized
ggcaacaagagtgaaactccat

SEQ ID NO: 61803 - DNA, 22 bp, Artificial Sequence
  chemically synthesized
catctcaaaaaaaaaaaaagct

SEQ ID NO: 61804 - DNA, 22 bp, Artificial Sequence
  chemically synthesized
aaaaaaaaaaaaagctgtataa

SEQ ID NO: 61805 - DNA, 22 bp, Artificial Sequence
  chemically synthesized
tataacagcttgagatataatt

SEQ ID NO: 61806 - DNA, 22 bp, Artificial Sequence
  chemically synthesized
gagatataattcacaataccat

SEQ ID NO: 61807 - DNA, 22 bp, Artificial Sequence
  chemically synthesized
agatataattcacaataccata

SEQ ID NO: 61808 - DNA, 22 bp, Artificial Sequence
  chemically synthesized
acaataccatacaattcactca

SEQ ID NO: 61809 - DNA, 22 bp, Artificial Sequence
  chemically synthesized
actcatttaaagtgtacaattc

SEQ ID NO: 61810 - DNA, 22 bp, Artificial Sequence
  chemically synthesized
atttaaagtgtacaattcaggg

SEQ ID NO: 61811 - DNA, 22 bp, Artificial Sequence
  chemically synthesized
aaagtgtacaattcaggggttt

SEQ ID NO: 61812 - DNA, 22 bp, Artificial Sequence
  chemically synthesized
aagtgtacaattcaggggtttt

SEQ ID NO: 61813 - DNA, 22 bp, Artificial Sequence
  chemically synthesized
aggggttttcattccactccaa

SEQ ID NO: 61814 - DNA, 22 bp, Artificial Sequence
  chemically synthesized
tcattccactccaacccactca

SEQ ID NO: 61815 - DNA, 22 bp, Artificial Sequence
  chemically synthesized
cattccactccaacccactcaa

SEQ ID NO: 61816 - DNA, 22 bp, Artificial Sequence
  chemically synthesized
attccactccaacccactcaag

SEQ ID NO: 61817 - DNA, 22 bp, Artificial Sequence
  chemically synthesized
cactccaacccactcaagccta

SEQ ID NO: 61818 - DNA, 22 bp, Artificial Sequence
  chemically synthesized
caacccactcaagcctaggcaa

SEQ ID NO: 61819 - DNA, 22 bp, Artificial Sequence
  chemically synthesized
aagcctaggcaaccactaatct

SEQ ID NO: 61820 - DNA, 22 bp, Artificial Sequence
  chemically synthesized
ggcaaccactaatctactttct

SEQ ID NO: 61821 - DNA, 22 bp, Artificial Sequence
  chemically synthesized
atctactttctgtctcatagat

SEQ ID NO: 61822 - DNA, 22 bp, Artificial Sequence
  chemically synthesized
ctttctgtctcatagatttgcc

SEQ ID NO: 61823 - DNA, 22 bp, Artificial Sequence
  chemically synthesized
tctgtctcatagatttgcctat

SEQ ID NO: 61824 - DNA, 22 bp, Artificial Sequence
  chemically synthesized
ctgtctcatagatttgcctatt

SEQ ID NO: 61825 - DNA, 22 bp, Artificial Sequence
  chemically synthesized
tgtctcatagatttgcctattt

SEQ ID NO: 61826 - DNA, 22 bp, Artificial Sequence
  chemically synthesized
tctcatagatttgcctatttgg

SEQ ID NO: 61827 - DNA, 22 bp, Artificial Sequence
  chemically synthesized
atagatttgcctatttggggca

SEQ ID NO: 61828 - DNA, 22 bp, Artificial Sequence
  chemically synthesized
gcctatttggggcatttcatat

SEQ ID NO: 61829 - DNA, 22 bp, Artificial Sequence
  chemically synthesized
cctatttggggcatttcatata

SEQ ID NO: 61830 - DNA, 22 bp, Artificial Sequence
  chemically synthesized
tttggggcatttcatataaata

SEQ ID NO: 61831 - DNA, 22 bp, Artificial Sequence
  chemically synthesized
ggggcatttcatataaatagac

SEQ ID NO: 61832 - DNA, 22 bp, Artificial Sequence
  chemically synthesized
gggcatttcatataaatagact

SEQ ID NO: 61833 - DNA, 22 bp, Artificial Sequence
  chemically synthesized
catataaatagactcctacaat

SEQ ID NO: 61834 - DNA, 22 bp, Artificial Sequence
  chemically synthesized
atataaatagactcctacaata

SEQ ID NO: 61835 - DNA, 22 bp, Artificial Sequence
  chemically synthesized
ctacaatatgtggccttttgtg

SEQ ID NO: 61836 - DNA, 22 bp, Artificial Sequence
  chemically synthesized
caatatgtggccttttgtgtct

SEQ ID NO: 61837 - DNA, 22 bp, Artificial Sequence
  chemically synthesized
ttgtgtctggcctctttcactt

SEQ ID NO: 61838 - DNA, 22 bp, Artificial Sequence
  chemically synthesized
tgtgtctggcctctttcactta

SEQ ID NO: 61839 - DNA, 22 bp, Artificial Sequence
  chemically synthesized
gtgtctggcctctttcacttag

SEQ ID NO: 61840 - DNA, 22 bp, Artificial Sequence
  chemically synthesized
tgtctggcctctttcacttagc

SEQ ID NO: 61841 - DNA, 22 bp, Artificial Sequence
  chemically synthesized
gcctctttcacttagcatgatg

SEQ ID NO: 61842 - DNA, 22 bp, Artificial Sequence
  chemically synthesized
tttcacttagcatgatgttttc

SEQ ID NO: 61843 - DNA, 22 bp, Artificial Sequence
  chemically synthesized
tcacttagcatgatgttttcaa

SEQ ID NO: 61844 - DNA, 22 bp, Artificial Sequence
  chemically synthesized
cacttagcatgatgttttcaag

SEQ ID NO: 61845 - DNA, 22 bp, Artificial Sequence
  chemically synthesized
acttagcatgatgttttcaagg

SEQ ID NO: 61846 - DNA, 22 bp, Artificial Sequence
  chemically synthesized
agcatgatgttttcaaggttta

SEQ ID NO: 61847 - DNA, 22 bp, Artificial Sequence
  chemically synthesized
gcatgatgttttcaaggtttat

SEQ ID NO: 61848 - DNA, 22 bp, Artificial Sequence
  chemically synthesized
tcaaggtttatctgtgttataa

SEQ ID NO: 61849 - DNA, 22 bp, Artificial Sequence
  chemically synthesized
caaggtttatctgtgttataac

SEQ ID NO: 61850 - DNA, 22 bp, Artificial Sequence
  chemically synthesized
aaggtttatctgtgttataaca

SEQ ID NO: 61851 - DNA, 22 bp, Artificial Sequence
  chemically synthesized
atctgtgttataacatatattg

SEQ ID NO: 61852 - DNA, 22 bp, Artificial Sequence
  chemically synthesized
tctgtgttataacatatattgg

SEQ ID NO: 61853 - DNA, 22 bp, Artificial Sequence
  chemically synthesized
tgttataacatatattggtact

SEQ ID NO: 61854 - DNA, 22 bp, Artificial Sequence
  chemically synthesized
taacatatattggtacttcatt

SEQ ID NO: 61855 - DNA, 22 bp, Artificial Sequence
  chemically synthesized
gtacttcatttctttttatgga

SEQ ID NO: 61856 - DNA, 22 bp, Artificial Sequence
  chemically synthesized
catttctttttatggacaagta

SEQ ID NO: 61857 - DNA, 22 bp, Artificial Sequence
  chemically synthesized
atttctttttatggacaagtaa

SEQ ID NO: 61858 - DNA, 22 bp, Artificial Sequence
  chemically synthesized
ctttttatggacaagtaatatt

SEQ ID NO: 61859 - DNA, 22 bp, Artificial Sequence
  chemically synthesized
tttttatggacaagtaatattc

SEQ ID NO: 61860 - DNA, 22 bp, Artificial Sequence
  chemically synthesized
tttatggacaagtaatattcca

SEQ ID NO: 61861 - DNA, 22 bp, Artificial Sequence
  chemically synthesized
ttatggacaagtaatattccat

SEQ ID NO: 61862 - DNA, 22 bp, Artificial Sequence
  chemically synthesized
tatggacaagtaatattccatt

SEQ ID NO: 61863 - DNA, 22 bp, Artificial Sequence
  chemically synthesized
atggacaagtaatattccattg

SEQ ID NO: 61864 - DNA, 22 bp, Artificial Sequence
  chemically synthesized
tggacaagtaatattccattgt

SEQ ID NO: 61865 - DNA, 22 bp, Artificial Sequence
  chemically synthesized
cattgtatgaatatataacatt

SEQ ID NO: 61866 - DNA, 22 bp, Artificial Sequence
  chemically synthesized
tatgaatatataacattgtatg

SEQ ID NO: 61867 - DNA, 22 bp, Artificial Sequence
  chemically synthesized
tatgaatataccacattttatt

SEQ ID NO: 61868 - DNA, 22 bp, Artificial Sequence
  chemically synthesized
tatttatctgtttatcaggcca

SEQ ID NO: 61869 - DNA, 22 bp, Artificial Sequence
  chemically synthesized
atttatctgtttatcaggccag

SEQ ID NO: 61870 - DNA, 22 bp, Artificial Sequence
  chemically synthesized
tttatctgtttatcaggccagg

SEQ ID NO: 61871 - DNA, 22 bp, Artificial Sequence
  chemically synthesized
atctgtttatcaggccaggcat

SEQ ID NO: 61872 - DNA, 22 bp, Artificial Sequence
  chemically synthesized
tctgtttatcaggccaggcatg

SEQ ID NO: 61873 - DNA, 22 bp, Artificial Sequence
  chemically synthesized
tttatcaggccaggcatggtgg

SEQ ID NO: 61874 - DNA, 22 bp, Artificial Sequence
  chemically synthesized
atcaggccaggcatggtggctc

SEQ ID NO: 61875 - DNA, 22 bp, Artificial Sequence
  chemically synthesized
tcaggccaggcatggtggctca

SEQ ID NO: 61876 - DNA, 22 bp, Artificial Sequence
  chemically synthesized
acatctgtaatcccagcacttt

SEQ ID NO: 61877 - DNA, 22 bp, Artificial Sequence
  chemically synthesized
taatcccagcactttgggaggc

SEQ ID NO: 61878 - DNA, 22 bp, Artificial Sequence
  chemically synthesized
tgggaggctgaggcaggaggat

SEQ ID NO: 61879 - DNA, 22 bp, Artificial Sequence
  chemically synthesized
gggaggctgaggcaggaggatt

SEQ ID NO: 61880 - DNA, 22 bp, Artificial Sequence
  chemically synthesized
ggaggctgaggcaggaggatta

SEQ ID NO: 61881 - DNA, 22 bp, Artificial Sequence
  chemically synthesized
aggcaggaggattacttgagcc

SEQ ID NO: 61882 - DNA, 22 bp, Artificial Sequence
  chemically synthesized
aagtaatcctcctgcctcagcc

SEQ ID NO: 61883 - DNA, 22 bp, Artificial Sequence
  chemically synthesized
ctgcctcagcctcccaaagtgc

SEQ ID NO: 61884 - DNA, 22 bp, Artificial Sequence
  chemically synthesized
cctcagcctcccaaagtgctgg

SEQ ID NO: 61885 - DNA, 22 bp, Artificial Sequence
  chemically synthesized
agcctcccaaagtgctgggatt

SEQ ID NO: 61886 - DNA, 22 bp, Artificial Sequence
  chemically synthesized
ccaaagtgctgggattacagat

SEQ ID NO: 61887 - DNA, 22 bp, Artificial Sequence
  chemically synthesized
ggattacagatgtgagccacca

SEQ ID NO: 61888 - DNA, 22 bp, Artificial Sequence
  chemically synthesized
cagatgtgagccaccatgcctg

SEQ ID NO: 61889 - DNA, 22 bp, Artificial Sequence
  chemically synthesized
gcctgataaacagataaataaa

SEQ ID NO: 61890 - DNA, 22 bp, Artificial Sequence
  chemically synthesized
ataaacagataaataaaatgtg

SEQ ID NO: 61891 - DNA, 22 bp, Artificial Sequence
  chemically synthesized
atacaatgttatatattcatac

SEQ ID NO: 61892 - DNA, 22 bp, Artificial Sequence
  chemically synthesized
tatattcatacaatggaatatt

SEQ ID NO: 61893 - DNA, 22 bp, Artificial Sequence
  chemically synthesized
atacaatggaatattacttgtc

SEQ ID NO: 61894 - DNA, 22 bp, Artificial Sequence
  chemically synthesized
cttgtccataaaaagaaatgaa

SEQ ID NO: 61895 - DNA, 22 bp, Artificial Sequence
  chemically synthesized
gtccataaaaagaaatgaagta

SEQ ID NO: 61896 - DNA, 22 bp, Artificial Sequence
  chemically synthesized
tccataaaaagaaatgaagtac

SEQ ID NO: 61897 - DNA, 22 bp, Artificial Sequence
  chemically synthesized
taacacagataaaccttgaaaa

SEQ ID NO: 61898 - DNA, 22 bp, Artificial Sequence
  chemically synthesized
gaaaacatcatgctaagtgaaa

SEQ ID NO: 61899 - DNA, 22 bp, Artificial Sequence
  chemically synthesized
aaaacatcatgctaagtgaaag

SEQ ID NO: 61900 - DNA, 22 bp, Artificial Sequence
  chemically synthesized
agtgaaagaggccagacacaaa

SEQ ID NO: 61901 - DNA, 22 bp, Artificial Sequence
  chemically synthesized
taggagtctatttatatgaaat

SEQ ID NO: 61902 - DNA, 22 bp, Artificial Sequence
  chemically synthesized
tttatatgaaatgccccaaata

SEQ ID NO: 61903 - DNA, 22 bp, Artificial Sequence
  chemically synthesized
atatgaaatgccccaaataggc

SEQ ID NO: 61904 - DNA, 22 bp, Artificial Sequence
  chemically synthesized
tatgaaatgccccaaataggca

SEQ ID NO: 61905 - DNA, 22 bp, Artificial Sequence
  chemically synthesized
tgagacagaaagtagattagtg

SEQ ID NO: 61906 - DNA, 22 bp, Artificial Sequence
  chemically synthesized
gtggttgcctaggcttgagtgg

SEQ ID NO: 61907 - DNA, 22 bp, Artificial Sequence
  chemically synthesized
cctaggcttgagtgggttggag

SEQ ID NO: 61908 - DNA, 22 bp, Artificial Sequence
  chemically synthesized
ggcttgagtgggttggagtgga

SEQ ID NO: 61909 - DNA, 22 bp, Artificial Sequence
  chemically synthesized
gagtgggttggagtggaatgaa

SEQ ID NO: 61910 - DNA, 22 bp, Artificial Sequence
  chemically synthesized
agtgggttggagtggaatgaaa

SEQ ID NO: 61911 - DNA, 22 bp, Artificial Sequence
  chemically synthesized
gagtggaatgaaaacccctgaa

SEQ ID NO: 61912 - DNA, 22 bp, Artificial Sequence
  chemically synthesized
aattgtacactttaaatgagtg

SEQ ID NO: 61913 - DNA, 22 bp, Artificial Sequence
  chemically synthesized
tacactttaaatgagtgaattg

SEQ ID NO: 61914 - DNA, 22 bp, Artificial Sequence
  chemically synthesized
taaatgagtgaattgtatggta

SEQ ID NO: 61915 - DNA, 22 bp, Artificial Sequence
  chemically synthesized
aaatgagtgaattgtatggtat

SEQ ID NO: 61916 - DNA, 22 bp, Artificial Sequence
  chemically synthesized
aatgagtgaattgtatggtatt

SEQ ID NO: 61917 - DNA, 22 bp, Artificial Sequence
  chemically synthesized
tatggtattgtgaattatatct

SEQ ID NO: 61918 - DNA, 22 bp, Artificial Sequence
  chemically synthesized
tgaattatatctcaagctgtta

SEQ ID NO: 61919 - DNA, 22 bp, Artificial Sequence
  chemically synthesized
tatctcaagctgttatacagct

SEQ ID NO: 61920 - DNA, 22 bp, Artificial Sequence
  chemically synthesized
aagctgttatacagcttttttt

SEQ ID NO: 61921 - DNA, 22 bp, Artificial Sequence
  chemically synthesized
ttatacagcttttttttttttt

SEQ ID NO: 61922 - DNA, 22 bp, Artificial Sequence
  chemically synthesized
tacagctttttttttttttgag

SEQ ID NO: 61923 - DNA, 22 bp, Artificial Sequence
  chemically synthesized
tttttttttttgagatggagtt

SEQ ID NO: 61924 - DNA, 22 bp, Artificial Sequence
  chemically synthesized
ttttttttttgagatggagttt

SEQ ID NO: 61925 - DNA, 22 bp, Artificial Sequence
  chemically synthesized
tttttttttgagatggagtttc

SEQ ID NO: 61926 - DNA, 22 bp, Artificial Sequence
  chemically synthesized
ttttttttgagatggagtttca

SEQ ID NO: 61927 - DNA, 22 bp, Artificial Sequence
  chemically synthesized
tttttttgagatggagtttcac

SEQ ID NO: 61928 - DNA, 22 bp, Artificial Sequence
  chemically synthesized
ttttttgagatggagtttcact

SEQ ID NO: 61929 - DNA, 22 bp, Artificial Sequence
  chemically synthesized
tttttgagatggagtttcactc

SEQ ID NO: 61930 - DNA, 22 bp, Artificial Sequence
  chemically synthesized
ttttgagatggagtttcactct

SEQ ID NO: 61931 - DNA, 22 bp, Artificial Sequence
  chemically synthesized
tttgagatggagtttcactctt

SEQ ID NO: 61932 - DNA, 22 bp, Artificial Sequence
  chemically synthesized
ttgagatggagtttcactcttg

SEQ ID NO: 61933 - DNA, 22 bp, Artificial Sequence
  chemically synthesized
tgagatggagtttcactcttgt

SEQ ID NO: 61934 - DNA, 22 bp, Artificial Sequence
  chemically synthesized
gagatggagtttcactcttgtt

SEQ ID NO: 61935 - DNA, 22 bp, Artificial Sequence
  chemically synthesized
agatggagtttcactcttgttg

SEQ ID NO: 61936 - DNA, 22 bp, Artificial Sequence
  chemically synthesized
cactcttgttgcccaggttgga

SEQ ID NO: 61937 - DNA, 22 bp, Artificial Sequence
  chemically synthesized
actcttgttgcccaggttggag

SEQ ID NO: 61938 - DNA, 22 bp, Artificial Sequence
  chemically synthesized
ttgttgcccaggttggagtgca

SEQ ID NO: 61939 - DNA, 22 bp, Artificial Sequence
  chemically synthesized
gttgcccaggttggagtgcaat

SEQ ID NO: 61940 - DNA, 22 bp, Artificial Sequence
  chemically synthesized
ttgcccaggttggagtgcaatg

SEQ ID NO: 61941 - DNA, 22 bp, Artificial Sequence
  chemically synthesized
cccaggttggagtgcaatggtg

SEQ ID NO: 61942 - DNA, 22 bp, Artificial Sequence
  chemically synthesized
gagtgcaatggtgtgatctggg

SEQ ID NO: 61943 - DNA, 22 bp, Artificial Sequence
  chemically synthesized
ggctcactgcaacctctgcctc

SEQ ID NO: 61944 - DNA, 22 bp, Artificial Sequence
  chemically synthesized
actgcaacctctgcctccccgg

SEQ ID NO: 61945 - DNA, 22 bp, Artificial Sequence
  chemically synthesized
caacctctgcctccccggttca

SEQ ID NO: 61946 - DNA, 22 bp, Artificial Sequence
  chemically synthesized
tgcctccccggttcaagcagtt

SEQ ID NO: 61947 - DNA, 22 bp, Artificial Sequence
  chemically synthesized
cctccccggttcaagcagttct

SEQ ID NO: 61948 - DNA, 22 bp, Artificial Sequence
  chemically synthesized
cccggttcaagcagttctcctg

SEQ ID NO: 61949 - DNA, 22 bp, Artificial Sequence
  chemically synthesized
aagcagttctcctgtctcagcc

SEQ ID NO: 61950 - DNA, 22 bp, Artificial Sequence
  chemically synthesized
tcctgtctcagcctctcaagta

SEQ ID NO: 61951 - DNA, 22 bp, Artificial Sequence
  chemically synthesized
ctgtctcagcctctcaagtagc

SEQ ID NO: 61952 - DNA, 22 bp, Artificial Sequence
  chemically synthesized
tctcagcctctcaagtagctgg

SEQ ID NO: 61953 - DNA, 22 bp, Artificial Sequence
  chemically synthesized
agcctctcaagtagctgggatt

SEQ ID NO: 61954 - DNA, 22 bp, Artificial Sequence
  chemically synthesized
tcaagtagctgggattacatgc

SEQ ID NO: 61955 - DNA, 22 bp, Artificial Sequence
  chemically synthesized
aagtagctgggattacatgcat

SEQ ID NO: 61956 - DNA, 22 bp, Artificial Sequence
  chemically synthesized
ggattacatgcatgtgccacca

SEQ ID NO: 61957 - DNA, 22 bp, Artificial Sequence
  chemically synthesized
catgcatgtgccaccacgtctg

SEQ ID NO: 61958 - DNA, 22 bp, Artificial Sequence
  chemically synthesized
gctaattttttgtatttttagt

SEQ ID NO: 61959 - DNA, 22 bp, Artificial Sequence
  chemically synthesized
attttttgtatttttagtagag

SEQ ID NO: 61960 - DNA, 22 bp, Artificial Sequence
  chemically synthesized
tttgtatttttagtagagacgc

SEQ ID NO: 61961 - DNA, 22 bp, Artificial Sequence
  chemically synthesized
ttgtatttttagtagagacgcg

SEQ ID NO: 61962 - DNA, 22 bp, Artificial Sequence
  chemically synthesized
tgtatttttagtagagacgcgg

SEQ ID NO: 61963 - DNA, 22 bp, Artificial Sequence
  chemically synthesized
gtatttttagtagagacgcggt

SEQ ID NO: 61964 - DNA, 22 bp, Artificial Sequence
  chemically synthesized
tatttttagtagagacgcggtt

SEQ ID NO: 61965 - DNA, 22 bp, Artificial Sequence
  chemically synthesized
ttagtagagacgcggtttcacc

SEQ ID NO: 61966 - DNA, 22 bp, Artificial Sequence
  chemically synthesized
tagtagagacgcggtttcacca

SEQ ID NO: 61967 - DNA, 22 bp, Artificial Sequence
  chemically synthesized
agtagagacgcggtttcaccat

SEQ ID NO: 61968 - DNA, 22 bp, Artificial Sequence
  chemically synthesized
gtagagacgcggtttcaccatg

SEQ ID NO: 61969 - DNA, 22 bp, Artificial Sequence
  chemically synthesized
caccatgttggtcaggtcgaac

SEQ ID NO: 61970 - DNA, 22 bp, Artificial Sequence
  chemically synthesized
accatgttggtcaggtcgaact

SEQ ID NO: 61971 - DNA, 22 bp, Artificial Sequence
  chemically synthesized
gtcaggtcgaactcctgatctc

SEQ ID NO: 61972 - DNA, 22 bp, Artificial Sequence
  chemically synthesized
ctgatctcaggtgatctgcctg

SEQ ID NO: 61973 - DNA, 22 bp, Artificial Sequence
  chemically synthesized
atctcaggtgatctgcctgcct

SEQ ID NO: 61974 - DNA, 22 bp, Artificial Sequence
  chemically synthesized
aggtgatctgcctgccttggct

SEQ ID NO: 61975 - DNA, 22 bp, Artificial Sequence
  chemically synthesized
cctgccttggcttcccaaagtg

SEQ ID NO: 61976 - DNA, 22 bp, Artificial Sequence
  chemically synthesized
ccttggcttcccaaagtgctgg

SEQ ID NO: 61977 - DNA, 22 bp, Artificial Sequence
  chemically synthesized
ggcttcccaaagtgctgggatt

SEQ ID NO: 61978 - DNA, 22 bp, Artificial Sequence
  chemically synthesized
gcttcccaaagtgctgggatta

SEQ ID NO: 61979 - DNA, 22 bp, Artificial Sequence
  chemically synthesized
cccaaagtgctgggattacagg

SEQ ID NO: 61980 - DNA, 22 bp, Artificial Sequence
  chemically synthesized
ccaaagtgctgggattacaggc

SEQ ID NO: 61981 - DNA, 22 bp, Artificial Sequence
  chemically synthesized
ggattacaggcatgagccaccg

SEQ ID NO: 61982 - DNA, 22 bp, Artificial Sequence
  chemically synthesized
caggcatgagccaccgtgcccg

SEQ ID NO: 61983 - DNA, 22 bp, Artificial Sequence
  chemically synthesized
gttatacattttttttaaggtg

SEQ ID NO: 61984 - DNA, 22 bp, Artificial Sequence
  chemically synthesized
ttatacattttttttaaggtgt

SEQ ID NO: 61985 - DNA, 22 bp, Artificial Sequence
  chemically synthesized
tacattttttttaaggtgttac

SEQ ID NO: 61986 - DNA, 22 bp, Artificial Sequence
  chemically synthesized
tttttaaggtgttacaattttg

SEQ ID NO: 61987 - DNA, 22 bp, Artificial Sequence
  chemically synthesized
ttttaaggtgttacaattttgt

SEQ ID NO: 61988 - DNA, 22 bp, Artificial Sequence
  chemically synthesized
tttaaggtgttacaattttgtt

SEQ ID NO: 61989 - DNA, 22 bp, Artificial Sequence
  chemically synthesized
ttaaggtgttacaattttgtta

SEQ ID NO: 61990 - DNA, 22 bp, Artificial Sequence
  chemically synthesized
taaggtgttacaattttgttaa

SEQ ID NO: 61991 - DNA, 22 bp, Artificial Sequence
  chemically synthesized
aaggtgttacaattttgttaaa

SEQ ID NO: 61992 - DNA, 22 bp, Artificial Sequence
  chemically synthesized
aggtgttacaattttgttaaaa

SEQ ID NO: 61993 - DNA, 22 bp, Artificial Sequence
  chemically synthesized
caattttgttaaaaatcaaaaa

SEQ ID NO: 61994 - DNA, 22 bp, Artificial Sequence
  chemically synthesized
tgttaaaaatcaaaaacatggc

SEQ ID NO: 61995 - DNA, 22 bp, Artificial Sequence
  chemically synthesized
gttaaaaatcaaaaacatggct

SEQ ID NO: 61996 - DNA, 22 bp, Artificial Sequence
  chemically synthesized
ttaaaaatcaaaaacatggctg

SEQ ID NO: 61997 - DNA, 22 bp, Artificial Sequence
  chemically synthesized
aaaatcaaaaacatggctgagt

SEQ ID NO: 61998 - DNA, 22 bp, Artificial Sequence
  chemically synthesized
agtgcagcagctcatgcctgtt

SEQ ID NO: 61999 - DNA, 22 bp, Artificial Sequence
  chemically synthesized
atgcctgttatcccagcacttt

SEQ ID NO: 62000 - DNA, 22 bp, Artificial Sequence
  chemically synthesized
ttatcccagcactttgggaggc

SEQ ID NO: 62001 - DNA, 22 bp, Artificial Sequence
  chemically synthesized
tcccagcactttgggaggctaa

SEQ ID NO: 62002 - DNA, 22 bp, Artificial Sequence
  chemically synthesized
tgggaggctaaggcgggaggat

SEQ ID NO: 62003 - DNA, 22 bp, Artificial Sequence
  chemically synthesized
gggaggctaaggcgggaggatg

SEQ ID NO: 62004 - DNA, 22 bp, Artificial Sequence
  chemically synthesized
ggaggctaaggcgggaggatgc

SEQ ID NO: 62005 - DNA, 22 bp, Artificial Sequence
  chemically synthesized
aggcgggaggatgcttgagacc

SEQ ID NO: 62006 - DNA, 22 bp, Artificial Sequence
  chemically synthesized
gagaccctgtctctacaaaaaa

SEQ ID NO: 62007 - DNA, 22 bp, Artificial Sequence
  chemically synthesized
agaccctgtctctacaaaaaat

SEQ ID NO: 62008 - DNA, 22 bp, Artificial Sequence
  chemically synthesized
tctctacaaaaaataaaaaaat

SEQ ID NO: 62009 - DNA, 22 bp, Artificial Sequence
  chemically synthesized
tacaaaaaataaaaaaattagc

SEQ ID NO: 62010 - DNA, 22 bp, Artificial Sequence
  chemically synthesized
caaaaaataaaaaaattagcca

SEQ ID NO: 62011 - DNA, 22 bp, Artificial Sequence
  chemically synthesized
gccaggcatggtggtacgcatc

SEQ ID NO: 62012 - DNA, 22 bp, Artificial Sequence
  chemically synthesized
tagtcccagctattcgggaggc

SEQ ID NO: 62013 - DNA, 22 bp, Artificial Sequence
  chemically synthesized
ttcgggaggctgaggctggagg

SEQ ID NO: 62014 - DNA, 22 bp, Artificial Sequence
  chemically synthesized
gggaggctgaggctggaggatc

SEQ ID NO: 62015 - DNA, 22 bp, Artificial Sequence
  chemically synthesized
aggctggaggatcatttgagcc

SEQ ID NO: 62016 - DNA, 22 bp, Artificial Sequence
  chemically synthesized
gaggatcatttgagccccagga

SEQ ID NO: 62017 - DNA, 22 bp, Artificial Sequence
  chemically synthesized
gagccccaggagttggaggttg

SEQ ID NO: 62018 - DNA, 22 bp, Artificial Sequence
  chemically synthesized
agccccaggagttggaggttgc

SEQ ID NO: 62019 - DNA, 22 bp, Artificial Sequence
  chemically synthesized
gaggttgcagtgagctgagatt

SEQ ID NO: 62020 - DNA, 22 bp, Artificial Sequence
  chemically synthesized
cagtgagctgagattgcgccat

SEQ ID NO: 62021 - DNA, 22 bp, Artificial Sequence
  chemically synthesized
agattgcgccattgcaccccag

SEQ ID NO: 62022 - DNA, 22 bp, Artificial Sequence
  chemically synthesized
cgccattgcaccccagcctggg

SEQ ID NO: 62023 - DNA, 22 bp, Artificial Sequence
  chemically synthesized
caccccagcctgggtgacagag

SEQ ID NO: 62024 - DNA, 22 bp, Artificial Sequence
  chemically synthesized
ggtgacagagtgagactccatc

SEQ ID NO: 62025 - DNA, 22 bp, Artificial Sequence
  chemically synthesized
catctcaaataataaaataaaa

SEQ ID NO: 62026 - DNA, 22 bp, Artificial Sequence
  chemically synthesized
aaataataaaataaaataaaat

SEQ ID NO: 62027 - DNA, 22 bp, Artificial Sequence
  chemically synthesized
agcctttggtctatgtgtgatg

SEQ ID NO: 62028 - DNA, 22 bp, Artificial Sequence
  chemically synthesized
tggtctatgtgtgatgtggcag

SEQ ID NO: 62029 - DNA, 22 bp, Artificial Sequence
  chemically synthesized
ggtctatgtgtgatgtggcagc

SEQ ID NO: 62030 - DNA, 22 bp, Artificial Sequence
  chemically synthesized
gtctatgtgtgatgtggcagca

SEQ ID NO: 62031 - DNA, 22 bp, Artificial Sequence
  chemically synthesized
tgtgtgatgtggcagcactggt

SEQ ID NO: 62032 - DNA, 22 bp, Artificial Sequence
  chemically synthesized
gtccacgcagcagaagttggac

SEQ ID NO: 62033 - DNA, 22 bp, Artificial Sequence
  chemically synthesized
gacttccttaatgggtctattt

SEQ ID NO: 62034 - DNA, 22 bp, Artificial Sequence
  chemically synthesized
ccttaatgggtctattttcttt

SEQ ID NO: 62035 - DNA, 22 bp, Artificial Sequence
  chemically synthesized
cttaatgggtctattttctttg

SEQ ID NO: 62036 - DNA, 22 bp, Artificial Sequence
  chemically synthesized
aatgggtctattttctttgggc

SEQ ID NO: 62037 - DNA, 22 bp, Artificial Sequence
  chemically synthesized
atgggtctattttctttgggca

SEQ ID NO: 62038 - DNA, 22 bp, Artificial Sequence
  chemically synthesized
ttttctttgggcaataatagaa

SEQ ID NO: 62039 - DNA, 22 bp, Artificial Sequence
  chemically synthesized
tctttgggcaataatagaattg

SEQ ID NO: 62040 - DNA, 22 bp, Artificial Sequence
  chemically synthesized
ctttgggcaataatagaattgc

SEQ ID NO: 62041 - DNA, 22 bp, Artificial Sequence
  chemically synthesized
tttgggcaataatagaattgca

SEQ ID NO: 62042 - DNA, 22 bp, Artificial Sequence
  chemically synthesized
tgggcaataatagaattgcatt

SEQ ID NO: 62043 - DNA, 22 bp, Artificial Sequence
  chemically synthesized
gggcaataatagaattgcattg

SEQ ID NO: 62044 - DNA, 22 bp, Artificial Sequence
  chemically synthesized
ggcaataatagaattgcattgc

SEQ ID NO: 62045 - DNA, 22 bp, Artificial Sequence
  chemically synthesized
cattgcgtgtgtgtgtgtgtgt

SEQ ID NO: 62046 - DNA, 22 bp, Artificial Sequence
  chemically synthesized
cgtgtgtgtgtgtgtgtatcat

SEQ ID NO: 62047 - DNA, 22 bp, Artificial Sequence
  chemically synthesized
aagcctaccacctgaaaactga

SEQ ID NO: 62048 - DNA, 22 bp, Artificial Sequence
  chemically synthesized
ccacctgaaaactgatacacta

SEQ ID NO: 62049 - DNA, 22 bp, Artificial Sequence
  chemically synthesized
aaaactgatacactactagaac

SEQ ID NO: 62050 - DNA, 22 bp, Artificial Sequence
  chemically synthesized
atacactactagaacattctac

SEQ ID NO: 62051 - DNA, 22 bp, Artificial Sequence
  chemically synthesized
ctagaacattctaccaaattat

SEQ ID NO: 62052 - DNA, 22 bp, Artificial Sequence
  chemically synthesized
gaacattctaccaaattatgcc

SEQ ID NO: 62053 - DNA, 22 bp, Artificial Sequence
  chemically synthesized
taccaaattatgccataacatg

SEQ ID NO: 62054 - DNA, 22 bp, Artificial Sequence
  chemically synthesized
ccaaattatgccataacatgac

SEQ ID NO: 62055 - DNA, 22 bp, Artificial Sequence
  chemically synthesized
tgccataacatgacatggacct

SEQ ID NO: 62056 - DNA, 22 bp, Artificial Sequence
  chemically synthesized
gctttaaaactgtcatcggtca

SEQ ID NO: 62057 - DNA, 22 bp, Artificial Sequence
  chemically synthesized
ctttaaaactgtcatcggtcac

SEQ ID NO: 62058 - DNA, 22 bp, Artificial Sequence
  chemically synthesized
taaaactgtcatcggtcactta

SEQ ID NO: 62059 - DNA, 22 bp, Artificial Sequence
  chemically synthesized
aaaactgtcatcggtcacttaa

SEQ ID NO: 62060 - DNA, 22 bp, Artificial Sequence
  chemically synthesized
aaactgtcatcggtcacttaaa

SEQ ID NO: 62061 - DNA, 22 bp, Artificial Sequence
  chemically synthesized
tcatcggtcacttaaacttgcc

SEQ ID NO: 62062 - DNA, 22 bp, Artificial Sequence
  chemically synthesized
aaacttgcctcacaagccattt

SEQ ID NO: 62063 - DNA, 22 bp, Artificial Sequence
  chemically synthesized
aacttgcctcacaagccatttc

SEQ ID NO: 62064 - DNA, 22 bp, Artificial Sequence
  chemically synthesized
gcctcacaagccatttctaaag

SEQ ID NO: 62065 - DNA, 22 bp, Artificial Sequence
  chemically synthesized
cctcacaagccatttctaaagt

SEQ ID NO: 62066 - DNA, 22 bp, Artificial Sequence
  chemically synthesized
acaagccatttctaaagtggac

SEQ ID NO: 62067 - DNA, 22 bp, Artificial Sequence
  chemically synthesized
ctaaagtggacgtaaatctata

SEQ ID NO: 62068 - DNA, 22 bp, Artificial Sequence
  chemically synthesized
taaagtggacgtaaatctataa

SEQ ID NO: 62069 - DNA, 22 bp, Artificial Sequence
  chemically synthesized
aagtggacgtaaatctataact

SEQ ID NO: 62070 - DNA, 22 bp, Artificial Sequence
  chemically synthesized
taacttagggaacagatgagtg

SEQ ID NO: 62071 - DNA, 22 bp, Artificial Sequence
  chemically synthesized
agggaacagatgagtgatcaaa

SEQ ID NO: 62072 - DNA, 22 bp, Artificial Sequence
  chemically synthesized
gggaacagatgagtgatcaaaa

SEQ ID NO: 62073 - DNA, 22 bp, Artificial Sequence
  chemically synthesized
tgtctaataagcaggatatatt

SEQ ID NO: 62074 - DNA, 22 bp, Artificial Sequence
  chemically synthesized
tctaataagcaggatatattac

SEQ ID NO: 62075 - DNA, 22 bp, Artificial Sequence
  chemically synthesized
ataagcaggatatattacaaaa

SEQ ID NO: 62076 - DNA, 22 bp, Artificial Sequence
  chemically synthesized
caaaatgattattttgtatctg

SEQ ID NO: 62077 - DNA, 22 bp, Artificial Sequence
  chemically synthesized
ttttgtatctgggattacaggc

SEQ ID NO: 62078 - DNA, 22 bp, Artificial Sequence
  chemically synthesized
tgtatctgggattacaggcgcg

SEQ ID NO: 62079 - DNA, 22 bp, Artificial Sequence
  chemically synthesized
gtatctgggattacaggcgcga

SEQ ID NO: 62080 - DNA, 22 bp, Artificial Sequence
  chemically synthesized
tatctgggattacaggcgcgag

SEQ ID NO: 62081 - DNA, 22 bp, Artificial Sequence
  chemically synthesized
ggattacaggcgcgagccacag

SEQ ID NO: 62082 - DNA, 22 bp, Artificial Sequence
  chemically synthesized
caggcgcgagccacagcaccca

SEQ ID NO: 62083 - DNA, 22 bp, Artificial Sequence
  chemically synthesized
cttgcttctttttttttttttt

SEQ ID NO: 62084 - DNA, 22 bp, Artificial Sequence
  chemically synthesized
gcttcttttttttttttttttc

SEQ ID NO: 62085 - DNA, 22 bp, Artificial Sequence
  chemically synthesized
cttcttttttttttttttttct

SEQ ID NO: 62086 - DNA, 22 bp, Artificial Sequence
  chemically synthesized
cttttttttttttttttctgag

SEQ ID NO: 62087 - DNA, 22 bp, Artificial Sequence
  chemically synthesized
ttttttttttttttttctgaga

SEQ ID NO: 62088 - DNA, 22 bp, Artificial Sequence
  chemically synthesized
ttttttttttttttctgagaca

SEQ ID NO: 62089 - DNA, 22 bp, Artificial Sequence
  chemically synthesized
tttttttttttttctgagacag

SEQ ID NO: 62090 - DNA, 22 bp, Artificial Sequence
  chemically synthesized
ttttttttttttctgagacagg

SEQ ID NO: 62091 - DNA, 22 bp, Artificial Sequence
  chemically synthesized
tttttttttttctgagacaggg

SEQ ID NO: 62092 - DNA, 22 bp, Artificial Sequence
  chemically synthesized
ttttttttttctgagacagggt

SEQ ID NO: 62093 - DNA, 22 bp, Artificial Sequence
  chemically synthesized
tttttttttctgagacagggtc

SEQ ID NO: 62094 - DNA, 22 bp, Artificial Sequence
  chemically synthesized
ttttttttctgagacagggtct

SEQ ID NO: 62095 - DNA, 22 bp, Artificial Sequence
  chemically synthesized
tttttttctgagacagggtctc

SEQ ID NO: 62096 - DNA, 22 bp, Artificial Sequence
  chemically synthesized
ttttttctgagacagggtctca

SEQ ID NO: 62097 - DNA, 22 bp, Artificial Sequence
  chemically synthesized
tttttctgagacagggtctcac

SEQ ID NO: 62098 - DNA, 22 bp, Artificial Sequence
  chemically synthesized
ttttctgagacagggtctcact

SEQ ID NO: 62099 - DNA, 22 bp, Artificial Sequence
  chemically synthesized
tttctgagacagggtctcactc

SEQ ID NO: 62100 - DNA, 22 bp, Artificial Sequence
  chemically synthesized
ttctgagacagggtctcactct

SEQ ID NO: 62101 - DNA, 22 bp, Artificial Sequence
  chemically synthesized
tctgagacagggtctcactctg

SEQ ID NO: 62102 - DNA, 22 bp, Artificial Sequence
  chemically synthesized
ctgagacagggtctcactctgt

SEQ ID NO: 62103 - DNA, 22 bp, Artificial Sequence
  chemically synthesized
tgagacagggtctcactctgtc

SEQ ID NO: 62104 - DNA, 22 bp, Artificial Sequence
  chemically synthesized
agacagggtctcactctgtcac

SEQ ID NO: 62105 - DNA, 22 bp, Artificial Sequence
  chemically synthesized
actctgtcacccaggctggagt

SEQ ID NO: 62106 - DNA, 22 bp, Artificial Sequence
  chemically synthesized
tgtcacccaggctggagtgcag

SEQ ID NO: 62107 - DNA, 22 bp, Artificial Sequence
  chemically synthesized
tcacccaggctggagtgcagtg

SEQ ID NO: 62108 - DNA, 22 bp, Artificial Sequence
  chemically synthesized
gagtgcagtggcataatcttgg

SEQ ID NO: 62109 - DNA, 22 bp, Artificial Sequence
  chemically synthesized
ggctcactgcaacctctgagct

SEQ ID NO: 62110 - DNA, 22 bp, Artificial Sequence
  chemically synthesized
gctcactgcaacctctgagctc

SEQ ID NO: 62111 - DNA, 22 bp, Artificial Sequence
  chemically synthesized
actgcaacctctgagctcaagg

SEQ ID NO: 62112 - DNA, 22 bp, Artificial Sequence
  chemically synthesized
caacctctgagctcaagggatt

SEQ ID NO: 62113 - DNA, 22 bp, Artificial Sequence
  chemically synthesized
tgagctcaagggattctcccac

SEQ ID NO: 62114 - DNA, 22 bp, Artificial Sequence
  chemically synthesized
agctcaagggattctcccacct

SEQ ID NO: 62115 - DNA, 22 bp, Artificial Sequence
  chemically synthesized
aagggattctcccacctcagcc

SEQ ID NO: 62116 - DNA, 22 bp, Artificial Sequence
  chemically synthesized
tcccacctcagccacctgagta

SEQ ID NO: 62117 - DNA, 22 bp, Artificial Sequence
  chemically synthesized
ccacctcagccacctgagtagt

SEQ ID NO: 62118 - DNA, 22 bp, Artificial Sequence
  chemically synthesized
agccacctgagtagttaggacc

SEQ ID NO: 62119 - DNA, 22 bp, Artificial Sequence
  chemically synthesized
agtagttaggaccacaggcatg

SEQ ID NO: 62120 - DNA, 22 bp, Artificial Sequence
  chemically synthesized
ggaccacaggcatgcaccacca

SEQ ID NO: 62121 - DNA, 22 bp, Artificial Sequence
  chemically synthesized
ggctaatgttttgtatttttgg

SEQ ID NO: 62122 - DNA, 22 bp, Artificial Sequence
  chemically synthesized
gctaatgttttgtatttttggt

SEQ ID NO: 62123 - DNA, 22 bp, Artificial Sequence
  chemically synthesized
atgttttgtatttttggtatag

SEQ ID NO: 62124 - DNA, 22 bp, Artificial Sequence
  chemically synthesized
tgtatttttggtatagacgggg

SEQ ID NO: 62125 - DNA, 22 bp, Artificial Sequence
  chemically synthesized
gtatttttggtatagacggggg

SEQ ID NO: 62126 - DNA, 22 bp, Artificial Sequence
  chemically synthesized
tatttttggtatagacgggggt

SEQ ID NO: 62127 - DNA, 22 bp, Artificial Sequence
  chemically synthesized
ttggtatagacgggggtctcac

SEQ ID NO: 62128 - DNA, 22 bp, Artificial Sequence
  chemically synthesized
tggtatagacgggggtctcacc

SEQ ID NO: 62129 - DNA, 22 bp, Artificial Sequence
  chemically synthesized
ggtatagacgggggtctcacca

SEQ ID NO: 62130 - DNA, 22 bp, Artificial Sequence
  chemically synthesized
gtatagacgggggtctcaccat

SEQ ID NO: 62131 - DNA, 22 bp, Artificial Sequence
  chemically synthesized
accatgttgcccaggctggtct

SEQ ID NO: 62132 - DNA, 22 bp, Artificial Sequence
  chemically synthesized
cccaggctggtctcgaactcct

SEQ ID NO: 62133 - DNA, 22 bp, Artificial Sequence
  chemically synthesized
gtctcgaactcctgagctcagg

SEQ ID NO: 62134 - DNA, 22 bp, Artificial Sequence
  chemically synthesized
gaactcctgagctcaggcaatc

SEQ ID NO: 62135 - DNA, 22 bp, Artificial Sequence
  chemically synthesized
ctgagctcaggcaatctgccac

SEQ ID NO: 62136 - DNA, 22 bp, Artificial Sequence
  chemically synthesized
agctcaggcaatctgccacctc

SEQ ID NO: 62137 - DNA, 22 bp, Artificial Sequence
  chemically synthesized
aggcaatctgccacctcagcct

SEQ ID NO: 62138 - DNA, 22 bp, Artificial Sequence
  chemically synthesized
ccacctcagcctcccaaagtgc

SEQ ID NO: 62139 - DNA, 22 bp, Artificial Sequence
  chemically synthesized
agcctcccaaagtgctgggatt

SEQ ID NO: 62140 - DNA, 22 bp, Artificial Sequence
  chemically synthesized
ccaaagtgctgggattacagat

SEQ ID NO: 62141 - DNA, 22 bp, Artificial Sequence
  chemically synthesized
ggattacagatgtgagccacca

SEQ ID NO: 62142 - DNA, 22 bp, Artificial Sequence
  chemically synthesized
cagatgtgagccaccatgccca

SEQ ID NO: 62143 - DNA, 22 bp, Artificial Sequence
  chemically synthesized
cctgatccttaacctggttcca

SEQ ID NO: 62144 - DNA, 22 bp, Artificial Sequence
  chemically synthesized
atccttaacctggttccaccat

SEQ ID NO: 62145 - DNA, 22 bp, Artificial Sequence
  chemically synthesized
aacctggttccaccattctgga

SEQ ID NO: 62146 - DNA, 22 bp, Artificial Sequence
  chemically synthesized
acctggttccaccattctggac

SEQ ID NO: 62147 - DNA, 22 bp, Artificial Sequence
  chemically synthesized
gttccaccattctggacaagat

SEQ ID NO: 62148 - DNA, 22 bp, Artificial Sequence
  chemically synthesized
caccattctggacaagatgact

SEQ ID NO: 62149 - DNA, 22 bp, Artificial Sequence
  chemically synthesized
tggacaagatgactaacccctc

SEQ ID NO: 62150 - DNA, 22 bp, Artificial Sequence
  chemically synthesized
gacaagatgactaacccctctg

SEQ ID NO: 62151 - DNA, 22 bp, Artificial Sequence
  chemically synthesized
acccctctggacctatttgtaa

SEQ ID NO: 62152 - DNA, 22 bp, Artificial Sequence
  chemically synthesized
tggacctatttgtaatataagg

SEQ ID NO: 62153 - DNA, 22 bp, Artificial Sequence
  chemically synthesized
gacctatttgtaatataaggat

SEQ ID NO: 62154 - DNA, 22 bp, Artificial Sequence
  chemically synthesized
tttgtaatataaggataaatga

SEQ ID NO: 62155 - DNA, 22 bp, Artificial Sequence
  chemically synthesized
gtaatataaggataaatgacag

SEQ ID NO: 62156 - DNA, 22 bp, Artificial Sequence
  chemically synthesized
taatataaggataaatgacagt

SEQ ID NO: 62157 - DNA, 22 bp, Artificial Sequence
  chemically synthesized
acagagatgttgggagaactaa

SEQ ID NO: 62158 - DNA, 22 bp, Artificial Sequence
  chemically synthesized
ggagaactaagcgagttaattg

SEQ ID NO: 62159 - DNA, 22 bp, Artificial Sequence
  chemically synthesized
agcgagttaattgtataaataa

SEQ ID NO: 62160 - DNA, 22 bp, Artificial Sequence
  chemically synthesized
attgtataaataaagtacatag

SEQ ID NO: 62161 - DNA, 22 bp, Artificial Sequence
  chemically synthesized
tataaataaagtacatagaaca

SEQ ID NO: 62162 - DNA, 22 bp, Artificial Sequence
  chemically synthesized
gcataaagttagcactcaataa

SEQ ID NO: 62163 - DNA, 22 bp, Artificial Sequence
  chemically synthesized
gcactcaataaactttatctgt

SEQ ID NO: 62164 - DNA, 22 bp, Artificial Sequence
  chemically synthesized
aataaactttatctgttatgtt

SEQ ID NO: 62165 - DNA, 22 bp, Artificial Sequence
  chemically synthesized
tatctgttatgttttcttatca

SEQ ID NO: 62166 - DNA, 22 bp, Artificial Sequence
  chemically synthesized
atctgttatgttttcttatcaa

SEQ ID NO: 62167 - DNA, 22 bp, Artificial Sequence
  chemically synthesized
tctgttatgttttcttatcaac

SEQ ID NO: 62168 - DNA, 22 bp, Artificial Sequence
  chemically synthesized
ttatgttttcttatcaacctca

SEQ ID NO: 62169 - DNA, 22 bp, Artificial Sequence
  chemically synthesized
tgttttcttatcaacctcataa

SEQ ID NO: 62170 - DNA, 22 bp, Artificial Sequence
  chemically synthesized
tcttatcaacctcataaacttc

SEQ ID NO: 62171 - DNA, 22 bp, Artificial Sequence
  chemically synthesized
cttatcaacctcataaacttca

SEQ ID NO: 62172 - DNA, 22 bp, Artificial Sequence
  chemically synthesized
ttatcaacctcataaacttcag

SEQ ID NO: 62173 - DNA, 22 bp, Artificial Sequence
  chemically synthesized
atcaacctcataaacttcaggg

SEQ ID NO: 62174 - DNA, 22 bp, Artificial Sequence
  chemically synthesized
tcaacctcataaacttcaggga

SEQ ID NO: 62175 - DNA, 22 bp, Artificial Sequence
  chemically synthesized
ataaacttcagggagtgggggc

SEQ ID NO: 62176 - DNA, 22 bp, Artificial Sequence
  chemically synthesized
cagggagtgggggcagtattta

SEQ ID NO: 62177 - DNA, 22 bp, Artificial Sequence
  chemically synthesized
agggagtgggggcagtatttac

SEQ ID NO: 62178 - DNA, 22 bp, Artificial Sequence
  chemically synthesized
actttctggcagacctttcttg

SEQ ID NO: 62179 - DNA, 22 bp, Artificial Sequence
  chemically synthesized
ctttctggcagacctttcttgt

SEQ ID NO: 62180 - DNA, 22 bp, Artificial Sequence
  chemically synthesized
tctggcagacctttcttgtaag

SEQ ID NO: 62181 - DNA, 22 bp, Artificial Sequence
  chemically synthesized
ctggcagacctttcttgtaagg

SEQ ID NO: 62182 - DNA, 22 bp, Artificial Sequence
  chemically synthesized
tggcagacctttcttgtaagga

SEQ ID NO: 62183 - DNA, 22 bp, Artificial Sequence
  chemically synthesized
gcagacctttcttgtaaggatc

SEQ ID NO: 62184 - DNA, 22 bp, Artificial Sequence
  chemically synthesized
tcttgtaaggatcttggacttg

SEQ ID NO: 62185 - DNA, 22 bp, Artificial Sequence
  chemically synthesized
cttgtaaggatcttggacttgg

SEQ ID NO: 62186 - DNA, 22 bp, Artificial Sequence
  chemically synthesized
ttgtaaggatcttggacttggt

SEQ ID NO: 62187 - DNA, 22 bp, Artificial Sequence
  chemically synthesized
gtaaggatcttggacttggtcc

SEQ ID NO: 62188 - DNA, 22 bp, Artificial Sequence
  chemically synthesized
taaggatcttggacttggtcct

SEQ ID NO: 62189 - DNA, 22 bp, Artificial Sequence
  chemically synthesized
ggacttggtccttgggagcaaa

SEQ ID NO: 62190 - DNA, 22 bp, Artificial Sequence
  chemically synthesized
gacttggtccttgggagcaaat

SEQ ID NO: 62191 - DNA, 22 bp, Artificial Sequence
  chemically synthesized
ggtccttgggagcaaatagatt

SEQ ID NO: 62192 - DNA, 22 bp, Artificial Sequence
  chemically synthesized
gtccttgggagcaaatagatta

SEQ ID NO: 62193 - DNA, 22 bp, Artificial Sequence
  chemically synthesized
gggagcaaatagattatcaagg

SEQ ID NO: 62194 - DNA, 22 bp, Artificial Sequence
  chemically synthesized
ggagcaaatagattatcaagga

SEQ ID NO: 62195 - DNA, 22 bp, Artificial Sequence
  chemically synthesized
tcaaggatggggctatgcctaa

SEQ ID NO: 62196 - DNA, 22 bp, Artificial Sequence
  chemically synthesized
tgcctaagcagtagggttcagt

SEQ ID NO: 62197 - DNA, 22 bp, Artificial Sequence
  chemically synthesized
agcagtagggttcagttcagac

SEQ ID NO: 62198 - DNA, 22 bp, Artificial Sequence
  chemically synthesized
agttcagacagatcaaaaccat

SEQ ID NO: 62199 - DNA, 22 bp, Artificial Sequence
  chemically synthesized
agacagatcaaaaccatttctg

SEQ ID NO: 62200 - DNA, 22 bp, Artificial Sequence
  chemically synthesized
ctggccaagcgcagtggctcac

SEQ ID NO: 62201 - DNA, 22 bp, Artificial Sequence
  chemically synthesized
tggccaagcgcagtggctcaca

SEQ ID NO: 62202 - DNA, 22 bp, Artificial Sequence
  chemically synthesized
gccaagcgcagtggctcacact

SEQ ID NO: 62203 - DNA, 22 bp, Artificial Sequence
  chemically synthesized
acactgtaatcccagcactttg

SEQ ID NO: 62204 - DNA, 22 bp, Artificial Sequence
  chemically synthesized
taatcccagcactttgggaggc

SEQ ID NO: 62205 - DNA, 22 bp, Artificial Sequence
  chemically synthesized
tgggaggctgaggcaggaggat

SEQ ID NO: 62206 - DNA, 22 bp, Artificial Sequence
  chemically synthesized
gggaggctgaggcaggaggatc

SEQ ID NO: 62207 - DNA, 22 bp, Artificial Sequence
  chemically synthesized
ggaggctgaggcaggaggatca

SEQ ID NO: 62208 - DNA, 22 bp, Artificial Sequence
  chemically synthesized
aggcaggaggatcacttgaacc

SEQ ID NO: 62209 - DNA, 22 bp, Artificial Sequence
  chemically synthesized
gaacccaggagttcaagaccag

SEQ ID NO: 62210 - DNA, 22 bp, Artificial Sequence
  chemically synthesized
aacccaggagttcaagaccagc

SEQ ID NO: 62211 - DNA, 22 bp, Artificial Sequence
  chemically synthesized
aagaccagcctgggcagcatag

SEQ ID NO: 62212 - DNA, 22 bp, Artificial Sequence
  chemically synthesized
ggcagcatagtgagacccccat

SEQ ID NO: 62213 - DNA, 22 bp, Artificial Sequence
  chemically synthesized
tattaaaaaaaaaaaaaagact

SEQ ID NO: 62214 - DNA, 22 bp, Artificial Sequence
  chemically synthesized
ttaaaaaaaaaaaaaagactat

SEQ ID NO: 62215 - DNA, 22 bp, Artificial Sequence
  chemically synthesized
aaaaaaaaaaaaagactatttt

SEQ ID NO: 62216 - DNA, 22 bp, Artificial Sequence
  chemically synthesized
ttttctttctccctggttggga

SEQ ID NO: 62217 - DNA, 22 bp, Artificial Sequence
  chemically synthesized
tctttctccctggttgggacca

SEQ ID NO: 62218 - DNA, 22 bp, Artificial Sequence
  chemically synthesized
ctttctccctggttgggaccat

SEQ ID NO: 62219 - DNA, 22 bp, Artificial Sequence
  chemically synthesized
tttctccctggttgggaccatt

SEQ ID NO: 62220 - DNA, 22 bp, Artificial Sequence
  chemically synthesized
tctccctggttgggaccatttg

SEQ ID NO: 62221 - DNA, 22 bp, Artificial Sequence
  chemically synthesized
ctccctggttgggaccatttga

SEQ ID NO: 62222 - DNA, 22 bp, Artificial Sequence
  chemically synthesized
tccctggttgggaccatttgat

SEQ ID NO: 62223 - DNA, 22 bp, Artificial Sequence
  chemically synthesized
cctggttgggaccatttgattc

SEQ ID NO: 62224 - DNA, 22 bp, Artificial Sequence
  chemically synthesized
gttgggaccatttgattctgtg

SEQ ID NO: 62225 - DNA, 22 bp, Artificial Sequence
  chemically synthesized
ggaccatttgattctgtgaggg

SEQ ID NO: 62226 - DNA, 22 bp, Artificial Sequence
  chemically synthesized
gattctgtgaggggcctggttc

SEQ ID NO: 62227 - DNA, 22 bp, Artificial Sequence
  chemically synthesized
attctgtgaggggcctggttcc

SEQ ID NO: 62228 - DNA, 22 bp, Artificial Sequence
  chemically synthesized
tgtgaggggcctggttcccaca

SEQ ID NO: 62229 - DNA, 22 bp, Artificial Sequence
  chemically synthesized
tgaggggcctggttcccacaac

SEQ ID NO: 62230 - DNA, 22 bp, Artificial Sequence
  chemically synthesized
gttcccacaacgccctctgaga

SEQ ID NO: 62231 - DNA, 22 bp, Artificial Sequence
  chemically synthesized
ccacaacgccctctgagagccc

SEQ ID NO: 62232 - DNA, 22 bp, Artificial Sequence
  chemically synthesized
tgagagcccaaatccagtagga

SEQ ID NO: 62233 - DNA, 22 bp, Artificial Sequence
  chemically synthesized
agagcccaaatccagtaggaga

SEQ ID NO: 62234 - DNA, 22 bp, Artificial Sequence
  chemically synthesized
ccctgaatatacagactccgga

SEQ ID NO: 62235 - DNA, 22 bp, Artificial Sequence
  chemically synthesized
cctgaatatacagactccggag

SEQ ID NO: 62236 - DNA, 22 bp, Artificial Sequence
  chemically synthesized
aatatacagactccggagttca

SEQ ID NO: 62237 - DNA, 22 bp, Artificial Sequence
  chemically synthesized
cggagttcaggtgtgaaatagc

SEQ ID NO: 62238 - DNA, 22 bp, Artificial Sequence
  chemically synthesized
aggtgtgaaatagcggagctta

SEQ ID NO: 62239 - DNA, 22 bp, Artificial Sequence
  chemically synthesized
accctcaggaaatccattgata

SEQ ID NO: 62240 - DNA, 22 bp, Artificial Sequence
  chemically synthesized
ccctcaggaaatccattgatac

SEQ ID NO: 62241 - DNA, 22 bp, Artificial Sequence
  chemically synthesized
aggaaatccattgatacggtga

SEQ ID NO: 62242 - DNA, 22 bp, Artificial Sequence
  chemically synthesized
atacggtgatgatttgaggcct

SEQ ID NO: 62243 - DNA, 22 bp, Artificial Sequence
  chemically synthesized
gaggcctttggaggtcgaaccc

SEQ ID NO: 62244 - DNA, 22 bp, Artificial Sequence
  chemically synthesized
aggcctttggaggtcgaaccct

SEQ ID NO: 62245 - DNA, 22 bp, Artificial Sequence
  chemically synthesized
tggaggtcgaaccctgcaccca

SEQ ID NO: 62246 - DNA, 22 bp, Artificial Sequence
  chemically synthesized
ggaggtcgaaccctgcacccag

SEQ ID NO: 62247 - DNA, 22 bp, Artificial Sequence
  chemically synthesized
gaggtcgaaccctgcacccagg

SEQ ID NO: 62248 - DNA, 22 bp, Artificial Sequence
  chemically synthesized
cacccaggatgaaataaatctc

SEQ ID NO: 62249 - DNA, 22 bp, Artificial Sequence
  chemically synthesized
ttagcagagaaacctgcaatag

SEQ ID NO: 62250 - DNA, 22 bp, Artificial Sequence
  chemically synthesized
agcagagaaacctgcaatagct

SEQ ID NO: 62251 - DNA, 22 bp, Artificial Sequence
  chemically synthesized
gcagagaaacctgcaatagctc

SEQ ID NO: 62252 - DNA, 22 bp, Artificial Sequence
  chemically synthesized
caatagctcccttgagcattcc

SEQ ID NO: 62253 - DNA, 22 bp, Artificial Sequence
  chemically synthesized
ccttgagcattccttggtgctg

SEQ ID NO: 62254 - DNA, 22 bp, Artificial Sequence
  chemically synthesized
gagcattccttggtgctgtgac

SEQ ID NO: 62255 - DNA, 22 bp, Artificial Sequence
  chemically synthesized
agcattccttggtgctgtgact

SEQ ID NO: 62256 - DNA, 22 bp, Artificial Sequence
  chemically synthesized
cttggtgctgtgactggctctg

SEQ ID NO: 62257 - DNA, 22 bp, Artificial Sequence
  chemically synthesized
ggtgctgtgactggctctgttt

SEQ ID NO: 62258 - DNA, 22 bp, Artificial Sequence
  chemically synthesized
gtgctgtgactggctctgttta

SEQ ID NO: 62259 - DNA, 22 bp, Artificial Sequence
  chemically synthesized
tgactggctctgtttagacttt

SEQ ID NO: 62260 - DNA, 22 bp, Artificial Sequence
  chemically synthesized
gctctgtttagactttcttgaa

SEQ ID NO: 62261 - DNA, 22 bp, Artificial Sequence
  chemically synthesized
tgtttagactttcttgaactat

SEQ ID NO: 62262 - DNA, 22 bp, Artificial Sequence
  chemically synthesized
tttagactttcttgaactataa

SEQ ID NO: 62263 - DNA, 22 bp, Artificial Sequence
  chemically synthesized
agactttcttgaactataaccc

SEQ ID NO: 62264 - DNA, 22 bp, Artificial Sequence
  chemically synthesized
gactttcttgaactataaccca

SEQ ID NO: 62265 - DNA, 22 bp, Artificial Sequence
  chemically synthesized
tcttgaactataacccaaaacc

SEQ ID NO: 62266 - DNA, 22 bp, Artificial Sequence
  chemically synthesized
cttgaactataacccaaaacct

SEQ ID NO: 62267 - DNA, 22 bp, Artificial Sequence
  chemically synthesized
ttgaactataacccaaaacctt

SEQ ID NO: 62268 - DNA, 22 bp, Artificial Sequence
  chemically synthesized
gaactataacccaaaaccttgc

SEQ ID NO: 62269 - DNA, 22 bp, Artificial Sequence
  chemically synthesized
aactataacccaaaaccttgct

SEQ ID NO: 62270 - DNA, 22 bp, Artificial Sequence
  chemically synthesized
taacccaaaaccttgctgacac

SEQ ID NO: 62271 - DNA, 22 bp, Artificial Sequence
  chemically synthesized
gctgacactgagttactggatt

SEQ ID NO: 62272 - DNA, 22 bp, Artificial Sequence
  chemically synthesized
ctgacactgagttactggattc

SEQ ID NO: 62273 - DNA, 22 bp, Artificial Sequence
  chemically synthesized
acactgagttactggattccag

SEQ ID NO: 62274 - DNA, 22 bp, Artificial Sequence
  chemically synthesized
agttactggattccagagctgg

SEQ ID NO: 62275 - DNA, 22 bp, Artificial Sequence
  chemically synthesized
ctggattccagagctggcctag

SEQ ID NO: 62276 - DNA, 22 bp, Artificial Sequence
  chemically synthesized
gattccagagctggcctagtct

SEQ ID NO: 62277 - DNA, 22 bp, Artificial Sequence
  chemically synthesized
cagagctggcctagtcttgttg

SEQ ID NO: 62278 - DNA, 22 bp, Artificial Sequence
  chemically synthesized
gcctagtcttgttgtgttactg

SEQ ID NO: 62279 - DNA, 22 bp, Artificial Sequence
  chemically synthesized
gtcttgttgtgttactgcaact

SEQ ID NO: 62280 - DNA, 22 bp, Artificial Sequence
  chemically synthesized
gttgtgttactgcaacttgtgt

SEQ ID NO: 62281 - DNA, 22 bp, Artificial Sequence
  chemically synthesized
ttgtgttactgcaacttgtgtg

SEQ ID NO: 62282 - DNA, 22 bp, Artificial Sequence
  chemically synthesized
tgttactgcaacttgtgtgccc

SEQ ID NO: 62283 - DNA, 22 bp, Artificial Sequence
  chemically synthesized
ctgcaacttgtgtgccctgatt

SEQ ID NO: 62284 - DNA, 22 bp, Artificial Sequence
  chemically synthesized
caacttgtgtgccctgattgct

SEQ ID NO: 62285 - DNA, 22 bp, Artificial Sequence
  chemically synthesized
gtgtgccctgattgcttaattt

SEQ ID NO: 62286 - DNA, 22 bp, Artificial Sequence
  chemically synthesized
tgtgccctgattgcttaatttg

SEQ ID NO: 62287 - DNA, 22 bp, Artificial Sequence
  chemically synthesized
attgcttaatttgatagtgacc

SEQ ID NO: 62288 - DNA, 22 bp, Artificial Sequence
  chemically synthesized
cttaatttgatagtgaccctgc

SEQ ID NO: 62289 - DNA, 22 bp, Artificial Sequence
  chemically synthesized
aatttgatagtgaccctgccca

SEQ ID NO: 62290 - DNA, 22 bp, Artificial Sequence
  chemically synthesized
atttgatagtgaccctgcccat

SEQ ID NO: 62291 - DNA, 22 bp, Artificial Sequence
  chemically synthesized
gatagtgaccctgcccatctac

SEQ ID NO: 62292 - DNA, 22 bp, Artificial Sequence
  chemically synthesized
atagtgaccctgcccatctact

SEQ ID NO: 62293 - DNA, 22 bp, Artificial Sequence
  chemically synthesized
cccatctactctcaagttgcaa

SEQ ID NO: 62294 - DNA, 22 bp, Artificial Sequence
  chemically synthesized
ctctcaagttgcaatttgatgc

SEQ ID NO: 62295 - DNA, 22 bp, Artificial Sequence
  chemically synthesized
tcaagttgcaatttgatgccat

SEQ ID NO: 62296 - DNA, 22 bp, Artificial Sequence
  chemically synthesized
aagttgcaatttgatgccatag

SEQ ID NO: 62297 - DNA, 22 bp, Artificial Sequence
  chemically synthesized
caatttgatgccatagagcaac

SEQ ID NO: 62298 - DNA, 22 bp, Artificial Sequence
  chemically synthesized
gatgccatagagcaactcatgc

SEQ ID NO: 62299 - DNA, 22 bp, Artificial Sequence
  chemically synthesized
atgccatagagcaactcatgct

SEQ ID NO: 62300 - DNA, 22 bp, Artificial Sequence
  chemically synthesized
atgctgacttgtggtctggtag

SEQ ID NO: 62301 - DNA, 22 bp, Artificial Sequence
  chemically synthesized
acttgtggtctggtagccaatg

SEQ ID NO: 62302 - DNA, 22 bp, Artificial Sequence
  chemically synthesized
gtggtctggtagccaatgttca

SEQ ID NO: 62303 - DNA, 22 bp, Artificial Sequence
  chemically synthesized
tggtctggtagccaatgttcat

SEQ ID NO: 62304 - DNA, 22 bp, Artificial Sequence
  chemically synthesized
gtagccaatgttcattcttggc

SEQ ID NO: 62305 - DNA, 22 bp, Artificial Sequence
  chemically synthesized
attcttggccaactctgaatct

SEQ ID NO: 62306 - DNA, 22 bp, Artificial Sequence
  chemically synthesized
ttggccaactctgaatctttct

SEQ ID NO: 62307 - DNA, 22 bp, Artificial Sequence
  chemically synthesized
ggccaactctgaatctttctgg

SEQ ID NO: 62308 - DNA, 22 bp, Artificial Sequence
  chemically synthesized
gccaactctgaatctttctggt

SEQ ID NO: 62309 - DNA, 22 bp, Artificial Sequence
  chemically synthesized
tgaatctttctggttctatgct

SEQ ID NO: 62310 - DNA, 22 bp, Artificial Sequence
  chemically synthesized
aatctttctggttctatgctga

SEQ ID NO: 62311 - DNA, 22 bp, Artificial Sequence
  chemically synthesized
tctggttctatgctgattttgg

SEQ ID NO: 62312 - DNA, 22 bp, Artificial Sequence
  chemically synthesized
ctggttctatgctgattttggg

SEQ ID NO: 62313 - DNA, 22 bp, Artificial Sequence
  chemically synthesized
tggttctatgctgattttgggc

SEQ ID NO: 62314 - DNA, 22 bp, Artificial Sequence
  chemically synthesized
gttctatgctgattttgggcct

SEQ ID NO: 62315 - DNA, 22 bp, Artificial Sequence
  chemically synthesized
tatgctgattttgggcctccgt

SEQ ID NO: 62316 - DNA, 22 bp, Artificial Sequence
  chemically synthesized
tgctgattttgggcctccgttt

SEQ ID NO: 62317 - DNA, 22 bp, Artificial Sequence
  chemically synthesized
attttgggcctccgtttatgtg

SEQ ID NO: 62318 - DNA, 22 bp, Artificial Sequence
  chemically synthesized
tgggcctccgtttatgtgctca

SEQ ID NO: 62319 - DNA, 22 bp, Artificial Sequence
  chemically synthesized
gggcctccgtttatgtgctcaa

SEQ ID NO: 62320 - DNA, 22 bp, Artificial Sequence
  chemically synthesized
ggcctccgtttatgtgctcaac

SEQ ID NO: 62321 - DNA, 22 bp, Artificial Sequence
  chemically synthesized
cgtttatgtgctcaactctgcc

SEQ ID NO: 62322 - DNA, 22 bp, Artificial Sequence
  chemically synthesized
atgtgctcaactctgcctgtgc

SEQ ID NO: 62323 - DNA, 22 bp, Artificial Sequence
  chemically synthesized
tgtgctcaactctgcctgtgcc

SEQ ID NO: 62324 - DNA, 22 bp, Artificial Sequence
  chemically synthesized
aactctgcctgtgcccctgtgg

SEQ ID NO: 62325 - DNA, 22 bp, Artificial Sequence
  chemically synthesized
tgcctgtgcccctgtggatgca

SEQ ID NO: 62326 - DNA, 22 bp, Artificial Sequence
  chemically synthesized
cctgtgcccctgtggatgcatt

SEQ ID NO: 62327 - DNA, 22 bp, Artificial Sequence
  chemically synthesized
tgcccctgtggatgcatttaag

SEQ ID NO: 62328 - DNA, 22 bp, Artificial Sequence
  chemically synthesized
tggatgcatttaagtctcccta

SEQ ID NO: 62329 - DNA, 22 bp, Artificial Sequence
  chemically synthesized
aagtctccctatccctaatggg

SEQ ID NO: 62330 - DNA, 22 bp, Artificial Sequence
  chemically synthesized
agtctccctatccctaatggga

SEQ ID NO: 62331 - DNA, 22 bp, Artificial Sequence
  chemically synthesized
cctatccctaatgggactctcg

SEQ ID NO: 62332 - DNA, 22 bp, Artificial Sequence
  chemically synthesized
tccctaatgggactctcggtca

SEQ ID NO: 62333 - DNA, 22 bp, Artificial Sequence
  chemically synthesized
atgggactctcggtcaactcaa

SEQ ID NO: 62334 - DNA, 22 bp, Artificial Sequence
  chemically synthesized
tcggtcaactcaagagagagca

SEQ ID NO: 62335 - DNA, 22 bp, Artificial Sequence
  chemically synthesized
ggtcaactcaagagagagcact

SEQ ID NO: 62336 - DNA, 22 bp, Artificial Sequence
  chemically synthesized
aagagagagcacttttcttctc

SEQ ID NO: 62337 - DNA, 22 bp, Artificial Sequence
  chemically synthesized
ttcttctccaaagggaaaatgc

SEQ ID NO: 62338 - DNA, 22 bp, Artificial Sequence
  chemically synthesized
tcttctccaaagggaaaatgca

SEQ ID NO: 62339 - DNA, 22 bp, Artificial Sequence
  chemically synthesized
cttctccaaagggaaaatgcag

SEQ ID NO: 62340 - DNA, 22 bp, Artificial Sequence
  chemically synthesized
ttctccaaagggaaaatgcagg

SEQ ID NO: 62341 - DNA, 22 bp, Artificial Sequence
  chemically synthesized
ctccaaagggaaaatgcaggca

SEQ ID NO: 62342 - DNA, 22 bp, Artificial Sequence
  chemically synthesized
tccaaagggaaaatgcaggcac

SEQ ID NO: 62343 - DNA, 22 bp, Artificial Sequence
  chemically synthesized
caaagggaaaatgcaggcacag

SEQ ID NO: 62344 - DNA, 22 bp, Artificial Sequence
  chemically synthesized
tttgtttagggaaacagagcta

SEQ ID NO: 62345 - DNA, 22 bp, Artificial Sequence
  chemically synthesized
gtttagggaaacagagctagaa

SEQ ID NO: 62346 - DNA, 22 bp, Artificial Sequence
  chemically synthesized
tttagggaaacagagctagaaa

SEQ ID NO: 62347 - DNA, 22 bp, Artificial Sequence
  chemically synthesized
agggaaacagagctagaaattt

SEQ ID NO: 62348 - DNA, 22 bp, Artificial Sequence
  chemically synthesized
gggaaacagagctagaaattta

SEQ ID NO: 62349 - DNA, 22 bp, Artificial Sequence
  chemically synthesized
gaaatttagttgggccagaatt

SEQ ID NO: 62350 - DNA, 22 bp, Artificial Sequence
  chemically synthesized
agttgggccagaattagaaact

SEQ ID NO: 62351 - DNA, 22 bp, Artificial Sequence
  chemically synthesized
gttgggccagaattagaaactt

SEQ ID NO: 62352 - DNA, 22 bp, Artificial Sequence
  chemically synthesized
ggccagaattagaaacttcaga

SEQ ID NO: 62353 - DNA, 22 bp, Artificial Sequence
  chemically synthesized
gaaacttcagatcacattgcat

SEQ ID NO: 62354 - DNA, 22 bp, Artificial Sequence
  chemically synthesized
cagatcacattgcatctaaaat

SEQ ID NO: 62355 - DNA, 22 bp, Artificial Sequence
  chemically synthesized
agatcacattgcatctaaaata

SEQ ID NO: 62356 - DNA, 22 bp, Artificial Sequence
  chemically synthesized
catctaaaatatagtaattaac

SEQ ID NO: 62357 - DNA, 22 bp, Artificial Sequence
  chemically synthesized
aaatatagtaattaacaagact

SEQ ID NO: 62358 - DNA, 22 bp, Artificial Sequence
  chemically synthesized
acaagactttattcttaaataa

SEQ ID NO: 62359 - DNA, 22 bp, Artificial Sequence
  chemically synthesized
tattcttaaataaaatgttgct

SEQ ID NO: 62360 - DNA, 22 bp, Artificial Sequence
  chemically synthesized
attcttaaataaaatgttgctt

SEQ ID NO: 62361 - DNA, 22 bp, Artificial Sequence
  chemically synthesized
ttcttaaataaaatgttgcttt

SEQ ID NO: 62362 - DNA, 22 bp, Artificial Sequence
  chemically synthesized
ttaaataaaatgttgctttaat

SEQ ID NO: 62363 - DNA, 22 bp, Artificial Sequence
  chemically synthesized
aaataaaatgttgctttaataa

SEQ ID NO: 62364 - DNA, 22 bp, Artificial Sequence
  chemically synthesized
aataaaatgttgctttaataaa

SEQ ID NO: 62365 - DNA, 22 bp, Artificial Sequence
  chemically synthesized
ctttaataaaatactgcacata

SEQ ID NO: 62366 - DNA, 22 bp, Artificial Sequence
  chemically synthesized
taataaaatactgcacatatat

SEQ ID NO: 62367 - DNA, 22 bp, Artificial Sequence
  chemically synthesized
aataaaatactgcacatatata

SEQ ID NO: 62368 - DNA, 22 bp, Artificial Sequence
  chemically synthesized
ataaaatactgcacatatatat

SEQ ID NO: 62369 - DNA, 22 bp, Artificial Sequence
  chemically synthesized
cacatatatatttttcttttca

SEQ ID NO: 62370 - DNA, 22 bp, Artificial Sequence
  chemically synthesized
ttcttttcaaagatgttatgag

SEQ ID NO: 62371 - DNA, 22 bp, Artificial Sequence
  chemically synthesized
tcttttcaaagatgttatgagc

SEQ ID NO: 62372 - DNA, 22 bp, Artificial Sequence
  chemically synthesized
cttttcaaagatgttatgagca

SEQ ID NO: 62373 - DNA, 22 bp, Artificial Sequence
  chemically synthesized
ttttcaaagatgttatgagcag

SEQ ID NO: 62374 - DNA, 22 bp, Artificial Sequence
  chemically synthesized
ttcaaagatgttatgagcagga

SEQ ID NO: 62375 - DNA, 22 bp, Artificial Sequence
  chemically synthesized
tcaaagatgttatgagcaggat

SEQ ID NO: 62376 - DNA, 22 bp, Artificial Sequence
  chemically synthesized
caaagatgttatgagcaggatg

SEQ ID NO: 62377 - DNA, 22 bp, Artificial Sequence
  chemically synthesized
aaagatgttatgagcaggatgg

SEQ ID NO: 62378 - DNA, 22 bp, Artificial Sequence
  chemically synthesized
tgagcaggatggttgttttgaa

SEQ ID NO: 62379 - DNA, 22 bp, Artificial Sequence
  chemically synthesized
ttttgaatgataatgtatggta

SEQ ID NO: 62380 - DNA, 22 bp, Artificial Sequence
  chemically synthesized
tgaatgataatgtatggtatac

SEQ ID NO: 62381 - DNA, 22 bp, Artificial Sequence
  chemically synthesized
gaatgataatgtatggtatact

SEQ ID NO: 62382 - DNA, 22 bp, Artificial Sequence
  chemically synthesized
aatgataatgtatggtatacta

SEQ ID NO: 62383 - DNA, 22 bp, Artificial Sequence
  chemically synthesized
tataattagtagcaaaaacaag

SEQ ID NO: 62384 - DNA, 22 bp, Artificial Sequence
  chemically synthesized
gtagcaaaaacaaggactttca

SEQ ID NO: 62385 - DNA, 22 bp, Artificial Sequence
  chemically synthesized
tcaaataaataggcttcagctt

SEQ ID NO: 62386 - DNA, 22 bp, Artificial Sequence
  chemically synthesized
caaataaataggcttcagcttt

SEQ ID NO: 62387 - DNA, 22 bp, Artificial Sequence
  chemically synthesized
aaataaataggcttcagctttt

SEQ ID NO: 62388 - DNA, 22 bp, Artificial Sequence
  chemically synthesized
cagctttttttggggggtaggt

SEQ ID NO: 62389 - DNA, 22 bp, Artificial Sequence
  chemically synthesized
agctttttttggggggtaggtg

SEQ ID NO: 62390 - DNA, 22 bp, Artificial Sequence
  chemically synthesized
tttttggggggtaggtgggtgg

SEQ ID NO: 62391 - DNA, 22 bp, Artificial Sequence
  chemically synthesized
ttttggggggtaggtgggtggg

SEQ ID NO: 62392 - DNA, 22 bp, Artificial Sequence
  chemically synthesized
tttggggggtaggtgggtgggg

SEQ ID NO: 62393 - DNA, 22 bp, Artificial Sequence
  chemically synthesized
ttggggggtaggtgggtggggc

SEQ ID NO: 62394 - DNA, 22 bp, Artificial Sequence
  chemically synthesized
tggggggtaggtgggtggggca

SEQ ID NO: 62395 - DNA, 22 bp, Artificial Sequence
  chemically synthesized
ggggggtaggtgggtggggcag

SEQ ID NO: 62396 - DNA, 22 bp, Artificial Sequence
  chemically synthesized
gggggtaggtgggtggggcaga

SEQ ID NO: 62397 - DNA, 22 bp, Artificial Sequence
  chemically synthesized
tgcatatcagatgagattgaaa

SEQ ID NO: 62398 - DNA, 22 bp, Artificial Sequence
  chemically synthesized
catatcagatgagattgaaaaa

SEQ ID NO: 62399 - DNA, 22 bp, Artificial Sequence
  chemically synthesized
aaaaacaggcaaggagggcccg

SEQ ID NO: 62400 - DNA, 22 bp, Artificial Sequence
  chemically synthesized
atgcctgtaatcctagcacctt

SEQ ID NO: 62401 - DNA, 22 bp, Artificial Sequence
  chemically synthesized
taatcctagcaccttgggaggc

SEQ ID NO: 62402 - DNA, 22 bp, Artificial Sequence
  chemically synthesized
gcaccttgggaggccaaggcag

SEQ ID NO: 62403 - DNA, 22 bp, Artificial Sequence
  chemically synthesized
gggaggccaaggcaggtggatc

SEQ ID NO: 62404 - DNA, 22 bp, Artificial Sequence
  chemically synthesized
ggaggccaaggcaggtggatca

SEQ ID NO: 62405 - DNA, 22 bp, Artificial Sequence
  chemically synthesized
gaggtcaggagttcgagaccag

SEQ ID NO: 62406 - DNA, 22 bp, Artificial Sequence
  chemically synthesized
aggtcaggagttcgagaccagc

SEQ ID NO: 62407 - DNA, 22 bp, Artificial Sequence
  chemically synthesized
gagaccagcctggccaacatga

SEQ ID NO: 62408 - DNA, 22 bp, Artificial Sequence
  chemically synthesized
gccaacatgatgaaatcccatc

SEQ ID NO: 62409 - DNA, 22 bp, Artificial Sequence
  chemically synthesized
ttctaaaattctaaaaatataa

SEQ ID NO: 62410 - DNA, 22 bp, Artificial Sequence
  chemically synthesized
ctaaaattctaaaaatataaaa

SEQ ID NO: 62411 - DNA, 22 bp, Artificial Sequence
  chemically synthesized
taaaattctaaaaatataaaaa

SEQ ID NO: 62412 - DNA, 22 bp, Artificial Sequence
  chemically synthesized
aaattctaaaaatataaaaatt

SEQ ID NO: 62413 - DNA, 22 bp, Artificial Sequence
  chemically synthesized
taaaaatataaaaattagcctg

SEQ ID NO: 62414 - DNA, 22 bp, Artificial Sequence
  chemically synthesized
aaaatataaaaattagcctggc

SEQ ID NO: 62415 - DNA, 22 bp, Artificial Sequence
  chemically synthesized
gcctggcatggtggtgcacgcc

SEQ ID NO: 62416 - DNA, 22 bp, Artificial Sequence
  chemically synthesized
gcatggtggtgcacgccggtag

SEQ ID NO: 62417 - DNA, 22 bp, Artificial Sequence
  chemically synthesized
gctactgaggaggctgagacat

SEQ ID NO: 62418 - DNA, 22 bp, Artificial Sequence
  chemically synthesized
ctgaggaggctgagacatgaga

SEQ ID NO: 62419 - DNA, 22 bp, Artificial Sequence
  chemically synthesized
aggaggctgagacatgagaatc

SEQ ID NO: 62420 - DNA, 22 bp, Artificial Sequence
  chemically synthesized
agacatgagaatcgcttgaacc

SEQ ID NO: 62421 - DNA, 22 bp, Artificial Sequence
  chemically synthesized
gaaccaggaggaagaggttgca

SEQ ID NO: 62422 - DNA, 22 bp, Artificial Sequence
  chemically synthesized
aaccaggaggaagaggttgcag

SEQ ID NO: 62423 - DNA, 22 bp, Artificial Sequence
  chemically synthesized
cagtgagccaagatcgtgccac

SEQ ID NO: 62424 - DNA, 22 bp, Artificial Sequence
  chemically synthesized
cactccagcctgggtgataggt

SEQ ID NO: 62425 - DNA, 22 bp, Artificial Sequence
  chemically synthesized
cagcctgggtgataggtgcgcc

SEQ ID NO: 62426 - DNA, 22 bp, Artificial Sequence
  chemically synthesized
ggtgataggtgcgccgtctcaa

SEQ ID NO: 62427 - DNA, 22 bp, Artificial Sequence
  chemically synthesized
aaaaaaagaaaaaaaaagaaaa

SEQ ID NO: 62428 - DNA, 22 bp, Artificial Sequence
  chemically synthesized
gctagctggacatagtggcttg

SEQ ID NO: 62429 - DNA, 22 bp, Artificial Sequence
  chemically synthesized
gctggacatagtggcttgcacc

SEQ ID NO: 62430 - DNA, 22 bp, Artificial Sequence
  chemically synthesized
gacatagtggcttgcacctgta

SEQ ID NO: 62431 - DNA, 22 bp, Artificial Sequence
  chemically synthesized
gcacctgtagtcccagctacgc

SEQ ID NO: 62432 - DNA, 22 bp, Artificial Sequence
  chemically synthesized
cacctgtagtcccagctacgcg

SEQ ID NO: 62433 - DNA, 22 bp, Artificial Sequence
  chemically synthesized
tagtcccagctacgcgggacgc

SEQ ID NO: 62434 - DNA, 22 bp, Artificial Sequence
  chemically synthesized
cgcgggacgctgtggtagggtg

SEQ ID NO: 62435 - DNA, 22 bp, Artificial Sequence
  chemically synthesized
tggtagggtgggaggactgctt

SEQ ID NO: 62436 - DNA, 22 bp, Artificial Sequence
  chemically synthesized
cttgagcccaggaattcaagag

SEQ ID NO: 62437 - DNA, 22 bp, Artificial Sequence
  chemically synthesized
gagcccaggaattcaagagcag

SEQ ID NO: 62438 - DNA, 22 bp, Artificial Sequence
  chemically synthesized
agcccaggaattcaagagcagc

SEQ ID NO: 62439 - DNA, 22 bp, Artificial Sequence
  chemically synthesized
aagagcagcctgggcaacatag

SEQ ID NO: 62440 - DNA, 22 bp, Artificial Sequence
  chemically synthesized
ggcaacatagtgagaccctgtc

SEQ ID NO: 62441 - DNA, 22 bp, Artificial Sequence
  chemically synthesized
tctcaaaaaaaaaaaaaaagag

SEQ ID NO: 62442 - DNA, 22 bp, Artificial Sequence
  chemically synthesized
aaaaaaaaaaaaaaagagagaa

SEQ ID NO: 62443 - DNA, 22 bp, Artificial Sequence
  chemically synthesized
acttttcctttaagaatgtgct

SEQ ID NO: 62444 - DNA, 22 bp, Artificial Sequence
  chemically synthesized
ttcctttaagaatgtgctcttg

SEQ ID NO: 62445 - DNA, 22 bp, Artificial Sequence
  chemically synthesized
tcctttaagaatgtgctcttgg

SEQ ID NO: 62446 - DNA, 22 bp, Artificial Sequence
  chemically synthesized
cctttaagaatgtgctcttggt

SEQ ID NO: 62447 - DNA, 22 bp, Artificial Sequence
  chemically synthesized
ctttaagaatgtgctcttggtt

SEQ ID NO: 62448 - DNA, 22 bp, Artificial Sequence
  chemically synthesized
taagaatgtgctcttggttggc

SEQ ID NO: 62449 - DNA, 22 bp, Artificial Sequence
  chemically synthesized
aagaatgtgctcttggttggct

SEQ ID NO: 62450 - DNA, 22 bp, Artificial Sequence
  chemically synthesized
agaatgtgctcttggttggctt

SEQ ID NO: 62451 - DNA, 22 bp, Artificial Sequence
  chemically synthesized
ttggttggcttgggatagagaa

SEQ ID NO: 62452 - DNA, 22 bp, Artificial Sequence
  chemically synthesized
ggttggcttgggatagagaaag

SEQ ID NO: 62453 - DNA, 22 bp, Artificial Sequence
  chemically synthesized
gttggcttgggatagagaaagg

SEQ ID NO: 62454 - DNA, 22 bp, Artificial Sequence
  chemically synthesized
gcttgggatagagaaaggagtc

SEQ ID NO: 62455 - DNA, 22 bp, Artificial Sequence
  chemically synthesized
gggatagagaaaggagtcatat

SEQ ID NO: 62456 - DNA, 22 bp, Artificial Sequence
  chemically synthesized
ggatagagaaaggagtcatatt

SEQ ID NO: 62457 - DNA, 22 bp, Artificial Sequence
  chemically synthesized
accctctaggaattaaaagtaa

SEQ ID NO: 62458 - DNA, 22 bp, Artificial Sequence
  chemically synthesized
ccctctaggaattaaaagtaac

SEQ ID NO: 62459 - DNA, 22 bp, Artificial Sequence
  chemically synthesized
taggaattaaaagtaacactgg

SEQ ID NO: 62460 - DNA, 22 bp, Artificial Sequence
  chemically synthesized
ggaattaaaagtaacactggag

SEQ ID NO: 62461 - DNA, 22 bp, Artificial Sequence
  chemically synthesized
aaagtaacactggagtgacctg

SEQ ID NO: 62462 - DNA, 22 bp, Artificial Sequence
  chemically synthesized
gagtgacctgagagaggaatcc

SEQ ID NO: 62463 - DNA, 22 bp, Artificial Sequence
  chemically synthesized
agagaggaatcctggccctccc

SEQ ID NO: 62464 - DNA, 22 bp, Artificial Sequence
  chemically synthesized
gccctccccttgtcattttgcc

SEQ ID NO: 62465 - DNA, 22 bp, Artificial Sequence
  chemically synthesized
cccttgtcattttgcccaagat

SEQ ID NO: 62466 - DNA, 22 bp, Artificial Sequence
  chemically synthesized
gtcattttgcccaagatttcag

SEQ ID NO: 62467 - DNA, 22 bp, Artificial Sequence
  chemically synthesized
tcattttgcccaagatttcaga

SEQ ID NO: 62468 - DNA, 22 bp, Artificial Sequence
  chemically synthesized
tgcccaagatttcagagcctaa

SEQ ID NO: 62469 - DNA, 22 bp, Artificial Sequence
  chemically synthesized
gcccaagatttcagagcctaat

SEQ ID NO: 62470 - DNA, 22 bp, Artificial Sequence
  chemically synthesized
cccaagatttcagagcctaatt

SEQ ID NO: 62471 - DNA, 22 bp, Artificial Sequence
  chemically synthesized
cagagcctaattgaaacataca

SEQ ID NO: 62472 - DNA, 22 bp, Artificial Sequence
  chemically synthesized
agagcctaattgaaacatacaa

SEQ ID NO: 62473 - DNA, 22 bp, Artificial Sequence
  chemically synthesized
attgaaacatacaaaagcacca

SEQ ID NO: 62474 - DNA, 22 bp, Artificial Sequence
  chemically synthesized
aaacatacaaaagcaccaccag

SEQ ID NO: 62475 - DNA, 22 bp, Artificial Sequence
  chemically synthesized
tagccttctgaagatccagtgg

SEQ ID NO: 62476 - DNA, 22 bp, Artificial Sequence
  chemically synthesized
gccttctgaagatccagtgggg

SEQ ID NO: 62477 - DNA, 22 bp, Artificial Sequence
  chemically synthesized
ctgaagatccagtggggtggat

SEQ ID NO: 62478 - DNA, 22 bp, Artificial Sequence
  chemically synthesized
tgaagatccagtggggtggatg

SEQ ID NO: 62479 - DNA, 22 bp, Artificial Sequence
  chemically synthesized
aagatccagtggggtggatgtg

SEQ ID NO: 62480 - DNA, 22 bp, Artificial Sequence
  chemically synthesized
gaaaaagcagagctgggcttat

SEQ ID NO: 62481 - DNA, 22 bp, Artificial Sequence
  chemically synthesized
ggcttataaggaggatgatgta

SEQ ID NO: 62482 - DNA, 22 bp, Artificial Sequence
  chemically synthesized
ataaggaggatgatgtaatgtg

SEQ ID NO: 62483 - DNA, 22 bp, Artificial Sequence
  chemically synthesized
taaggaggatgatgtaatgtga

SEQ ID NO: 62484 - DNA, 22 bp, Artificial Sequence
  chemically synthesized
tacctgaatgttttgacctagt

SEQ ID NO: 62485 - DNA, 22 bp, Artificial Sequence
  chemically synthesized
aatgttttgacctagtgcaata

SEQ ID NO: 62486 - DNA, 22 bp, Artificial Sequence
  chemically synthesized
tgacctagtgcaatatctgggt

SEQ ID NO: 62487 - DNA, 22 bp, Artificial Sequence
  chemically synthesized
gacctagtgcaatatctgggtc

SEQ ID NO: 62488 - DNA, 22 bp, Artificial Sequence
  chemically synthesized
acctagtgcaatatctgggtca

SEQ ID NO: 62489 - DNA, 22 bp, Artificial Sequence
  chemically synthesized
gtgcaatatctgggtcactgca

SEQ ID NO: 62490 - DNA, 22 bp, Artificial Sequence
  chemically synthesized
ggtcactgcagccattcagaaa

SEQ ID NO: 62491 - DNA, 22 bp, Artificial Sequence
  chemically synthesized
cagccattcagaaatccaagga

SEQ ID NO: 62492 - DNA, 22 bp, Artificial Sequence
  chemically synthesized
agaaatccaaggaaatacgatg

SEQ ID NO: 62493 - DNA, 22 bp, Artificial Sequence
  chemically synthesized
gaagcagaattaccccactaac

SEQ ID NO: 62494 - DNA, 22 bp, Artificial Sequence
  chemically synthesized
ccccactaaccatctattaatt

SEQ ID NO: 62495 - DNA, 22 bp, Artificial Sequence
  chemically synthesized
accatctattaattatacttaa

SEQ ID NO: 62496 - DNA, 22 bp, Artificial Sequence
  chemically synthesized
ttaattatacttaagctggtcc

SEQ ID NO: 62497 - DNA, 22 bp, Artificial Sequence
  chemically synthesized
attatacttaagctggtccccc

SEQ ID NO: 62498 - DNA, 22 bp, Artificial Sequence
  chemically synthesized
tacttaagctggtcccccatta

SEQ ID NO: 62499 - DNA, 22 bp, Artificial Sequence
  chemically synthesized
aagctggtcccccattactgag

SEQ ID NO: 62500 - DNA, 22 bp, Artificial Sequence
  chemically synthesized
agctggtcccccattactgaga

SEQ ID NO: 62501 - DNA, 22 bp, Artificial Sequence
  chemically synthesized
gtcccccattactgagagtgca

SEQ ID NO: 62502 - DNA, 22 bp, Artificial Sequence
  chemically synthesized
ctgagagtgcattactatataa

SEQ ID NO: 62503 - DNA, 22 bp, Artificial Sequence
  chemically synthesized
agagtgcattactatataatta

SEQ ID NO: 62504 - DNA, 22 bp, Artificial Sequence
  chemically synthesized
ctatataattaaagccatttag

SEQ ID NO: 62505 - DNA, 22 bp, Artificial Sequence
  chemically synthesized
tataattaaagccatttagaca

SEQ ID NO: 62506 - DNA, 22 bp, Artificial Sequence
  chemically synthesized
aagccatttagacatggcttgg

SEQ ID NO: 62507 - DNA, 22 bp, Artificial Sequence
  chemically synthesized
agacatggcttggcatagcact

SEQ ID NO: 62508 - DNA, 22 bp, Artificial Sequence
  chemically synthesized
gacatggcttggcatagcactt

SEQ ID NO: 62509 - DNA, 22 bp, Artificial Sequence
  chemically synthesized
ggcatagcacttgcatgatacg

SEQ ID NO: 62510 - DNA, 22 bp, Artificial Sequence
  chemically synthesized
gcatagcacttgcatgatacgc

SEQ ID NO: 62511 - DNA, 22 bp, Artificial Sequence
  chemically synthesized
gcatgatacgccacatactaaa

SEQ ID NO: 62512 - DNA, 22 bp, Artificial Sequence
  chemically synthesized
catgatacgccacatactaaaa

SEQ ID NO: 62513 - DNA, 22 bp, Artificial Sequence
  chemically synthesized
aaaactcctccttaggcagcct

SEQ ID NO: 62514 - DNA, 22 bp, Artificial Sequence
  chemically synthesized
ctccttaggcagccttcttttc

SEQ ID NO: 62515 - DNA, 22 bp, Artificial Sequence
  chemically synthesized
cttaggcagccttcttttccta

SEQ ID NO: 62516 - DNA, 22 bp, Artificial Sequence
  chemically synthesized
aggcagccttcttttcctatca

SEQ ID NO: 62517 - DNA, 22 bp, Artificial Sequence
  chemically synthesized
ggcagccttcttttcctatcag

SEQ ID NO: 62518 - DNA, 22 bp, Artificial Sequence
  chemically synthesized
cttttcctatcagattcagagc

SEQ ID NO: 62519 - DNA, 22 bp, Artificial Sequence
  chemically synthesized
ttttcctatcagattcagagct

SEQ ID NO: 62520 - DNA, 22 bp, Artificial Sequence
  chemically synthesized
ttcctatcagattcagagctcc

SEQ ID NO: 62521 - DNA, 22 bp, Artificial Sequence
  chemically synthesized
tcctatcagattcagagctcct

SEQ ID NO: 62522 - DNA, 22 bp, Artificial Sequence
  chemically synthesized
cctatcagattcagagctcctt

SEQ ID NO: 62523 - DNA, 22 bp, Artificial Sequence
  chemically synthesized
ctatcagattcagagctccttt

SEQ ID NO: 62524 - DNA, 22 bp, Artificial Sequence
  chemically synthesized
tcagattcagagctcctttctc

SEQ ID NO: 62525 - DNA, 22 bp, Artificial Sequence
  chemically synthesized
agagctcctttctccttttctc

SEQ ID NO: 62526 - DNA, 22 bp, Artificial Sequence
  chemically synthesized
ctttctccttttctcggtaaga

SEQ ID NO: 62527 - DNA, 22 bp, Artificial Sequence
  chemically synthesized
tctccttttctcggtaagaatg

SEQ ID NO: 62528 - DNA, 22 bp, Artificial Sequence
  chemically synthesized
ctccttttctcggtaagaatga

SEQ ID NO: 62529 - DNA, 22 bp, Artificial Sequence
  chemically synthesized
tccttttctcggtaagaatgaa

SEQ ID NO: 62530 - DNA, 22 bp, Artificial Sequence
  chemically synthesized
cttttctcggtaagaatgaaca

SEQ ID NO: 62531 - DNA, 22 bp, Artificial Sequence
  chemically synthesized
ttctcggtaagaatgaacacag

SEQ ID NO: 62532 - DNA, 22 bp, Artificial Sequence
  chemically synthesized
tctcggtaagaatgaacacagg

SEQ ID NO: 62533 - DNA, 22 bp, Artificial Sequence
  chemically synthesized
ctcggtaagaatgaacacaggt

SEQ ID NO: 62534 - DNA, 22 bp, Artificial Sequence
  chemically synthesized
tcggtaagaatgaacacaggta

SEQ ID NO: 62535 - DNA, 22 bp, Artificial Sequence
  chemically synthesized
ggtaagaatgaacacaggtaga

SEQ ID NO: 62536 - DNA, 22 bp, Artificial Sequence
  chemically synthesized
tcagttaggatctccagcctgg

SEQ ID NO: 62537 - DNA, 22 bp, Artificial Sequence
  chemically synthesized
agttaggatctccagcctgggc

SEQ ID NO: 62538 - DNA, 22 bp, Artificial Sequence
  chemically synthesized
ggatctccagcctgggcttgtg

SEQ ID NO: 62539 - DNA, 22 bp, Artificial Sequence
  chemically synthesized
cagcctgggcttgtgagctggc

SEQ ID NO: 62540 - DNA, 22 bp, Artificial Sequence
  chemically synthesized
ggcttgtgagctggccctacct

SEQ ID NO: 62541 - DNA, 22 bp, Artificial Sequence
  chemically synthesized
gtgagctggccctacctggaag

SEQ ID NO: 62542 - DNA, 22 bp, Artificial Sequence
  chemically synthesized
tgagctggccctacctggaagt

SEQ ID NO: 62543 - DNA, 22 bp, Artificial Sequence
  chemically synthesized
gccctacctggaagtcttgctt

SEQ ID NO: 62544 - DNA, 22 bp, Artificial Sequence
  chemically synthesized
cctggaagtcttgcttttgtat

SEQ ID NO: 62545 - DNA, 22 bp, Artificial Sequence
  chemically synthesized
gaagtcttgcttttgtatatgt

SEQ ID NO: 62546 - DNA, 22 bp, Artificial Sequence
  chemically synthesized
gcttttgtatatgtgacggaag

SEQ ID NO: 62547 - DNA, 22 bp, Artificial Sequence
  chemically synthesized
cttttgtatatgtgacggaaga

SEQ ID NO: 62548 - DNA, 22 bp, Artificial Sequence
  chemically synthesized
ttgtatatgtgacggaagaata

SEQ ID NO: 62549 - DNA, 22 bp, Artificial Sequence
  chemically synthesized
tgtatatgtgacggaagaataa

SEQ ID NO: 62550 - DNA, 22 bp, Artificial Sequence
  chemically synthesized
gtatatgtgacggaagaataag

SEQ ID NO: 62551 - DNA, 22 bp, Artificial Sequence
  chemically synthesized
tatatgtgacggaagaataagt

SEQ ID NO: 62552 - DNA, 22 bp, Artificial Sequence
  chemically synthesized
caggggaaaatccagaacaacc

SEQ ID NO: 62553 - DNA, 22 bp, Artificial Sequence
  chemically synthesized
aggggaaaatccagaacaaccc

SEQ ID NO: 62554 - DNA, 22 bp, Artificial Sequence
  chemically synthesized
ctagcaacaggtctttctcaat

SEQ ID NO: 62555 - DNA, 22 bp, Artificial Sequence
  chemically synthesized
tagcaacaggtctttctcaata

SEQ ID NO: 62556 - DNA, 22 bp, Artificial Sequence
  chemically synthesized
gcaacaggtctttctcaatagc

SEQ ID NO: 62557 - DNA, 22 bp, Artificial Sequence
  chemically synthesized
tctcaatagcttcattagcttt

SEQ ID NO: 62558 - DNA, 22 bp, Artificial Sequence
  chemically synthesized
ctcaatagcttcattagctttt

SEQ ID NO: 62559 - DNA, 22 bp, Artificial Sequence
  chemically synthesized
tcaatagcttcattagcttttc

SEQ ID NO: 62560 - DNA, 22 bp, Artificial Sequence
  chemically synthesized
aatagcttcattagcttttcaa

SEQ ID NO: 62561 - DNA, 22 bp, Artificial Sequence
  chemically synthesized
cattagcttttcaaaaacatta

SEQ ID NO: 62562 - DNA, 22 bp, Artificial Sequence
  chemically synthesized
attagcttttcaaaaacattac

SEQ ID NO: 62563 - DNA, 22 bp, Artificial Sequence
  chemically synthesized
gcttttcaaaaacattacccaa

SEQ ID NO: 62564 - DNA, 22 bp, Artificial Sequence
  chemically synthesized
ttcaaaaacattacccaatatg

SEQ ID NO: 62565 - DNA, 22 bp, Artificial Sequence
  chemically synthesized
tcaaaaacattacccaatatga

SEQ ID NO: 62566 - DNA, 22 bp, Artificial Sequence
  chemically synthesized
caaaaacattacccaatatgat

SEQ ID NO: 62567 - DNA, 22 bp, Artificial Sequence
  chemically synthesized
aaaaacattacccaatatgatt

SEQ ID NO: 62568 - DNA, 22 bp, Artificial Sequence
  chemically synthesized
cccaatatgattaggattgtaa

SEQ ID NO: 62569 - DNA, 22 bp, Artificial Sequence
  chemically synthesized
ggattgtaaaagaggaccacct

SEQ ID NO: 62570 - DNA, 22 bp, Artificial Sequence
  chemically synthesized
taaaagaggaccacctgagctg

SEQ ID NO: 62571 - DNA, 22 bp, Artificial Sequence
  chemically synthesized
agctgacagcacctctggcctc

SEQ ID NO: 62572 - DNA, 22 bp, Artificial Sequence
  chemically synthesized
acagcacctctggcctcaaaat

SEQ ID NO: 62573 - DNA, 22 bp, Artificial Sequence
  chemically synthesized
tggcctcaaaatgggctggcag

SEQ ID NO: 62574 - DNA, 22 bp, Artificial Sequence
  chemically synthesized
gcctcaaaatgggctggcagaa

SEQ ID NO: 62575 - DNA, 22 bp, Artificial Sequence
  chemically synthesized
aaaatgggctggcagaagacca

SEQ ID NO: 62576 - DNA, 22 bp, Artificial Sequence
  chemically synthesized
gcagaagaccattcaaagataa

SEQ ID NO: 62577 - DNA, 22 bp, Artificial Sequence
  chemically synthesized
aaagataaaatgggctgttcca

SEQ ID NO: 62578 - DNA, 22 bp, Artificial Sequence
  chemically synthesized
ttccagtgggagtgagctccct

SEQ ID NO: 62579 - DNA, 22 bp, Artificial Sequence
  chemically synthesized
cagtgggagtgagctccctact

SEQ ID NO: 62580 - DNA, 22 bp, Artificial Sequence
  chemically synthesized
cctacttgtgagagtattcaag

SEQ ID NO: 62581 - DNA, 22 bp, Artificial Sequence
  chemically synthesized
cttgtgagagtattcaagtaga

SEQ ID NO: 62582 - DNA, 22 bp, Artificial Sequence
  chemically synthesized
gtgagagtattcaagtagagag

SEQ ID NO: 62583 - DNA, 22 bp, Artificial Sequence
  chemically synthesized
tgagagtattcaagtagagaga

SEQ ID NO: 62584 - DNA, 22 bp, Artificial Sequence
  chemically synthesized
aagtagagagaggaggacctcc

SEQ ID NO: 62585 - DNA, 22 bp, Artificial Sequence
  chemically synthesized
ctggcgggaaacttgcatatgg

SEQ ID NO: 62586 - DNA, 22 bp, Artificial Sequence
  chemically synthesized
gcgggaaacttgcatatggtgt

SEQ ID NO: 62587 - DNA, 22 bp, Artificial Sequence
  chemically synthesized
gcatatggtgtacgtgatatgg

SEQ ID NO: 62588 - DNA, 22 bp, Artificial Sequence
  chemically synthesized
catatggtgtacgtgatatggc

SEQ ID NO: 62589 - DNA, 22 bp, Artificial Sequence
  chemically synthesized
catctgaaagagtctgtgctga

SEQ ID NO: 62590 - DNA, 22 bp, Artificial Sequence
  chemically synthesized
aaagagtctgtgctgagggcag

SEQ ID NO: 62591 - DNA, 22 bp, Artificial Sequence
  chemically synthesized
tgctgagggcaggctggagtca

SEQ ID NO: 62592 - DNA, 22 bp, Artificial Sequence
  chemically synthesized
agggcaggctggagtcacacat

SEQ ID NO: 62593 - DNA, 22 bp, Artificial Sequence
  chemically synthesized
gagtcacacatgggaataagcc

SEQ ID NO: 62594 - DNA, 22 bp, Artificial Sequence
  chemically synthesized
caatctgccatccgtgatttaa

SEQ ID NO: 62595 - DNA, 22 bp, Artificial Sequence
  chemically synthesized
ccatccgtgatttaattccacg

SEQ ID NO: 62596 - DNA, 22 bp, Artificial Sequence
  chemically synthesized
aattccacgacggcagaatgga

SEQ ID NO: 62597 - DNA, 22 bp, Artificial Sequence
  chemically synthesized
attccacgacggcagaatggat

SEQ ID NO: 62598 - DNA, 22 bp, Artificial Sequence
  chemically synthesized
cacgacggcagaatggatggca

SEQ ID NO: 62599 - DNA, 22 bp, Artificial Sequence
  chemically synthesized
gctccaaataccagtgcccatt

SEQ ID NO: 62600 - DNA, 22 bp, Artificial Sequence
  chemically synthesized
ctccaaataccagtgcccattg

SEQ ID NO: 62601 - DNA, 22 bp, Artificial Sequence
  chemically synthesized
caaataccagtgcccattgctt

SEQ ID NO: 62602 - DNA, 22 bp, Artificial Sequence
  chemically synthesized
cttcaaatagtagtcctcctca

SEQ ID NO: 62603 - DNA, 22 bp, Artificial Sequence
  chemically synthesized
caaatagtagtcctcctcaatc

SEQ ID NO: 62604 - DNA, 22 bp, Artificial Sequence
  chemically synthesized
aaatagtagtcctcctcaatcc

SEQ ID NO: 62605 - DNA, 22 bp, Artificial Sequence
  chemically synthesized
ctcaatccctggcatggttgtt

SEQ ID NO: 62606 - DNA, 22 bp, Artificial Sequence
  chemically synthesized
aatccctggcatggttgttgac

SEQ ID NO: 62607 - DNA, 22 bp, Artificial Sequence
  chemically synthesized
gcatggttgttgactttaaaca

SEQ ID NO: 62608 - DNA, 22 bp, Artificial Sequence
  chemically synthesized
ttgactttaaacaccgaagact

SEQ ID NO: 62609 - DNA, 22 bp, Artificial Sequence
  chemically synthesized
actttaaacaccgaagactcca

SEQ ID NO: 62610 - DNA, 22 bp, Artificial Sequence
  chemically synthesized
taaacaccgaagactccacatc

SEQ ID NO: 62611 - DNA, 22 bp, Artificial Sequence
  chemically synthesized
aaacaccgaagactccacatct

SEQ ID NO: 62612 - DNA, 22 bp, Artificial Sequence
  chemically synthesized
aacaccgaagactccacatctc

SEQ ID NO: 62613 - DNA, 22 bp, Artificial Sequence
  chemically synthesized
cacatctcttacaacgacttct

SEQ ID NO: 62614 - DNA, 22 bp, Artificial Sequence
  chemically synthesized
ttacaacgacttcttgtgcggc

SEQ ID NO: 62615 - DNA, 22 bp, Artificial Sequence
  chemically synthesized
acaacgacttcttgtgcggctg

SEQ ID NO: 62616 - DNA, 22 bp, Artificial Sequence
  chemically synthesized
caacgacttcttgtgcggctgg

SEQ ID NO: 62617 - DNA, 22 bp, Artificial Sequence
  chemically synthesized
cttgtgcggctggcccaggacc

SEQ ID NO: 62618 - DNA, 22 bp, Artificial Sequence
  chemically synthesized
ttgtgcggctggcccaggacct

SEQ ID NO: 62619 - DNA, 22 bp, Artificial Sequence
  chemically synthesized
gtgcggctggcccaggacctgg

SEQ ID NO: 62620 - DNA, 22 bp, Artificial Sequence
  chemically synthesized
tgcggctggcccaggacctggg

SEQ ID NO: 62621 - DNA, 22 bp, Artificial Sequence
  chemically synthesized
gcccaggacctgggcgaggcag

SEQ ID NO: 62622 - DNA, 22 bp, Artificial Sequence
  chemically synthesized
ggcgaggcagtaggggatgaca

SEQ ID NO: 62623 - DNA, 22 bp, Artificial Sequence
  chemically synthesized
acggatgccaggggcactaccg

SEQ ID NO: 62624 - DNA, 22 bp, Artificial Sequence
  chemically synthesized
ccgcactcttgcagaaggacaa

SEQ ID NO: 62625 - DNA, 22 bp, Artificial Sequence
  chemically synthesized
ttgcagaaggacaagacgtaga

SEQ ID NO: 62626 - DNA, 22 bp, Artificial Sequence
  chemically synthesized
gcagaaggacaagacgtagaag

SEQ ID NO: 62627 - DNA, 22 bp, Artificial Sequence
  chemically synthesized
cagaaggacaagacgtagaaga

SEQ ID NO: 62628 - DNA, 22 bp, Artificial Sequence
  chemically synthesized
gacttgggatgggggtttcaag

SEQ ID NO: 62629 - DNA, 22 bp, Artificial Sequence
  chemically synthesized
gggatgggggtttcaaggagtc

SEQ ID NO: 62630 - DNA, 22 bp, Artificial Sequence
  chemically synthesized
ggatgggggtttcaaggagtca

SEQ ID NO: 62631 - DNA, 22 bp, Artificial Sequence
  chemically synthesized
caaggagtcaaagacgtgcagg

SEQ ID NO: 62632 - DNA, 22 bp, Artificial Sequence
  chemically synthesized
aaggagtcaaagacgtgcagga

SEQ ID NO: 62633 - DNA, 22 bp, Artificial Sequence
  chemically synthesized
caatagagctgaggcggaatgg

SEQ ID NO: 62634 - DNA, 22 bp, Artificial Sequence
  chemically synthesized
aggcggaatgggagccacttgc

SEQ ID NO: 62635 - DNA, 22 bp, Artificial Sequence
  chemically synthesized
gctgagtttccccttgcagctc

SEQ ID NO: 62636 - DNA, 22 bp, Artificial Sequence
  chemically synthesized
ctgagtttccccttgcagctct

SEQ ID NO: 62637 - DNA, 22 bp, Artificial Sequence
  chemically synthesized
agtttccccttgcagctctccc

SEQ ID NO: 62638 - DNA, 22 bp, Artificial Sequence
  chemically synthesized
ccccttgcagctctccctgtac

SEQ ID NO: 62639 - DNA, 22 bp, Artificial Sequence
  chemically synthesized
cccttgcagctctccctgtaca

SEQ ID NO: 62640 - DNA, 22 bp, Artificial Sequence
  chemically synthesized
gcagctctccctgtacatgctg

SEQ ID NO: 62641 - DNA, 22 bp, Artificial Sequence
  chemically synthesized
cagctctccctgtacatgctgg

SEQ ID NO: 62642 - DNA, 22 bp, Artificial Sequence
  chemically synthesized
tccctgtacatgctggagttga

SEQ ID NO: 62643 - DNA, 22 bp, Artificial Sequence
  chemically synthesized
cctgtacatgctggagttgaga

SEQ ID NO: 62644 - DNA, 22 bp, Artificial Sequence
  chemically synthesized
tacatgctggagttgagagcca

SEQ ID NO: 62645 - DNA, 22 bp, Artificial Sequence
  chemically synthesized
gagttgagagccagccccaggc

SEQ ID NO: 62646 - DNA, 22 bp, Artificial Sequence
  chemically synthesized
agagccagccccaggccaaaga

SEQ ID NO: 62647 - DNA, 22 bp, Artificial Sequence
  chemically synthesized
ttgaggaggctggcaaagggtg

SEQ ID NO: 62648 - DNA, 22 bp, Artificial Sequence
  chemically synthesized
gaggaggctggcaaagggtgtg

SEQ ID NO: 62649 - DNA, 22 bp, Artificial Sequence
  chemically synthesized
aggaggctggcaaagggtgtgg

SEQ ID NO: 62650 - DNA, 22 bp, Artificial Sequence
  chemically synthesized
gcaaagggtgtggtgtcaatgt

SEQ ID NO: 62651 - DNA, 22 bp, Artificial Sequence
  chemically synthesized
tggctgctcgcaccacctctgg

SEQ ID NO: 62652 - DNA, 22 bp, Artificial Sequence
  chemically synthesized
gctgctcgcaccacctctgggc

SEQ ID NO: 62653 - DNA, 22 bp, Artificial Sequence
  chemically synthesized
ctcgcaccacctctgggctttc

SEQ ID NO: 62654 - DNA, 22 bp, Artificial Sequence
  chemically synthesized
gcaccacctctgggctttctcc

SEQ ID NO: 62655 - DNA, 22 bp, Artificial Sequence
  chemically synthesized
tgggctttctccagagtccaca

SEQ ID NO: 62656 - DNA, 22 bp, Artificial Sequence
  chemically synthesized
ggctttctccagagtccacagg

SEQ ID NO: 62657 - DNA, 22 bp, Artificial Sequence
  chemically synthesized
tctccagagtccacaggaggtc

SEQ ID NO: 62658 - DNA, 22 bp, Artificial Sequence
  chemically synthesized
ctccagagtccacaggaggtct

SEQ ID NO: 62659 - DNA, 22 bp, Artificial Sequence
  chemically synthesized
tccagagtccacaggaggtcta

SEQ ID NO: 62660 - DNA, 22 bp, Artificial Sequence
  chemically synthesized
cagagtccacaggaggtctaca

SEQ ID NO: 62661 - DNA, 22 bp, Artificial Sequence
  chemically synthesized
cacccagtcccttgagcagcag

SEQ ID NO: 62662 - DNA, 22 bp, Artificial Sequence
  chemically synthesized
gagcagcagataaaatccgatg

SEQ ID NO: 62663 - DNA, 22 bp, Artificial Sequence
  chemically synthesized
agcagcagataaaatccgatgg

SEQ ID NO: 62664 - DNA, 22 bp, Artificial Sequence
  chemically synthesized
aacaggaagaaggtaatgagaa

SEQ ID NO: 62665 - DNA, 22 bp, Artificial Sequence
  chemically synthesized
cttgaggctggcattatagatg

SEQ ID NO: 62666 - DNA, 22 bp, Artificial Sequence
  chemically synthesized
ttgaggctggcattatagatgc

SEQ ID NO: 62667 - DNA, 22 bp, Artificial Sequence
  chemically synthesized
gaggctggcattatagatgctg

SEQ ID NO: 62668 - DNA, 22 bp, Artificial Sequence
  chemically synthesized
aggctggcattatagatgctgt

SEQ ID NO: 62669 - DNA, 22 bp, Artificial Sequence
  chemically synthesized
gcattatagatgctgtggatgt

SEQ ID NO: 62670 - DNA, 22 bp, Artificial Sequence
  chemically synthesized
tagatgctgtggatgtggctga

SEQ ID NO: 62671 - DNA, 22 bp, Artificial Sequence
  chemically synthesized
tggatgtggctgaaagtttctg

SEQ ID NO: 62672 - DNA, 22 bp, Artificial Sequence
  chemically synthesized
aaagtttctgcaacagcaatgc

SEQ ID NO: 62673 - DNA, 22 bp, Artificial Sequence
  chemically synthesized
ctgcaacagcaatgcctgagtg

SEQ ID NO: 62674 - DNA, 22 bp, Artificial Sequence
  chemically synthesized
tgcaacagcaatgcctgagtgg

SEQ ID NO: 62675 - DNA, 22 bp, Artificial Sequence
  chemically synthesized
caacagcaatgcctgagtggaa

SEQ ID NO: 62676 - DNA, 22 bp, Artificial Sequence
  chemically synthesized
agtggaagaaagcatgactgtg

SEQ ID NO: 62677 - DNA, 22 bp, Artificial Sequence
  chemically synthesized
tgagagataggaaggatttggg

SEQ ID NO: 62678 - DNA, 22 bp, Artificial Sequence
  chemically synthesized
gggacctttgctagaggtgggt

SEQ ID NO: 62679 - DNA, 22 bp, Artificial Sequence
  chemically synthesized
ggacctttgctagaggtgggtt

SEQ ID NO: 62680 - DNA, 22 bp, Artificial Sequence
  chemically synthesized
tgctagaggtgggtttggagga

SEQ ID NO: 62681 - DNA, 22 bp, Artificial Sequence
  chemically synthesized
gctagaggtgggtttggaggag

SEQ ID NO: 62682 - DNA, 22 bp, Artificial Sequence
  chemically synthesized
ctagaggtgggtttggaggagt

SEQ ID NO: 62683 - DNA, 22 bp, Artificial Sequence
  chemically synthesized
gaggtgggtttggaggagtggg

SEQ ID NO: 62684 - DNA, 22 bp, Artificial Sequence
  chemically synthesized
ggaggagtgggtgacatgccat

SEQ ID NO: 62685 - DNA, 22 bp, Artificial Sequence
  chemically synthesized
gaggagtgggtgacatgccatc

SEQ ID NO: 62686 - DNA, 22 bp, Artificial Sequence
  chemically synthesized
tgcgactgtggaattaaatcac

SEQ ID NO: 62687 - DNA, 22 bp, Artificial Sequence
  chemically synthesized
cgactgtggaattaaatcacag

SEQ ID NO: 62688 - DNA, 22 bp, Artificial Sequence
  chemically synthesized
tggaattaaatcacagatggca

SEQ ID NO: 62689 - DNA, 22 bp, Artificial Sequence
  chemically synthesized
aatcacagatggcagatgggag

SEQ ID NO: 62690 - DNA, 22 bp, Artificial Sequence
  chemically synthesized
gcttattcccatgtgtgactcc

SEQ ID NO: 62691 - DNA, 22 bp, Artificial Sequence
  chemically synthesized
attcccatgtgtgactccagcc

SEQ ID NO: 62692 - DNA, 22 bp, Artificial Sequence
  chemically synthesized
ttcccatgtgtgactccagcct

SEQ ID NO: 62693 - DNA, 22 bp, Artificial Sequence
  chemically synthesized
ccatgtgtgactccagcctgcc

SEQ ID NO: 62694 - DNA, 22 bp, Artificial Sequence
  chemically synthesized
cagcctgccctcaatatagact

SEQ ID NO: 62695 - DNA, 22 bp, Artificial Sequence
  chemically synthesized
ccctcaatatagactctttcag

SEQ ID NO: 62696 - DNA, 22 bp, Artificial Sequence
  chemically synthesized
aatatagactctttcagatgga

SEQ ID NO: 62697 - DNA, 22 bp, Artificial Sequence
  chemically synthesized
tttcagatggaggtgccatatc

SEQ ID NO: 62698 - DNA, 22 bp, Artificial Sequence
  chemically synthesized
tcagatggaggtgccatatcac

SEQ ID NO: 62699 - DNA, 22 bp, Artificial Sequence
  chemically synthesized
cagatggaggtgccatatcacg

SEQ ID NO: 62700 - DNA, 22 bp, Artificial Sequence
  chemically synthesized
agatggaggtgccatatcacgt

SEQ ID NO: 62701 - DNA, 22 bp, Artificial Sequence
  chemically synthesized
ccaccgtatgcaaatttcctac

SEQ ID NO: 62702 - DNA, 22 bp, Artificial Sequence
  chemically synthesized
cctaccaggaggtcctcctatc

SEQ ID NO: 62703 - DNA, 22 bp, Artificial Sequence
  chemically synthesized
ctaccaggaggtcctcctatct

SEQ ID NO: 62704 - DNA, 22 bp, Artificial Sequence
  chemically synthesized
ccaggaggtcctcctatctcta

SEQ ID NO: 62705 - DNA, 22 bp, Artificial Sequence
  chemically synthesized
ctatctctacttgaaataccct

SEQ ID NO: 62706 - DNA, 22 bp, Artificial Sequence
  chemically synthesized
tctctacttgaaataccctcag

SEQ ID NO: 62707 - DNA, 22 bp, Artificial Sequence
  chemically synthesized
tacttgaaataccctcagaggt

SEQ ID NO: 62708 - DNA, 22 bp, Artificial Sequence
  chemically synthesized
cttgaaataccctcagaggtag

SEQ ID NO: 62709 - DNA, 22 bp, Artificial Sequence
  chemically synthesized
gaaataccctcagaggtaggga

SEQ ID NO: 62710 - DNA, 22 bp, Artificial Sequence
  chemically synthesized
aaataccctcagaggtagggag

SEQ ID NO: 62711 - DNA, 22 bp, Artificial Sequence
  chemically synthesized
agaggtagggagctcaccccca

SEQ ID NO: 62712 - DNA, 22 bp, Artificial Sequence
  chemically synthesized
acccccactataacagtccatt

SEQ ID NO: 62713 - DNA, 22 bp, Artificial Sequence
  chemically synthesized
taacagtccattttatctttga

SEQ ID NO: 62714 - DNA, 22 bp, Artificial Sequence
  chemically synthesized
tatctttgaacggaattgattg

SEQ ID NO: 62715 - DNA, 22 bp, Artificial Sequence
  chemically synthesized
atctttgaacggaattgattgc

SEQ ID NO: 62716 - DNA, 22 bp, Artificial Sequence
  chemically synthesized
tctttgaacggaattgattgct

SEQ ID NO: 62717 - DNA, 22 bp, Artificial Sequence
  chemically synthesized
tgaacggaattgattgctgaat

SEQ ID NO: 62718 - DNA, 22 bp, Artificial Sequence
  chemically synthesized
gaacggaattgattgctgaata

SEQ ID NO: 62719 - DNA, 22 bp, Artificial Sequence
  chemically synthesized
aacggaattgattgctgaatag

SEQ ID NO: 62720 - DNA, 22 bp, Artificial Sequence
  chemically synthesized
attgctgaatagttcttccttg

SEQ ID NO: 62721 - DNA, 22 bp, Artificial Sequence
  chemically synthesized
ctgaatagttcttccttgtctg

SEQ ID NO: 62722 - DNA, 22 bp, Artificial Sequence
  chemically synthesized
aatagttcttccttgtctgtgt

SEQ ID NO: 62723 - DNA, 22 bp, Artificial Sequence
  chemically synthesized
ttccttgtctgtgtgaaactgg

SEQ ID NO: 62724 - DNA, 22 bp, Artificial Sequence
  chemically synthesized
ccttgtctgtgtgaaactggtc

SEQ ID NO: 62725 - DNA, 22 bp, Artificial Sequence
  chemically synthesized
cttgtctgtgtgaaactggtcc

SEQ ID NO: 62726 - DNA, 22 bp, Artificial Sequence
  chemically synthesized
gtctgtgtgaaactggtccccc

SEQ ID NO: 62727 - DNA, 22 bp, Artificial Sequence
  chemically synthesized
tctgtgtgaaactggtccccct

SEQ ID NO: 62728 - DNA, 22 bp, Artificial Sequence
  chemically synthesized
tgtgaaactggtccccctctaa

SEQ ID NO: 62729 - DNA, 22 bp, Artificial Sequence
  chemically synthesized
gtccccctctaatactgtctat

SEQ ID NO: 62730 - DNA, 22 bp, Artificial Sequence
  chemically synthesized
taatactgtctatttttctcag

SEQ ID NO: 62731 - DNA, 22 bp, Artificial Sequence
  chemically synthesized
atactgtctatttttctcagtt

SEQ ID NO: 62732 - DNA, 22 bp, Artificial Sequence
  chemically synthesized
tctatttttctcagttctttct

SEQ ID NO: 62733 - DNA, 22 bp, Artificial Sequence
  chemically synthesized
tttttctcagttctttctgcag

SEQ ID NO: 62734 - DNA, 22 bp, Artificial Sequence
  chemically synthesized
ttctcagttctttctgcaggag

SEQ ID NO: 62735 - DNA, 22 bp, Artificial Sequence
  chemically synthesized
tctcagttctttctgcaggagt

SEQ ID NO: 62736 - DNA, 22 bp, Artificial Sequence
  chemically synthesized
ctcagttctttctgcaggagtt

SEQ ID NO: 62737 - DNA, 22 bp, Artificial Sequence
  chemically synthesized
tcagttctttctgcaggagtta

SEQ ID NO: 62738 - DNA, 22 bp, Artificial Sequence
  chemically synthesized
agttctttctgcaggagttagt

SEQ ID NO: 62739 - DNA, 22 bp, Artificial Sequence
  chemically synthesized
tttctgcaggagttagtaagtg

SEQ ID NO: 62740 - DNA, 22 bp, Artificial Sequence
  chemically synthesized
tctgcaggagttagtaagtgat

SEQ ID NO: 62741 - DNA, 22 bp, Artificial Sequence
  chemically synthesized
ctgcaggagttagtaagtgatg

SEQ ID NO: 62742 - DNA, 22 bp, Artificial Sequence
  chemically synthesized
tgcaggagttagtaagtgatga

SEQ ID NO: 62743 - DNA, 22 bp, Artificial Sequence
  chemically synthesized
caggagttagtaagtgatgaat

SEQ ID NO: 62744 - DNA, 22 bp, Artificial Sequence
  chemically synthesized
gtaagtgatgaatctagtccct

SEQ ID NO: 62745 - DNA, 22 bp, Artificial Sequence
  chemically synthesized
gtccctctgtcacacatttgaa

SEQ ID NO: 62746 - DNA, 22 bp, Artificial Sequence
  chemically synthesized
tgtcacacatttgaacacagtt

SEQ ID NO: 62747 - DNA, 22 bp, Artificial Sequence
  chemically synthesized
tcacacatttgaacacagttat

SEQ ID NO: 62748 - DNA, 22 bp, Artificial Sequence
  chemically synthesized
gaacacagttattctctctaac

SEQ ID NO: 62749 - DNA, 22 bp, Artificial Sequence
  chemically synthesized
aacacagttattctctctaacc

SEQ ID NO: 62750 - DNA, 22 bp, Artificial Sequence
  chemically synthesized
ttctctctaacctaaacattcc

SEQ ID NO: 62751 - DNA, 22 bp, Artificial Sequence
  chemically synthesized
tctctaacctaaacattcccag

SEQ ID NO: 62752 - DNA, 22 bp, Artificial Sequence
  chemically synthesized
tctaacctaaacattcccaggt

SEQ ID NO: 62753 - DNA, 22 bp, Artificial Sequence
  chemically synthesized
taacctaaacattcccaggttt

SEQ ID NO: 62754 - DNA, 22 bp, Artificial Sequence
  chemically synthesized
acctaaacattcccaggttttt

SEQ ID NO: 62755 - DNA, 22 bp, Artificial Sequence
  chemically synthesized
aacattcccaggtttttcatgt

SEQ ID NO: 62756 - DNA, 22 bp, Artificial Sequence
  chemically synthesized
ccaggtttttcatgtgatatgg

SEQ ID NO: 62757 - DNA, 22 bp, Artificial Sequence
  chemically synthesized
ttcatgtgatatggcttccagg

SEQ ID NO: 62758 - DNA, 22 bp, Artificial Sequence
  chemically synthesized
tcatgtgatatggcttccaggt

SEQ ID NO: 62759 - DNA, 22 bp, Artificial Sequence
  chemically synthesized
catgtgatatggcttccaggtt

SEQ ID NO: 62760 - DNA, 22 bp, Artificial Sequence
  chemically synthesized
atgtgatatggcttccaggttc

SEQ ID NO: 62761 - DNA, 22 bp, Artificial Sequence
  chemically synthesized
ccaggttcttcctcaaacatgg

SEQ ID NO: 62762 - DNA, 22 bp, Artificial Sequence
  chemically synthesized
caggttcttcctcaaacatgga

SEQ ID NO: 62763 - DNA, 22 bp, Artificial Sequence
  chemically synthesized
ttcctcaaacatggaacccagt

SEQ ID NO: 62764 - DNA, 22 bp, Artificial Sequence
  chemically synthesized
cctcaaacatggaacccagtac

SEQ ID NO: 62765 - DNA, 22 bp, Artificial Sequence
  chemically synthesized
ctcaaacatggaacccagtact

SEQ ID NO: 62766 - DNA, 22 bp, Artificial Sequence
  chemically synthesized
aaacatggaacccagtactaaa

SEQ ID NO: 62767 - DNA, 22 bp, Artificial Sequence
  chemically synthesized
aatgctgtgttacttttgtgat

SEQ ID NO: 62768 - DNA, 22 bp, Artificial Sequence
  chemically synthesized
tgttacttttgtgattaccatg

SEQ ID NO: 62769 - DNA, 22 bp, Artificial Sequence
  chemically synthesized
cttttgtgattaccatgaaacc

SEQ ID NO: 62770 - DNA, 22 bp, Artificial Sequence
  chemically synthesized
ttgtgattaccatgaaaccatt

SEQ ID NO: 62771 - DNA, 22 bp, Artificial Sequence
  chemically synthesized
tgtgattaccatgaaaccatta

SEQ ID NO: 62772 - DNA, 22 bp, Artificial Sequence
  chemically synthesized
gtgattaccatgaaaccattat

SEQ ID NO: 62773 - DNA, 22 bp, Artificial Sequence
  chemically synthesized
tgattaccatgaaaccattatc

SEQ ID NO: 62774 - DNA, 22 bp, Artificial Sequence
  chemically synthesized
ccatgaaaccattatctccctt

SEQ ID NO: 62775 - DNA, 22 bp, Artificial Sequence
  chemically synthesized
tctcccttgttctcaacattct

SEQ ID NO: 62776 - DNA, 22 bp, Artificial Sequence
  chemically synthesized
ccttgttctcaacattcttctt

SEQ ID NO: 62777 - DNA, 22 bp, Artificial Sequence
  chemically synthesized
gttctcaacattcttctttgaa

SEQ ID NO: 62778 - DNA, 22 bp, Artificial Sequence
  chemically synthesized
ttctcaacattcttctttgaat

SEQ ID NO: 62779 - DNA, 22 bp, Artificial Sequence
  chemically synthesized
tcaacattcttctttgaatgct

SEQ ID NO: 62780 - DNA, 22 bp, Artificial Sequence
  chemically synthesized
aacattcttctttgaatgctgc

SEQ ID NO: 62781 - DNA, 22 bp, Artificial Sequence
  chemically synthesized
ttctttgaatgctgctatgttc

SEQ ID NO: 62782 - DNA, 22 bp, Artificial Sequence
  chemically synthesized
ctttgaatgctgctatgttccg

SEQ ID NO: 62783 - DNA, 22 bp, Artificial Sequence
  chemically synthesized
tttgaatgctgctatgttccgt

SEQ ID NO: 62784 - DNA, 22 bp, Artificial Sequence
  chemically synthesized
tgaatgctgctatgttccgttc

SEQ ID NO: 62785 - DNA, 22 bp, Artificial Sequence
  chemically synthesized
gaatgctgctatgttccgttct

SEQ ID NO: 62786 - DNA, 22 bp, Artificial Sequence
  chemically synthesized
aatgctgctatgttccgttctt

SEQ ID NO: 62787 - DNA, 22 bp, Artificial Sequence
  chemically synthesized
ctatgttccgttcttacaaatc

SEQ ID NO: 62788 - DNA, 22 bp, Artificial Sequence
  chemically synthesized
tgttccgttcttacaaatctcc

SEQ ID NO: 62789 - DNA, 22 bp, Artificial Sequence
  chemically synthesized
cgttcttacaaatctccagggg

SEQ ID NO: 62790 - DNA, 22 bp, Artificial Sequence
  chemically synthesized
ttacaaatctccaggggagaaa

SEQ ID NO: 62791 - DNA, 22 bp, Artificial Sequence
  chemically synthesized
acaaatctccaggggagaaatt

SEQ ID NO: 62792 - DNA, 22 bp, Artificial Sequence
  chemically synthesized
caaatctccaggggagaaattc

SEQ ID NO: 62793 - DNA, 22 bp, Artificial Sequence
  chemically synthesized
caggggagaaattccacagttt

SEQ ID NO: 62794 - DNA, 22 bp, Artificial Sequence
  chemically synthesized
cacagttttgttaaggtcttat

SEQ ID NO: 62795 - DNA, 22 bp, Artificial Sequence
  chemically synthesized
tgttaaggtcttatattccagt

SEQ ID NO: 62796 - DNA, 22 bp, Artificial Sequence
  chemically synthesized
gttaaggtcttatattccagtg

SEQ ID NO: 62797 - DNA, 22 bp, Artificial Sequence
  chemically synthesized
ttaaggtcttatattccagtgc

SEQ ID NO: 62798 - DNA, 22 bp, Artificial Sequence
  chemically synthesized
aggtcttatattccagtgcctc

SEQ ID NO: 62799 - DNA, 22 bp, Artificial Sequence
  chemically synthesized
atattccagtgcctcccacaaa

SEQ ID NO: 62800 - DNA, 22 bp, Artificial Sequence
  chemically synthesized
tattccagtgcctcccacaaaa

SEQ ID NO: 62801 - DNA, 22 bp, Artificial Sequence
  chemically synthesized
cagtgcctcccacaaaatcttt

SEQ ID NO: 62802 - DNA, 22 bp, Artificial Sequence
  chemically synthesized
ccacaaaatctttcttatgctt

SEQ ID NO: 62803 - DNA, 22 bp, Artificial Sequence
  chemically synthesized
tcttatgcttaacttaaatctt

SEQ ID NO: 62804 - DNA, 22 bp, Artificial Sequence
  chemically synthesized
cttatgcttaacttaaatcttg

SEQ ID NO: 62805 - DNA, 22 bp, Artificial Sequence
  chemically synthesized
ttatgcttaacttaaatcttgt

SEQ ID NO: 62806 - DNA, 22 bp, Artificial Sequence
  chemically synthesized
atgcttaacttaaatcttgtct

SEQ ID NO: 62807 - DNA, 22 bp, Artificial Sequence
  chemically synthesized
tgcttaacttaaatcttgtctt

SEQ ID NO: 62808 - DNA, 22 bp, Artificial Sequence
  chemically synthesized
aacttaaatcttgtcttaccct

SEQ ID NO: 62809 - DNA, 22 bp, Artificial Sequence
  chemically synthesized
acttaaatcttgtcttaccctt

SEQ ID NO: 62810 - DNA, 22 bp, Artificial Sequence
  chemically synthesized
aaatcttgtcttacccttgtta

SEQ ID NO: 62811 - DNA, 22 bp, Artificial Sequence
  chemically synthesized
aatcttgtcttacccttgttaa

SEQ ID NO: 62812 - DNA, 22 bp, Artificial Sequence
  chemically synthesized
gtcttacccttgttaattggat

SEQ ID NO: 62813 - DNA, 22 bp, Artificial Sequence
  chemically synthesized
tcttacccttgttaattggatc

SEQ ID NO: 62814 - DNA, 22 bp, Artificial Sequence
  chemically synthesized
acccttgttaattggatctaag

SEQ ID NO: 62815 - DNA, 22 bp, Artificial Sequence
  chemically synthesized
cccttgttaattggatctaaga

SEQ ID NO: 62816 - DNA, 22 bp, Artificial Sequence
  chemically synthesized
gttaattggatctaagaaaaca

SEQ ID NO: 62817 - DNA, 22 bp, Artificial Sequence
  chemically synthesized
ttaattggatctaagaaaacac

SEQ ID NO: 62818 - DNA, 22 bp, Artificial Sequence
  chemically synthesized
attggatctaagaaaacacata

SEQ ID NO: 62819 - DNA, 22 bp, Artificial Sequence
  chemically synthesized
gatctaagaaaacacatattca

SEQ ID NO: 62820 - DNA, 22 bp, Artificial Sequence
  chemically synthesized
agaaaacacatattcaggcagg

SEQ ID NO: 62821 - DNA, 22 bp, Artificial Sequence
  chemically synthesized
aggcagggtgcggtggctcacc

SEQ ID NO: 62822 - DNA, 22 bp, Artificial Sequence
  chemically synthesized
acccttgtaatcccagcgcttt

SEQ ID NO: 62823 - DNA, 22 bp, Artificial Sequence
  chemically synthesized
gtaatcccagcgctttgggagg

SEQ ID NO: 62824 - DNA, 22 bp, Artificial Sequence
  chemically synthesized
taatcccagcgctttgggaggc

SEQ ID NO: 62825 - DNA, 22 bp, Artificial Sequence
  chemically synthesized
tgggaggccgaggcgggcggat

SEQ ID NO: 62826 - DNA, 22 bp, Artificial Sequence
  chemically synthesized
gggaggccgaggcgggcggatc

SEQ ID NO: 62827 - DNA, 22 bp, Artificial Sequence
  chemically synthesized
ggaggccgaggcgggcggatca

SEQ ID NO: 62828 - DNA, 22 bp, Artificial Sequence
  chemically synthesized
tgctaaaaatacaaaaaattag

SEQ ID NO: 62829 - DNA, 22 bp, Artificial Sequence
  chemically synthesized
ctaaaaatacaaaaaattagcc

SEQ ID NO: 62830 - DNA, 22 bp, Artificial Sequence
  chemically synthesized
aaaatacaaaaaattagccggg

SEQ ID NO: 62831 - DNA, 22 bp, Artificial Sequence
  chemically synthesized
gccgggcatggtggcgggcgcc

SEQ ID NO: 62832 - DNA, 22 bp, Artificial Sequence
  chemically synthesized
tagtcccagctactcggagagg

SEQ ID NO: 62833 - DNA, 22 bp, Artificial Sequence
  chemically synthesized
ctcggagaggctgaggcaggag

SEQ ID NO: 62834 - DNA, 22 bp, Artificial Sequence
  chemically synthesized
ggagaggctgaggcaggagaat

SEQ ID NO: 62835 - DNA, 22 bp, Artificial Sequence
  chemically synthesized
aggcaggagaatggcgtgaacc

SEQ ID NO: 62836 - DNA, 22 bp, Artificial Sequence
  chemically synthesized
gcagtgagccgagatcgcacca

SEQ ID NO: 62837 - DNA, 22 bp, Artificial Sequence
  chemically synthesized
cagtgagccgagatcgcaccac

SEQ ID NO: 62838 - DNA, 22 bp, Artificial Sequence
  chemically synthesized
cactctagcctgggtcacagag

SEQ ID NO: 62839 - DNA, 22 bp, Artificial Sequence
  chemically synthesized
tagcctgggtcacagagcgaga

SEQ ID NO: 62840 - DNA, 22 bp, Artificial Sequence
  chemically synthesized
gcctgggtcacagagcgagact

SEQ ID NO: 62841 - DNA, 22 bp, Artificial Sequence
  chemically synthesized
ggtcacagagcgagactccatc

SEQ ID NO: 62842 - DNA, 22 bp, Artificial Sequence
  chemically synthesized
catctcaaaaaaaaaaaacaaa

SEQ ID NO: 62843 - DNA, 22 bp, Artificial Sequence
  chemically synthesized
aaaaaaaaaaaacaaaaaaaaa

SEQ ID NO: 62844 - DNA, 22 bp, Artificial Sequence
  chemically synthesized
aaaactctgaacctataaaaga

SEQ ID NO: 62845 - DNA, 22 bp, Artificial Sequence
  chemically synthesized
tgaacctataaaagagatcaac

SEQ ID NO: 62846 - DNA, 22 bp, Artificial Sequence
  chemically synthesized
aacctataaaagagatcaactg

SEQ ID NO: 62847 - DNA, 22 bp, Artificial Sequence
  chemically synthesized
taaaagagatcaactgcagtta

SEQ ID NO: 62848 - DNA, 22 bp, Artificial Sequence
  chemically synthesized
cagttatctattaggtttgcaa

SEQ ID NO: 62849 - DNA, 22 bp, Artificial Sequence
  chemically synthesized
tctattaggtttgcaaatgaat

SEQ ID NO: 62850 - DNA, 22 bp, Artificial Sequence
  chemically synthesized
ttaggtttgcaaatgaatgtat

SEQ ID NO: 62851 - DNA, 22 bp, Artificial Sequence
  chemically synthesized
ggtttgcaaatgaatgtattta

SEQ ID NO: 62852 - DNA, 22 bp, Artificial Sequence
  chemically synthesized
gcaaatgaatgtatttaaatga

SEQ ID NO: 62853 - DNA, 22 bp, Artificial Sequence
  chemically synthesized
caaatgaatgtatttaaatgaa

SEQ ID NO: 62854 - DNA, 22 bp, Artificial Sequence
  chemically synthesized
aaatgaacagctttcctaggac

SEQ ID NO: 62855 - DNA, 22 bp, Artificial Sequence
  chemically synthesized
aatgaacagctttcctaggaca

SEQ ID NO: 62856 - DNA, 22 bp, Artificial Sequence
  chemically synthesized
tcctaggacatcgtgttaattt

SEQ ID NO: 62857 - DNA, 22 bp, Artificial Sequence
  chemically synthesized
cctaggacatcgtgttaatttg

SEQ ID NO: 62858 - DNA, 22 bp, Artificial Sequence
  chemically synthesized
ctaggacatcgtgttaatttgt

SEQ ID NO: 62859 - DNA, 22 bp, Artificial Sequence
  chemically synthesized
ggacatcgtgttaatttgttaa

SEQ ID NO: 62860 - DNA, 22 bp, Artificial Sequence
  chemically synthesized
atttgttaaatttggcagattc

SEQ ID NO: 62861 - DNA, 22 bp, Artificial Sequence
  chemically synthesized
gttaaatttggcagattccctg

SEQ ID NO: 62862 - DNA, 22 bp, Artificial Sequence
  chemically synthesized
ttaaatttggcagattccctga

SEQ ID NO: 62863 - DNA, 22 bp, Artificial Sequence
  chemically synthesized
aatttggcagattccctgaaaa

SEQ ID NO: 62864 - DNA, 22 bp, Artificial Sequence
  chemically synthesized
ggcagattccctgaaaagtaaa

SEQ ID NO: 62865 - DNA, 22 bp, Artificial Sequence
  chemically synthesized
gcagattccctgaaaagtaaat

SEQ ID NO: 62866 - DNA, 22 bp, Artificial Sequence
  chemically synthesized
cctgaaaagtaaattagggcct

SEQ ID NO: 62867 - DNA, 22 bp, Artificial Sequence
  chemically synthesized
aaaagtaaattagggcctgttg

SEQ ID NO: 62868 - DNA, 22 bp, Artificial Sequence
  chemically synthesized
gggcctgttgaagaccagtaag

SEQ ID NO: 62869 - DNA, 22 bp, Artificial Sequence
  chemically synthesized
ttgaagaccagtaagaaataaa

SEQ ID NO: 62870 - DNA, 22 bp, Artificial Sequence
  chemically synthesized
aagaccagtaagaaataaagat

SEQ ID NO: 62871 - DNA, 22 bp, Artificial Sequence
  chemically synthesized
taaaaagctctgagatttcaag

SEQ ID NO: 62872 - DNA, 22 bp, Artificial Sequence
  chemically synthesized
tgagatttcaagctaattcaat

SEQ ID NO: 62873 - DNA, 22 bp, Artificial Sequence
  chemically synthesized
agatttcaagctaattcaattt

SEQ ID NO: 62874 - DNA, 22 bp, Artificial Sequence
  chemically synthesized
caagctaattcaatttggtgcg

SEQ ID NO: 62875 - DNA, 22 bp, Artificial Sequence
  chemically synthesized
aagctaattcaatttggtgcgt

SEQ ID NO: 62876 - DNA, 22 bp, Artificial Sequence
  chemically synthesized
attcaatttggtgcgttaattt

SEQ ID NO: 62877 - DNA, 22 bp, Artificial Sequence
  chemically synthesized
aatttggtgcgttaatttgatg

SEQ ID NO: 62878 - DNA, 22 bp, Artificial Sequence
  chemically synthesized
ggtgcgttaatttgatgtatgg

SEQ ID NO: 62879 - DNA, 22 bp, Artificial Sequence
  chemically synthesized
gtgcgttaatttgatgtatggt

SEQ ID NO: 62880 - DNA, 22 bp, Artificial Sequence
  chemically synthesized
atttgatgtatggtaacttcta

SEQ ID NO: 62881 - DNA, 22 bp, Artificial Sequence
  chemically synthesized
gatgtatggtaacttctacaca

SEQ ID NO: 62882 - DNA, 22 bp, Artificial Sequence
  chemically synthesized
atgtatggtaacttctacacaa

SEQ ID NO: 62883 - DNA, 22 bp, Artificial Sequence
  chemically synthesized
ctacacaattcattctatagat

SEQ ID NO: 62884 - DNA, 22 bp, Artificial Sequence
  chemically synthesized
tacacaattcattctatagatc

SEQ ID NO: 62885 - DNA, 22 bp, Artificial Sequence
  chemically synthesized
cacaattcattctatagatctg

SEQ ID NO: 62886 - DNA, 22 bp, Artificial Sequence
  chemically synthesized
attctatagatctgggcactct

SEQ ID NO: 62887 - DNA, 22 bp, Artificial Sequence
  chemically synthesized
tatagatctgggcactcttata

SEQ ID NO: 62888 - DNA, 22 bp, Artificial Sequence
  chemically synthesized
tagatctgggcactcttataga

SEQ ID NO: 62889 - DNA, 22 bp, Artificial Sequence
  chemically synthesized
ggcactcttatagaaattaatc

SEQ ID NO: 62890 - DNA, 22 bp, Artificial Sequence
  chemically synthesized
ttatagaaattaatcatttcaa

SEQ ID NO: 62891 - DNA, 22 bp, Artificial Sequence
  chemically synthesized
atagaaattaatcatttcaagt

SEQ ID NO: 62892 - DNA, 22 bp, Artificial Sequence
  chemically synthesized
tagaaattaatcatttcaagtt

SEQ ID NO: 62893 - DNA, 22 bp, Artificial Sequence
  chemically synthesized
atcatttcaagttgctcattct

SEQ ID NO: 62894 - DNA, 22 bp, Artificial Sequence
  chemically synthesized
caagttgctcattcttgacttt

SEQ ID NO: 62895 - DNA, 22 bp, Artificial Sequence
  chemically synthesized
aagttgctcattcttgactttc

SEQ ID NO: 62896 - DNA, 22 bp, Artificial Sequence
  chemically synthesized
ctcattcttgactttcaaccca

SEQ ID NO: 62897 - DNA, 22 bp, Artificial Sequence
  chemically synthesized
attcttgactttcaacccacag

SEQ ID NO: 62898 - DNA, 22 bp, Artificial Sequence
  chemically synthesized
ttgactttcaacccacagaaat

SEQ ID NO: 62899 - DNA, 22 bp, Artificial Sequence
  chemically synthesized
gactttcaacccacagaaatgc

SEQ ID NO: 62900 - DNA, 22 bp, Artificial Sequence
  chemically synthesized
actttcaacccacagaaatgct

SEQ ID NO: 62901 - DNA, 22 bp, Artificial Sequence
  chemically synthesized
tcaacccacagaaatgctaaca

SEQ ID NO: 62902 - DNA, 22 bp, Artificial Sequence
  chemically synthesized
caacccacagaaatgctaacag

SEQ ID NO: 62903 - DNA, 22 bp, Artificial Sequence
  chemically synthesized
aacccacagaaatgctaacagt

SEQ ID NO: 62904 - DNA, 22 bp, Artificial Sequence
  chemically synthesized
acagtactgattacacacagga

SEQ ID NO: 62905 - DNA, 22 bp, Artificial Sequence
  chemically synthesized
attacacacaggatgtggctgg

SEQ ID NO: 62906 - DNA, 22 bp, Artificial Sequence
  chemically synthesized
cacacaggatgtggctggaatg

SEQ ID NO: 62907 - DNA, 22 bp, Artificial Sequence
  chemically synthesized
gaatgctgggattttgtcctga

SEQ ID NO: 62908 - DNA, 22 bp, Artificial Sequence
  chemically synthesized
ggattttgtcctgattagggag

SEQ ID NO: 62909 - DNA, 22 bp, Artificial Sequence
  chemically synthesized
tgtcctgattagggagagaaac

SEQ ID NO: 62910 - DNA, 22 bp, Artificial Sequence
  chemically synthesized
gtcctgattagggagagaaacg

SEQ ID NO: 62911 - DNA, 22 bp, Artificial Sequence
  chemically synthesized
tcctgattagggagagaaacgg

SEQ ID NO: 62912 - DNA, 22 bp, Artificial Sequence
  chemically synthesized
attagggagagaaacggaatgg

SEQ ID NO: 62913 - DNA, 22 bp, Artificial Sequence
  chemically synthesized
gggagagaaacggaatggggtt

SEQ ID NO: 62914 - DNA, 22 bp, Artificial Sequence
  chemically synthesized
gggggagaaggaagggagtcag

SEQ ID NO: 62915 - DNA, 22 bp, Artificial Sequence
  chemically synthesized
ggggagaaggaagggagtcaga

SEQ ID NO: 62916 - DNA, 22 bp, Artificial Sequence
  chemically synthesized
acaggactccagcaacaacttg

SEQ ID NO: 62917 - DNA, 22 bp, Artificial Sequence
  chemically synthesized
cagcaacaacttgatgaggaaa

SEQ ID NO: 62918 - DNA, 22 bp, Artificial Sequence
  chemically synthesized
gatgaggaaaatgagcagcaag

SEQ ID NO: 62919 - DNA, 22 bp, Artificial Sequence
  chemically synthesized
atgaggaaaatgagcagcaagg

SEQ ID NO: 62920 - DNA, 22 bp, Artificial Sequence
  chemically synthesized
gtgacagacagacattcagctg

SEQ ID NO: 62921 - DNA, 22 bp, Artificial Sequence
  chemically synthesized
agctgcacagcccagaatccca

SEQ ID NO: 62922 - DNA, 22 bp, Artificial Sequence
  chemically synthesized
cacagcccagaatcccaaccac

SEQ ID NO: 62923 - DNA, 22 bp, Artificial Sequence
  chemically synthesized
aagcacctgcaacagaagaggc

SEQ ID NO: 62924 - DNA, 22 bp, Artificial Sequence
  chemically synthesized
caacagaagaggcaaccataac

SEQ ID NO: 62925 - DNA, 22 bp, Artificial Sequence
  chemically synthesized
cagcaaagaaaacagcccctgc

SEQ ID NO: 62926 - DNA, 22 bp, Artificial Sequence
  chemically synthesized
agcaaagaaaacagcccctgca

SEQ ID NO: 62927 - DNA, 22 bp, Artificial Sequence
  chemically synthesized
cagaaatgttggagcctggcaa

SEQ ID NO: 62928 - DNA, 22 bp, Artificial Sequence
  chemically synthesized
gagcctggcaaacttaggtgct

SEQ ID NO: 62929 - DNA, 22 bp, Artificial Sequence
  chemically synthesized
gcaaacttaggtgctctcagtg

SEQ ID NO: 62930 - DNA, 22 bp, Artificial Sequence
  chemically synthesized
aggtgctctcagtggaattttt

SEQ ID NO: 62931 - DNA, 22 bp, Artificial Sequence
  chemically synthesized
ggtgctctcagtggaatttttg

SEQ ID NO: 62932 - DNA, 22 bp, Artificial Sequence
  chemically synthesized
tcagtggaatttttgtaaatta

SEQ ID NO: 62933 - DNA, 22 bp, Artificial Sequence
  chemically synthesized
agtggaatttttgtaaattaaa

SEQ ID NO: 62934 - DNA, 22 bp, Artificial Sequence
  chemically synthesized
ttgtaaattaaagccagtactc

SEQ ID NO: 62935 - DNA, 22 bp, Artificial Sequence
  chemically synthesized
tgtaaattaaagccagtactca

SEQ ID NO: 62936 - DNA, 22 bp, Artificial Sequence
  chemically synthesized
gtaaattaaagccagtactcaa

SEQ ID NO: 62937 - DNA, 22 bp, Artificial Sequence
  chemically synthesized
taaattaaagccagtactcaaa

SEQ ID NO: 62938 - DNA, 22 bp, Artificial Sequence
  chemically synthesized
aagccagtactcaaaagtccaa

SEQ ID NO: 62939 - DNA, 22 bp, Artificial Sequence
  chemically synthesized
aaaagtccaaagatgcctgttg

SEQ ID NO: 62940 - DNA, 22 bp, Artificial Sequence
  chemically synthesized
ttgggggctgggtgcagcggct

SEQ ID NO: 62941 - DNA, 22 bp, Artificial Sequence
  chemically synthesized
ggggctgggtgcagcggctcag

SEQ ID NO: 62942 - DNA, 22 bp, Artificial Sequence
  chemically synthesized
ggtgcagcggctcagacctgta

SEQ ID NO: 62943 - DNA, 22 bp, Artificial Sequence
  chemically synthesized
agacctgtaatcccaatacttt

SEQ ID NO: 62944 - DNA, 22 bp, Artificial Sequence
  chemically synthesized
taatcccaatactttgggaggc

SEQ ID NO: 62945 - DNA, 22 bp, Artificial Sequence
  chemically synthesized
tgggaggccgaggtgagaggat

SEQ ID NO: 62946 - DNA, 22 bp, Artificial Sequence
  chemically synthesized
gggaggccgaggtgagaggatc

SEQ ID NO: 62947 - DNA, 22 bp, Artificial Sequence
  chemically synthesized
ggaggccgaggtgagaggatca

SEQ ID NO: 62948 - DNA, 22 bp, Artificial Sequence
  chemically synthesized
gaggccaggagttcaagactag

SEQ ID NO: 62949 - DNA, 22 bp, Artificial Sequence
  chemically synthesized
aggccaggagttcaagactagt

SEQ ID NO: 62950 - DNA, 22 bp, Artificial Sequence
  chemically synthesized
aagactagtctgggcaacatag

SEQ ID NO: 62951 - DNA, 22 bp, Artificial Sequence
  chemically synthesized
gtctgggcaacatagcaagacc

SEQ ID NO: 62952 - DNA, 22 bp, Artificial Sequence
  chemically synthesized
ggcaacatagcaagacccctgt

SEQ ID NO: 62953 - DNA, 22 bp, Artificial Sequence
  chemically synthesized
tctctttaaaaaagatcaaaat

SEQ ID NO: 62954 - DNA, 22 bp, Artificial Sequence
  chemically synthesized
tttaaaaaagatcaaaattgac

SEQ ID NO: 62955 - DNA, 22 bp, Artificial Sequence
  chemically synthesized
taaaaaagatcaaaattgacca

SEQ ID NO: 62956 - DNA, 22 bp, Artificial Sequence
  chemically synthesized
aaaaaagatcaaaattgaccag

SEQ ID NO: 62957 - DNA, 22 bp, Artificial Sequence
  chemically synthesized
aaaaagatcaaaattgaccagg

SEQ ID NO: 62958 - DNA, 22 bp, Artificial Sequence
  chemically synthesized
accaggcacggtggcttatgct

SEQ ID NO: 62959 - DNA, 22 bp, Artificial Sequence
  chemically synthesized
atgcttgtaatcccagcacttt

SEQ ID NO: 62960 - DNA, 22 bp, Artificial Sequence
  chemically synthesized
tgcttgtaatcccagcactttg

SEQ ID NO: 62961 - DNA, 22 bp, Artificial Sequence
  chemically synthesized
gtaatcccagcactttgggagg

SEQ ID NO: 62962 - DNA, 22 bp, Artificial Sequence
  chemically synthesized
taatcccagcactttgggaggc

SEQ ID NO: 62963 - DNA, 22 bp, Artificial Sequence
  chemically synthesized
tgggaggccgaggtgggtggat

SEQ ID NO: 62964 - DNA, 22 bp, Artificial Sequence
  chemically synthesized
gggaggccgaggtgggtggatc

SEQ ID NO: 62965 - DNA, 22 bp, Artificial Sequence
  chemically synthesized
ggaggccgaggtgggtggatca

SEQ ID NO: 62966 - DNA, 22 bp, Artificial Sequence
  chemically synthesized
gaggtcaggagtttgagaccag

SEQ ID NO: 62967 - DNA, 22 bp, Artificial Sequence
  chemically synthesized
aggtcaggagtttgagaccagc

SEQ ID NO: 62968 - DNA, 22 bp, Artificial Sequence
  chemically synthesized
gagaccagcctgatcaacaggt

SEQ ID NO: 62969 - DNA, 22 bp, Artificial Sequence
  chemically synthesized
agaccagcctgatcaacaggtg

SEQ ID NO: 62970 - DNA, 22 bp, Artificial Sequence
  chemically synthesized
atcaacaggtgaaaccccatct

SEQ ID NO: 62971 - DNA, 22 bp, Artificial Sequence
  chemically synthesized
tactaaaaaaaaaattacaaaa

SEQ ID NO: 62972 - DNA, 22 bp, Artificial Sequence
  chemically synthesized
ctaaaaaaaaaattacaaaatt

SEQ ID NO: 62973 - DNA, 22 bp, Artificial Sequence
  chemically synthesized
aaaaaaaaattacaaaattagc

SEQ ID NO: 62974 - DNA, 22 bp, Artificial Sequence
  chemically synthesized
caaaattagccaggtggggtgg

SEQ ID NO: 62975 - DNA, 22 bp, Artificial Sequence
  chemically synthesized
gccaggtggggtggctcacgcc

SEQ ID NO: 62976 - DNA, 22 bp, Artificial Sequence
  chemically synthesized
acgcctgtaatcccagctattt

SEQ ID NO: 62977 - DNA, 22 bp, Artificial Sequence
  chemically synthesized
taatcccagctatttgagaggc

SEQ ID NO: 62978 - DNA, 22 bp, Artificial Sequence
  chemically synthesized
tttgagaggctgaggcaggaga

SEQ ID NO: 62979 - DNA, 22 bp, Artificial Sequence
  chemically synthesized
gagaggctgaggcaggagaatt

SEQ ID NO: 62980 - DNA, 22 bp, Artificial Sequence
  chemically synthesized
agaggctgaggcaggagaattg

SEQ ID NO: 62981 - DNA, 22 bp, Artificial Sequence
  chemically synthesized
aggcaggagaattgcttgaact

SEQ ID NO: 62982 - DNA, 22 bp, Artificial Sequence
  chemically synthesized
cttgaactcaggaggtggaggt

SEQ ID NO: 62983 - DNA, 22 bp, Artificial Sequence
  chemically synthesized
gaactcaggaggtggaggttac

SEQ ID NO: 62984 - DNA, 22 bp, Artificial Sequence
  chemically synthesized
aactcaggaggtggaggttaca

SEQ ID NO: 62985 - DNA, 22 bp, Artificial Sequence
  chemically synthesized
aggaggtggaggttacagtgag

SEQ ID NO: 62986 - DNA, 22 bp, Artificial Sequence
  chemically synthesized
cagtgagccgagactgcgccac

SEQ ID NO: 62987 - DNA, 22 bp, Artificial Sequence
  chemically synthesized
cgccactgcactctagcctggg

SEQ ID NO: 62988 - DNA, 22 bp, Artificial Sequence
  chemically synthesized
cactctagcctgggcaacaaga

SEQ ID NO: 62989 - DNA, 22 bp, Artificial Sequence
  chemically synthesized
tagcctgggcaacaagagcaaa

SEQ ID NO: 62990 - DNA, 22 bp, Artificial Sequence
  chemically synthesized
gcctgggcaacaagagcaaaac

SEQ ID NO: 62991 - DNA, 22 bp, Artificial Sequence
  chemically synthesized
ggcaacaagagcaaaactccgt

SEQ ID NO: 62992 - DNA, 22 bp, Artificial Sequence
  chemically synthesized
cgtctcaaaaaaaaaaaaaaaa

SEQ ID NO: 62993 - DNA, 22 bp, Artificial Sequence
  chemically synthesized
aaaaaaaaaaaaaaaaggccag

SEQ ID NO: 62994 - DNA, 22 bp, Artificial Sequence
  chemically synthesized
atgcctgcaatcccagcacttt

SEQ ID NO: 62995 - DNA, 22 bp, Artificial Sequence
  chemically synthesized
caatcccagcactttgggaggc

SEQ ID NO: 62996 - DNA, 22 bp, Artificial Sequence
  chemically synthesized
tgggaggctgaggcggatggat

SEQ ID NO: 62997 - DNA, 22 bp, Artificial Sequence
  chemically synthesized
gggaggctgaggcggatggatc

SEQ ID NO: 62998 - DNA, 22 bp, Artificial Sequence
  chemically synthesized
ggaggctgaggcggatggatca

SEQ ID NO: 62999 - DNA, 22 bp, Artificial Sequence
  chemically synthesized
aggcggatggatcactaggtca

SEQ ID NO: 63000 - DNA, 22 bp, Artificial Sequence
  chemically synthesized
ggtcaggagttcaagaccagcc

SEQ ID NO: 63001 - DNA, 22 bp, Artificial Sequence
  chemically synthesized
aagaccagcctggccaatatgg

SEQ ID NO: 63002 - DNA, 22 bp, Artificial Sequence
  chemically synthesized
gccaatatggtgaaaccccatc

SEQ ID NO: 63003 - DNA, 22 bp, Artificial Sequence
  chemically synthesized
tactaaaaataaaaaaattagc

SEQ ID NO: 63004 - DNA, 22 bp, Artificial Sequence
  chemically synthesized
ctaaaaataaaaaaattagcca

SEQ ID NO: 63005 - DNA, 22 bp, Artificial Sequence
  chemically synthesized
aaaataaaaaaattagccaggt

SEQ ID NO: 63006 - DNA, 22 bp, Artificial Sequence
  chemically synthesized
gccaggtgtggtggcacgtgcc

SEQ ID NO: 63007 - DNA, 22 bp, Artificial Sequence
  chemically synthesized
tagtcccagctactcggtaggc

SEQ ID NO: 63008 - DNA, 22 bp, Artificial Sequence
  chemically synthesized
ctcggtaggctgaggcagaaga

SEQ ID NO: 63009 - DNA, 22 bp, Artificial Sequence
  chemically synthesized
ggtaggctgaggcagaagaata

SEQ ID NO: 63010 - DNA, 22 bp, Artificial Sequence
  chemically synthesized
aggcagaagaatagcttgaacc

SEQ ID NO: 63011 - DNA, 22 bp, Artificial Sequence
  chemically synthesized
gaacccaggaagcggaggttgc

SEQ ID NO: 63012 - DNA, 22 bp, Artificial Sequence
  chemically synthesized
aacccaggaagcggaggttgca

SEQ ID NO: 63013 - DNA, 22 bp, Artificial Sequence
  chemically synthesized
cagtgaggcgagatggcgccac

SEQ ID NO: 63014 - DNA, 22 bp, Artificial Sequence
  chemically synthesized
cactccagcctgggcaacagag

SEQ ID NO: 63015 - DNA, 22 bp, Artificial Sequence
  chemically synthesized
cagcctgggcaacagagcgaga

SEQ ID NO: 63016 - DNA, 22 bp, Artificial Sequence
  chemically synthesized
ggcaacagagcgagattccgtc

SEQ ID NO: 63017 - DNA, 22 bp, Artificial Sequence
  chemically synthesized
cgtctcaaaaaaaaaaaaaaaa

SEQ ID NO: 63018 - DNA, 22 bp, Artificial Sequence
  chemically synthesized
aaaaaaaaaaaaaaaatgcctg

SEQ ID NO: 63019 - DNA, 22 bp, Artificial Sequence
  chemically synthesized
tggcaagtggttaacccttgtg

SEQ ID NO: 63020 - DNA, 22 bp, Artificial Sequence
  chemically synthesized
acccttgtgtatatgaatttta

SEQ ID NO: 63021 - DNA, 22 bp, Artificial Sequence
  chemically synthesized
gtgtatatgaattttaacttcc

SEQ ID NO: 63022 - DNA, 22 bp, Artificial Sequence
  chemically synthesized
tgtatatgaattttaacttccc

SEQ ID NO: 63023 - DNA, 22 bp, Artificial Sequence
  chemically synthesized
taacttccctattttatctgtt

SEQ ID NO: 63024 - DNA, 22 bp, Artificial Sequence
  chemically synthesized
aacttccctattttatctgttt

SEQ ID NO: 63025 - DNA, 22 bp, Artificial Sequence
  chemically synthesized
acttccctattttatctgtttg

SEQ ID NO: 63026 - DNA, 22 bp, Artificial Sequence
  chemically synthesized
ccctattttatctgtttgataa

SEQ ID NO: 63027 - DNA, 22 bp, Artificial Sequence
  chemically synthesized
cctattttatctgtttgataat

SEQ ID NO: 63028 - DNA, 22 bp, Artificial Sequence
  chemically synthesized
ttttatctgtttgataattaag

SEQ ID NO: 63029 - DNA, 22 bp, Artificial Sequence
  chemically synthesized
tatctgtttgataattaaggat

SEQ ID NO: 63030 - DNA, 22 bp, Artificial Sequence
  chemically synthesized
atctgtttgataattaaggatt

SEQ ID NO: 63031 - DNA, 22 bp, Artificial Sequence
  chemically synthesized
tctgtttgataattaaggattt

SEQ ID NO: 63032 - DNA, 22 bp, Artificial Sequence
  chemically synthesized
tttgataattaaggatttgcat

SEQ ID NO: 63033 - DNA, 22 bp, Artificial Sequence
  chemically synthesized
gataattaaggatttgcatggc

SEQ ID NO: 63034 - DNA, 22 bp, Artificial Sequence
  chemically synthesized
ataattaaggatttgcatggct

SEQ ID NO: 63035 - DNA, 22 bp, Artificial Sequence
  chemically synthesized
aggatttgcatggctggcgcgg

SEQ ID NO: 63036 - DNA, 22 bp, Artificial Sequence
  chemically synthesized
gcatggctggcgcggtggctca

SEQ ID NO: 63037 - DNA, 22 bp, Artificial Sequence
  chemically synthesized
catggctggcgcggtggctcat

SEQ ID NO: 63038 - DNA, 22 bp, Artificial Sequence
  chemically synthesized
gcgcggtggctcatgcctgtaa

SEQ ID NO: 63039 - DNA, 22 bp, Artificial Sequence
  chemically synthesized
atgcctgtaatcccaatatttt

SEQ ID NO: 63040 - DNA, 22 bp, Artificial Sequence
  chemically synthesized
taatcccaatattttaggaggc

SEQ ID NO: 63041 - DNA, 22 bp, Artificial Sequence
  chemically synthesized
taggaggctgaggcaagccaat

SEQ ID NO: 63042 - DNA, 22 bp, Artificial Sequence
  chemically synthesized
aggaggctgaggcaagccaatt

SEQ ID NO: 63043 - DNA, 22 bp, Artificial Sequence
  chemically synthesized
ggaggctgaggcaagccaattg

SEQ ID NO: 63044 - DNA, 22 bp, Artificial Sequence
  chemically synthesized
aggcaagccaattgcttgagat

SEQ ID NO: 63045 - DNA, 22 bp, Artificial Sequence
  chemically synthesized
cttgagatcaagaccagcctga

SEQ ID NO: 63046 - DNA, 22 bp, Artificial Sequence
  chemically synthesized
gagatcaagaccagcctgagcc

SEQ ID NO: 63047 - DNA, 22 bp, Artificial Sequence
  chemically synthesized
agatcaagaccagcctgagcct

SEQ ID NO: 63048 - DNA, 22 bp, Artificial Sequence
  chemically synthesized
agcctgggcaacatagcagaac

SEQ ID NO: 63049 - DNA, 22 bp, Artificial Sequence
  chemically synthesized
ggcaacatagcagaactctgtc

SEQ ID NO: 63050 - DNA, 22 bp, Artificial Sequence
  chemically synthesized
tgtctctacaaaaagatacgag

SEQ ID NO: 63051 - DNA, 22 bp, Artificial Sequence
  chemically synthesized
tctctacaaaaagatacgagaa

SEQ ID NO: 63052 - DNA, 22 bp, Artificial Sequence
  chemically synthesized
tacaaaaagatacgagaaatta

SEQ ID NO: 63053 - DNA, 22 bp, Artificial Sequence
  chemically synthesized
caaaaagatacgagaaattagc

SEQ ID NO: 63054 - DNA, 22 bp, Artificial Sequence
  chemically synthesized
gctgggtgtggtgtgtggcctg

SEQ ID NO: 63055 - DNA, 22 bp, Artificial Sequence
  chemically synthesized
ggtgtggtgtgtggcctgtggt

SEQ ID NO: 63056 - DNA, 22 bp, Artificial Sequence
  chemically synthesized
tggtcccagctactcagatggc

SEQ ID NO: 63057 - DNA, 22 bp, Artificial Sequence
  chemically synthesized
ctcagatggctgaggtgggagg

SEQ ID NO: 63058 - DNA, 22 bp, Artificial Sequence
  chemically synthesized
agatggctgaggtgggaggatc

SEQ ID NO: 63059 - DNA, 22 bp, Artificial Sequence
  chemically synthesized
aggtgggaggatcgcttgagcc

SEQ ID NO: 63060 - DNA, 22 bp, Artificial Sequence
  chemically synthesized
gagcctgggaggcagaggttgc

SEQ ID NO: 63061 - DNA, 22 bp, Artificial Sequence
  chemically synthesized
agcctgggaggcagaggttgca

SEQ ID NO: 63062 - DNA, 22 bp, Artificial Sequence
  chemically synthesized
ggaggcagaggttgcagcgaga

SEQ ID NO: 63063 - DNA, 22 bp, Artificial Sequence
  chemically synthesized
cagcgagacatgatcgtgccac

SEQ ID NO: 63064 - DNA, 22 bp, Artificial Sequence
  chemically synthesized
cacttcagcctggatgacagag

SEQ ID NO: 63065 - DNA, 22 bp, Artificial Sequence
  chemically synthesized
cagcctggatgacagagcgaga

SEQ ID NO: 63066 - DNA, 22 bp, Artificial Sequence
  chemically synthesized
agcctggatgacagagcgagac

SEQ ID NO: 63067 - DNA, 22 bp, Artificial Sequence
  chemically synthesized
gatgacagagcgagactgcatc

SEQ ID NO: 63068 - DNA, 22 bp, Artificial Sequence
  chemically synthesized
catctcaaaaataaaaataaaa

SEQ ID NO: 63069 - DNA, 22 bp, Artificial Sequence
  chemically synthesized
aaaaataaaaataaaaaggatt

SEQ ID NO: 63070 - DNA, 22 bp, Artificial Sequence
  chemically synthesized
gcactgtggctgcacacccgga

SEQ ID NO: 63071 - DNA, 22 bp, Artificial Sequence
  chemically synthesized
cactgtggctgcacacccggaa

SEQ ID NO: 63072 - DNA, 22 bp, Artificial Sequence
  chemically synthesized
tggctgcacacccggaattctc

SEQ ID NO: 63073 - DNA, 22 bp, Artificial Sequence
  chemically synthesized
cacacccggaattctctgtagt

SEQ ID NO: 63074 - DNA, 22 bp, Artificial Sequence
  chemically synthesized
tctgtagtaggaatatcttctg

SEQ ID NO: 63075 - DNA, 22 bp, Artificial Sequence
  chemically synthesized
tgtagtaggaatatcttctgtt

SEQ ID NO: 63076 - DNA, 22 bp, Artificial Sequence
  chemically synthesized
tagtaggaatatcttctgtttc

SEQ ID NO: 63077 - DNA, 22 bp, Artificial Sequence
  chemically synthesized
ctgtttctctggttattttaac

SEQ ID NO: 63078 - DNA, 22 bp, Artificial Sequence
  chemically synthesized
tgtttctctggttattttaacc

SEQ ID NO: 63079 - DNA, 22 bp, Artificial Sequence
  chemically synthesized
tttctctggttattttaacctg

SEQ ID NO: 63080 - DNA, 22 bp, Artificial Sequence
  chemically synthesized
ctctggttattttaacctggat

SEQ ID NO: 63081 - DNA, 22 bp, Artificial Sequence
  chemically synthesized
tctggttattttaacctggatg

SEQ ID NO: 63082 - DNA, 22 bp, Artificial Sequence
  chemically synthesized
tggttattttaacctggatggg

SEQ ID NO: 63083 - DNA, 22 bp, Artificial Sequence
  chemically synthesized
gttattttaacctggatgggtg

SEQ ID NO: 63084 - DNA, 22 bp, Artificial Sequence
  chemically synthesized
ttttaacctggatgggtgactc

SEQ ID NO: 63085 - DNA, 22 bp, Artificial Sequence
  chemically synthesized
taacctggatgggtgactctgt

SEQ ID NO: 63086 - DNA, 22 bp, Artificial Sequence
  chemically synthesized
aacctggatgggtgactctgtg

SEQ ID NO: 63087 - DNA, 22 bp, Artificial Sequence
  chemically synthesized
acctggatgggtgactctgtgg

SEQ ID NO: 63088 - DNA, 22 bp, Artificial Sequence
  chemically synthesized
gatgggtgactctgtggttggt

SEQ ID NO: 63089 - DNA, 22 bp, Artificial Sequence
  chemically synthesized
tgtggttggtacagacatgggt

SEQ ID NO: 63090 - DNA, 22 bp, Artificial Sequence
  chemically synthesized
tggttggtacagacatgggttt

SEQ ID NO: 63091 - DNA, 22 bp, Artificial Sequence
  chemically synthesized
gtacagacatgggtttttattt

SEQ ID NO: 63092 - DNA, 22 bp, Artificial Sequence
  chemically synthesized
ttatttaagccctgctgctact

SEQ ID NO: 63093 - DNA, 22 bp, Artificial Sequence
  chemically synthesized
tatttaagccctgctgctactt

SEQ ID NO: 63094 - DNA, 22 bp, Artificial Sequence
  chemically synthesized
atttaagccctgctgctacttc

SEQ ID NO: 63095 - DNA, 22 bp, Artificial Sequence
  chemically synthesized
tttaagccctgctgctacttca

SEQ ID NO: 63096 - DNA, 22 bp, Artificial Sequence
  chemically synthesized
aagccctgctgctacttcacta

SEQ ID NO: 63097 - DNA, 22 bp, Artificial Sequence
  chemically synthesized
agccctgctgctacttcactac

SEQ ID NO: 63098 - DNA, 22 bp, Artificial Sequence
  chemically synthesized
ctgctacttcactaccttattt

SEQ ID NO: 63099 - DNA, 22 bp, Artificial Sequence
  chemically synthesized
ctacttcactaccttattttta

SEQ ID NO: 63100 - DNA, 22 bp, Artificial Sequence
  chemically synthesized
cttcactaccttatttttataa

SEQ ID NO: 63101 - DNA, 22 bp, Artificial Sequence
  chemically synthesized
cactaccttatttttataagtc

SEQ ID NO: 63102 - DNA, 22 bp, Artificial Sequence
  chemically synthesized
actaccttatttttataagtcc

SEQ ID NO: 63103 - DNA, 22 bp, Artificial Sequence
  chemically synthesized
ccttatttttataagtcccttc

SEQ ID NO: 63104 - DNA, 22 bp, Artificial Sequence
  chemically synthesized
atttttataagtcccttcatgg

SEQ ID NO: 63105 - DNA, 22 bp, Artificial Sequence
  chemically synthesized
tttttataagtcccttcatggt

SEQ ID NO: 63106 - DNA, 22 bp, Artificial Sequence
  chemically synthesized
ttataagtcccttcatggtgtt

SEQ ID NO: 63107 - DNA, 22 bp, Artificial Sequence
  chemically synthesized
tataagtcccttcatggtgttg

SEQ ID NO: 63108 - DNA, 22 bp, Artificial Sequence
  chemically synthesized
ataagtcccttcatggtgttgg

SEQ ID NO: 63109 - DNA, 22 bp, Artificial Sequence
  chemically synthesized
taagtcccttcatggtgttggg

SEQ ID NO: 63110 - DNA, 22 bp, Artificial Sequence
  chemically synthesized
catggtgttgggctttgtttcc

SEQ ID NO: 63111 - DNA, 22 bp, Artificial Sequence
  chemically synthesized
atggtgttgggctttgtttcct

SEQ ID NO: 63112 - DNA, 22 bp, Artificial Sequence
  chemically synthesized
ggctttgtttccttatctgtaa

SEQ ID NO: 63113 - DNA, 22 bp, Artificial Sequence
  chemically synthesized
tgtttccttatctgtaaaacaa

SEQ ID NO: 63114 - DNA, 22 bp, Artificial Sequence
  chemically synthesized
gtttccttatctgtaaaacaac

SEQ ID NO: 63115 - DNA, 22 bp, Artificial Sequence
  chemically synthesized
tttccttatctgtaaaacaacg

SEQ ID NO: 63116 - DNA, 22 bp, Artificial Sequence
  chemically synthesized
ccttatctgtaaaacaacggat

SEQ ID NO: 63117 - DNA, 22 bp, Artificial Sequence
  chemically synthesized
cttatctgtaaaacaacggatt

SEQ ID NO: 63118 - DNA, 22 bp, Artificial Sequence
  chemically synthesized
atctgtaaaacaacggattgca

SEQ ID NO: 63119 - DNA, 22 bp, Artificial Sequence
  chemically synthesized
tctgtaaaacaacggattgcac

SEQ ID NO: 63120 - DNA, 22 bp, Artificial Sequence
  chemically synthesized
taaaacaacggattgcactact

SEQ ID NO: 63121 - DNA, 22 bp, Artificial Sequence
  chemically synthesized
cactactggatccctttcagcc

SEQ ID NO: 63122 - DNA, 22 bp, Artificial Sequence
  chemically synthesized
ctggatccctttcagcccaaac

SEQ ID NO: 63123 - DNA, 22 bp, Artificial Sequence
  chemically synthesized
gatccctttcagcccaaacatt

SEQ ID NO: 63124 - DNA, 22 bp, Artificial Sequence
  chemically synthesized
tcagcccaaacattccctgact

SEQ ID NO: 63125 - DNA, 22 bp, Artificial Sequence
  chemically synthesized
cagcccaaacattccctgactc

SEQ ID NO: 63126 - DNA, 22 bp, Artificial Sequence
  chemically synthesized
agcccaaacattccctgactct

SEQ ID NO: 63127 - DNA, 22 bp, Artificial Sequence
  chemically synthesized
cctgactctgaggtttatccct

SEQ ID NO: 63128 - DNA, 22 bp, Artificial Sequence
  chemically synthesized
actctgaggtttatccctatcc

SEQ ID NO: 63129 - DNA, 22 bp, Artificial Sequence
  chemically synthesized
tgaggtttatccctatccaaag

SEQ ID NO: 63130 - DNA, 22 bp, Artificial Sequence
  chemically synthesized
aggtttatccctatccaaagtg

SEQ ID NO: 63131 - DNA, 22 bp, Artificial Sequence
  chemically synthesized
atccctatccaaagtgccacaa

SEQ ID NO: 63132 - DNA, 22 bp, Artificial Sequence
  chemically synthesized
tccctatccaaagtgccacaac

SEQ ID NO: 63133 - DNA, 22 bp, Artificial Sequence
  chemically synthesized
tccaaagtgccacaactcttaa

SEQ ID NO: 63134 - DNA, 22 bp, Artificial Sequence
  chemically synthesized
ttaatcagcggctgcccaggtg

SEQ ID NO: 63135 - DNA, 22 bp, Artificial Sequence
  chemically synthesized
aatcagcggctgcccaggtgtg

SEQ ID NO: 63136 - DNA, 22 bp, Artificial Sequence
  chemically synthesized
atcagcggctgcccaggtgtgg

SEQ ID NO: 63137 - DNA, 22 bp, Artificial Sequence
  chemically synthesized
cccaggtgtgggagcgggctag

SEQ ID NO: 63138 - DNA, 22 bp, Artificial Sequence
  chemically synthesized
gggggatgtgaggaagaatacg

SEQ ID NO: 63139 - DNA, 22 bp, Artificial Sequence
  chemically synthesized
cagagagagctgcctcctgccc

SEQ ID NO: 63140 - DNA, 22 bp, Artificial Sequence
  chemically synthesized
cctcctgccctccaccacctac

SEQ ID NO: 63141 - DNA, 22 bp, Artificial Sequence
  chemically synthesized
ctgccctccaccacctacaccc

SEQ ID NO: 63142 - DNA, 22 bp, Artificial Sequence
  chemically synthesized
ccctccaccacctacaccccag

SEQ ID NO: 63143 - DNA, 22 bp, Artificial Sequence
  chemically synthesized
caccacctacaccccagtggtg

SEQ ID NO: 63144 - DNA, 22 bp, Artificial Sequence
  chemically synthesized
caccccagtggtgagttcttac

SEQ ID NO: 63145 - DNA, 22 bp, Artificial Sequence
  chemically synthesized
ttaccgaaatctgtaggtcggc

SEQ ID NO: 63146 - DNA, 22 bp, Artificial Sequence
  chemically synthesized
accgaaatctgtaggtcggctt

SEQ ID NO: 63147 - DNA, 22 bp, Artificial Sequence
  chemically synthesized
ccgaaatctgtaggtcggcttt

SEQ ID NO: 63148 - DNA, 22 bp, Artificial Sequence
  chemically synthesized
taggtcggctttatctttccct

SEQ ID NO: 63149 - DNA, 22 bp, Artificial Sequence
  chemically synthesized
tatctttccctgaaagatggaa

SEQ ID NO: 63150 - DNA, 22 bp, Artificial Sequence
  chemically synthesized
atctttccctgaaagatggaaa

SEQ ID NO: 63151 - DNA, 22 bp, Artificial Sequence
  chemically synthesized
tctttccctgaaagatggaaag

SEQ ID NO: 63152 - DNA, 22 bp, Artificial Sequence
  chemically synthesized
tccctgaaagatggaaagagta

SEQ ID NO: 63153 - DNA, 22 bp, Artificial Sequence
  chemically synthesized
ccctgaaagatggaaagagtag

SEQ ID NO: 63154 - DNA, 22 bp, Artificial Sequence
  chemically synthesized
cctgaaagatggaaagagtaga

SEQ ID NO: 63155 - DNA, 22 bp, Artificial Sequence
  chemically synthesized
aaagatggaaagagtagatgtg

SEQ ID NO: 63156 - DNA, 22 bp, Artificial Sequence
  chemically synthesized
ctgtgcccatggcatggccaga

SEQ ID NO: 63157 - DNA, 22 bp, Artificial Sequence
  chemically synthesized
tgcccatggcatggccagaggg

SEQ ID NO: 63158 - DNA, 22 bp, Artificial Sequence
  chemically synthesized
cctaaagggcaggaaagagaat

SEQ ID NO: 63159 - DNA, 22 bp, Artificial Sequence
  chemically synthesized
aagggcaggaaagagaatggag

SEQ ID NO: 63160 - DNA, 22 bp, Artificial Sequence
  chemically synthesized
atctgggagacagtgcatcatc

SEQ ID NO: 63161 - DNA, 22 bp, Artificial Sequence
  chemically synthesized
ggagacagtgcatcatctaccc

SEQ ID NO: 63162 - DNA, 22 bp, Artificial Sequence
  chemically synthesized
cccagccacccagccatccccc

SEQ ID NO: 63163 - DNA, 22 bp, Artificial Sequence
  chemically synthesized
tccacccatctacccattcatc

SEQ ID NO: 63164 - DNA, 22 bp, Artificial Sequence
  chemically synthesized
cccattcatccatccattcacc

SEQ ID NO: 63165 - DNA, 22 bp, Artificial Sequence
  chemically synthesized
atccatccattcaccccccatc

SEQ ID NO: 63166 - DNA, 22 bp, Artificial Sequence
  chemically synthesized
accccccatccatccgttcacc

SEQ ID NO: 63167 - DNA, 22 bp, Artificial Sequence
  chemically synthesized
accccccatccatccacccatc

SEQ ID NO: 63168 - DNA, 22 bp, Artificial Sequence
  chemically synthesized
accatccattcgttatccataa

SEQ ID NO: 63169 - DNA, 22 bp, Artificial Sequence
  chemically synthesized
ccatccattcgttatccataat

SEQ ID NO: 63170 - DNA, 22 bp, Artificial Sequence
  chemically synthesized
gttatccataattcatttattt

SEQ ID NO: 63171 - DNA, 22 bp, Artificial Sequence
  chemically synthesized
tccataattcatttatttaaca

SEQ ID NO: 63172 - DNA, 22 bp, Artificial Sequence
  chemically synthesized
atttatttaacaaatttccatc

SEQ ID NO: 63173 - DNA, 22 bp, Artificial Sequence
  chemically synthesized
atttaacaaatttccatctcct

SEQ ID NO: 63174 - DNA, 22 bp, Artificial Sequence
  chemically synthesized
tttaacaaatttccatctccta

SEQ ID NO: 63175 - DNA, 22 bp, Artificial Sequence
  chemically synthesized
aacaaatttccatctcctatgc

SEQ ID NO: 63176 - DNA, 22 bp, Artificial Sequence
  chemically synthesized
acaaatttccatctcctatgca

SEQ ID NO: 63177 - DNA, 22 bp, Artificial Sequence
  chemically synthesized
ccatctcctatgcaccaagcat

SEQ ID NO: 63178 - DNA, 22 bp, Artificial Sequence
  chemically synthesized
catctcctatgcaccaagcatt

SEQ ID NO: 63179 - DNA, 22 bp, Artificial Sequence
  chemically synthesized
ctatgcaccaagcattgtgcaa

SEQ ID NO: 63180 - DNA, 22 bp, Artificial Sequence
  chemically synthesized
tgcaccaagcattgtgcaaggc

SEQ ID NO: 63181 - DNA, 22 bp, Artificial Sequence
  chemically synthesized
tgcaaggctctgggaatacaat

SEQ ID NO: 63182 - DNA, 22 bp, Artificial Sequence
  chemically synthesized
tgggaatacaatgatgagcaaa

SEQ ID NO: 63183 - DNA, 22 bp, Artificial Sequence
  chemically synthesized
ggaatacaatgatgagcaaagc

SEQ ID NO: 63184 - DNA, 22 bp, Artificial Sequence
  chemically synthesized
ctcttgcagtttaatacagtct

SEQ ID NO: 63185 - DNA, 22 bp, Artificial Sequence
  chemically synthesized
ttgcagtttaatacagtctgga

SEQ ID NO: 63186 - DNA, 22 bp, Artificial Sequence
  chemically synthesized
gcagtttaatacagtctggaga

SEQ ID NO: 63187 - DNA, 22 bp, Artificial Sequence
  chemically synthesized
cagtttaatacagtctggagat

SEQ ID NO: 63188 - DNA, 22 bp, Artificial Sequence
  chemically synthesized
aatacagtctggagattacaca

SEQ ID NO: 63189 - DNA, 22 bp, Artificial Sequence
  chemically synthesized
atacagtctggagattacacaa

SEQ ID NO: 63190 - DNA, 22 bp, Artificial Sequence
  chemically synthesized
gagattacacaaagaatcagca

SEQ ID NO: 63191 - DNA, 22 bp, Artificial Sequence
  chemically synthesized
cacaaagaatcagcatactggg

SEQ ID NO: 63192 - DNA, 22 bp, Artificial Sequence
  chemically synthesized
ggcgtacaattacaaactgatc

SEQ ID NO: 63193 - DNA, 22 bp, Artificial Sequence
  chemically synthesized
caaactgatctgccctccacat

SEQ ID NO: 63194 - DNA, 22 bp, Artificial Sequence
  chemically synthesized
atctgccctccacatcttctgt

SEQ ID NO: 63195 - DNA, 22 bp, Artificial Sequence
  chemically synthesized
ccctccacatcttctgttcctt

SEQ ID NO: 63196 - DNA, 22 bp, Artificial Sequence
  chemically synthesized
cacatcttctgttccttctctc

SEQ ID NO: 63197 - DNA, 22 bp, Artificial Sequence
  chemically synthesized
ctgttccttctctccttgcaca

SEQ ID NO: 63198 - DNA, 22 bp, Artificial Sequence
  chemically synthesized
tgttccttctctccttgcacac

SEQ ID NO: 63199 - DNA, 22 bp, Artificial Sequence
  chemically synthesized
ttccttctctccttgcacactc

SEQ ID NO: 63200 - DNA, 22 bp, Artificial Sequence
  chemically synthesized
cttctctccttgcacactctgt

SEQ ID NO: 63201 - DNA, 22 bp, Artificial Sequence
  chemically synthesized
ctctccttgcacactctgttct

SEQ ID NO: 63202 - DNA, 22 bp, Artificial Sequence
  chemically synthesized
tctccttgcacactctgttctg

SEQ ID NO: 63203 - DNA, 22 bp, Artificial Sequence
  chemically synthesized
tccttgcacactctgttctggc

SEQ ID NO: 63204 - DNA, 22 bp, Artificial Sequence
  chemically synthesized
cttgcacactctgttctggcta

SEQ ID NO: 63205 - DNA, 22 bp, Artificial Sequence
  chemically synthesized
gcacactctgttctggctacac

SEQ ID NO: 63206 - DNA, 22 bp, Artificial Sequence
  chemically synthesized
cacactctgttctggctacact

SEQ ID NO: 63207 - DNA, 22 bp, Artificial Sequence
  chemically synthesized
tgttctggctacactggcctca

SEQ ID NO: 63208 - DNA, 22 bp, Artificial Sequence
  chemically synthesized
ttctggctacactggcctcatt

SEQ ID NO: 63209 - DNA, 22 bp, Artificial Sequence
  chemically synthesized
tggctacactggcctcattgct

SEQ ID NO: 63210 - DNA, 22 bp, Artificial Sequence
  chemically synthesized
gctacactggcctcattgcttt

SEQ ID NO: 63211 - DNA, 22 bp, Artificial Sequence
  chemically synthesized
cactggcctcattgctttcctt

SEQ ID NO: 63212 - DNA, 22 bp, Artificial Sequence
  chemically synthesized
gcctcattgctttcctttaaac

SEQ ID NO: 63213 - DNA, 22 bp, Artificial Sequence
  chemically synthesized
attgctttcctttaaacacacc

SEQ ID NO: 63214 - DNA, 22 bp, Artificial Sequence
  chemically synthesized
ctttcctttaaacacaccaaac

SEQ ID NO: 63215 - DNA, 22 bp, Artificial Sequence
  chemically synthesized
tcctttaaacacaccaaacacg

SEQ ID NO: 63216 - DNA, 22 bp, Artificial Sequence
  chemically synthesized
cctttaaacacaccaaacacgt

SEQ ID NO: 63217 - DNA, 22 bp, Artificial Sequence
  chemically synthesized
ctttaaacacaccaaacacgtt

SEQ ID NO: 63218 - DNA, 22 bp, Artificial Sequence
  chemically synthesized
taaacacaccaaacacgttccc

SEQ ID NO: 63219 - DNA, 22 bp, Artificial Sequence
  chemically synthesized
aaacacaccaaacacgttccca

SEQ ID NO: 63220 - DNA, 22 bp, Artificial Sequence
  chemically synthesized
aacacaccaaacacgttcccac

SEQ ID NO: 63221 - DNA, 22 bp, Artificial Sequence
  chemically synthesized
ccacctcagggcttttgcattg

SEQ ID NO: 63222 - DNA, 22 bp, Artificial Sequence
  chemically synthesized
agggcttttgcattgcaatctt

SEQ ID NO: 63223 - DNA, 22 bp, Artificial Sequence
  chemically synthesized
ttgcattgcaatcttctctggc

SEQ ID NO: 63224 - DNA, 22 bp, Artificial Sequence
  chemically synthesized
tgcattgcaatcttctctggcc

SEQ ID NO: 63225 - DNA, 22 bp, Artificial Sequence
  chemically synthesized
gcattgcaatcttctctggcca

SEQ ID NO: 63226 - DNA, 22 bp, Artificial Sequence
  chemically synthesized
cattgcaatcttctctggccag

SEQ ID NO: 63227 - DNA, 22 bp, Artificial Sequence
  chemically synthesized
caatcttctctggccagacagc

SEQ ID NO: 63228 - DNA, 22 bp, Artificial Sequence
  chemically synthesized
ctctggccagacagcccttcac

SEQ ID NO: 63229 - DNA, 22 bp, Artificial Sequence
  chemically synthesized
tctggccagacagcccttcaca

SEQ ID NO: 63230 - DNA, 22 bp, Artificial Sequence
  chemically synthesized
tggccagacagcccttcacagc

SEQ ID NO: 63231 - DNA, 22 bp, Artificial Sequence
  chemically synthesized
gccagacagcccttcacagctc

SEQ ID NO: 63232 - DNA, 22 bp, Artificial Sequence
  chemically synthesized
cacagctcttctgccagaaact

SEQ ID NO: 63233 - DNA, 22 bp, Artificial Sequence
  chemically synthesized
acagctcttctgccagaaactt

SEQ ID NO: 63234 - DNA, 22 bp, Artificial Sequence
  chemically synthesized
ttctgccagaaacttacttcct

SEQ ID NO: 63235 - DNA, 22 bp, Artificial Sequence
  chemically synthesized
ctgccagaaacttacttcctca

SEQ ID NO: 63236 - DNA, 22 bp, Artificial Sequence
  chemically synthesized
tgccagaaacttacttcctcac

SEQ ID NO: 63237 - DNA, 22 bp, Artificial Sequence
  chemically synthesized
ccagaaacttacttcctcacat

SEQ ID NO: 63238 - DNA, 22 bp, Artificial Sequence
  chemically synthesized
acttcctcacatccttgaagac

SEQ ID NO: 63239 - DNA, 22 bp, Artificial Sequence
  chemically synthesized
cttcctcacatccttgaagact

SEQ ID NO: 63240 - DNA, 22 bp, Artificial Sequence
  chemically synthesized
cctcacatccttgaagacttga

SEQ ID NO: 63241 - DNA, 22 bp, Artificial Sequence
  chemically synthesized
ctcacatccttgaagacttgac

SEQ ID NO: 63242 - DNA, 22 bp, Artificial Sequence
  chemically synthesized
acatccttgaagacttgactca

SEQ ID NO: 63243 - DNA, 22 bp, Artificial Sequence
  chemically synthesized
gaagacttgactcagatctcat

SEQ ID NO: 63244 - DNA, 22 bp, Artificial Sequence
  chemically synthesized
aagacttgactcagatctcata

SEQ ID NO: 63245 - DNA, 22 bp, Artificial Sequence
  chemically synthesized
gactcagatctcatattctcag

SEQ ID NO: 63246 - DNA, 22 bp, Artificial Sequence
  chemically synthesized
actcagatctcatattctcagt

SEQ ID NO: 63247 - DNA, 22 bp, Artificial Sequence
  chemically synthesized
agatctcatattctcagtgagt

SEQ ID NO: 63248 - DNA, 22 bp, Artificial Sequence
  chemically synthesized
atattctcagtgagtcctactc

SEQ ID NO: 63249 - DNA, 22 bp, Artificial Sequence
  chemically synthesized
tcagtgagtcctactctgacca

SEQ ID NO: 63250 - DNA, 22 bp, Artificial Sequence
  chemically synthesized
agtgagtcctactctgaccacg

SEQ ID NO: 63251 - DNA, 22 bp, Artificial Sequence
  chemically synthesized
ctctgaccacgctatttaaccc

SEQ ID NO: 63252 - DNA, 22 bp, Artificial Sequence
  chemically synthesized
tgaccacgctatttaaccctgc

SEQ ID NO: 63253 - DNA, 22 bp, Artificial Sequence
  chemically synthesized
accacgctatttaaccctgctt

SEQ ID NO: 63254 - DNA, 22 bp, Artificial Sequence
  chemically synthesized
tttaaccctgcttgcaaccggt

SEQ ID NO: 63255 - DNA, 22 bp, Artificial Sequence
  chemically synthesized
aaccctgcttgcaaccggttcc

SEQ ID NO: 63256 - DNA, 22 bp, Artificial Sequence
  chemically synthesized
accctgcttgcaaccggttccg

SEQ ID NO: 63257 - DNA, 22 bp, Artificial Sequence
  chemically synthesized
cttgcaaccggttccgtttttt

SEQ ID NO: 63258 - DNA, 22 bp, Artificial Sequence
  chemically synthesized
gcaaccggttccgtttttttat

SEQ ID NO: 63259 - DNA, 22 bp, Artificial Sequence
  chemically synthesized
caaccggttccgtttttttatt

SEQ ID NO: 63260 - DNA, 22 bp, Artificial Sequence
  chemically synthesized
cgtttttttatttgtttgtttt

SEQ ID NO: 63261 - DNA, 22 bp, Artificial Sequence
  chemically synthesized
ttttatttgtttgttttttgtt

SEQ ID NO: 63262 - DNA, 22 bp, Artificial Sequence
  chemically synthesized
tttatttgtttgttttttgttt

SEQ ID NO: 63263 - DNA, 22 bp, Artificial Sequence
  chemically synthesized
ttatttgtttgttttttgtttt

SEQ ID NO: 63264 - DNA, 22 bp, Artificial Sequence
  chemically synthesized
tatttgtttgttttttgttttt

SEQ ID NO: 63265 - DNA, 22 bp, Artificial Sequence
  chemically synthesized
atttgtttgttttttgtttttt

SEQ ID NO: 63266 - DNA, 22 bp, Artificial Sequence
  chemically synthesized
tttgtttgttttttgttttttt

SEQ ID NO: 63267 - DNA, 22 bp, Artificial Sequence
  chemically synthesized
gtttgttttttgtttttttaga

SEQ ID NO: 63268 - DNA, 22 bp, Artificial Sequence
  chemically synthesized
tttgttttttgtttttttagag

SEQ ID NO: 63269 - DNA, 22 bp, Artificial Sequence
  chemically synthesized
gttttttgtttttttagagaca

SEQ ID NO: 63270 - DNA, 22 bp, Artificial Sequence
  chemically synthesized
ttttttgtttttttagagacag

SEQ ID NO: 63271 - DNA, 22 bp, Artificial Sequence
  chemically synthesized
tttgtttttttagagacagtgt

SEQ ID NO: 63272 - DNA, 22 bp, Artificial Sequence
  chemically synthesized
ttgtttttttagagacagtgtc

SEQ ID NO: 63273 - DNA, 22 bp, Artificial Sequence
  chemically synthesized
tgtttttttagagacagtgtct

SEQ ID NO: 63274 - DNA, 22 bp, Artificial Sequence
  chemically synthesized
gtttttttagagacagtgtctt

SEQ ID NO: 63275 - DNA, 22 bp, Artificial Sequence
  chemically synthesized
tttttttagagacagtgtcttg

SEQ ID NO: 63276 - DNA, 22 bp, Artificial Sequence
  chemically synthesized
ttttagagacagtgtcttgctt

SEQ ID NO: 63277 - DNA, 22 bp, Artificial Sequence
  chemically synthesized
tttagagacagtgtcttgcttt

SEQ ID NO: 63278 - DNA, 22 bp, Artificial Sequence
  chemically synthesized
ttagagacagtgtcttgctttg

SEQ ID NO: 63279 - DNA, 22 bp, Artificial Sequence
  chemically synthesized
tagagacagtgtcttgctttgt

SEQ ID NO: 63280 - DNA, 22 bp, Artificial Sequence
  chemically synthesized
agagacagtgtcttgctttgtc

SEQ ID NO: 63281 - DNA, 22 bp, Artificial Sequence
  chemically synthesized
gagacagtgtcttgctttgtct

SEQ ID NO: 63282 - DNA, 22 bp, Artificial Sequence
  chemically synthesized
gctttgtctcctaggctgcaat

SEQ ID NO: 63283 - DNA, 22 bp, Artificial Sequence
  chemically synthesized
ctttgtctcctaggctgcaatg

SEQ ID NO: 63284 - DNA, 22 bp, Artificial Sequence
  chemically synthesized
tgtctcctaggctgcaatgcag

SEQ ID NO: 63285 - DNA, 22 bp, Artificial Sequence
  chemically synthesized
gtctcctaggctgcaatgcagt

SEQ ID NO: 63286 - DNA, 22 bp, Artificial Sequence
  chemically synthesized
tctcctaggctgcaatgcagtg

SEQ ID NO: 63287 - DNA, 22 bp, Artificial Sequence
  chemically synthesized
ctaggctgcaatgcagtgccat

SEQ ID NO: 63288 - DNA, 22 bp, Artificial Sequence
  chemically synthesized
ggctgcaatgcagtgccatgat

SEQ ID NO: 63289 - DNA, 22 bp, Artificial Sequence
  chemically synthesized
caatgcagtgccatgatcatag

SEQ ID NO: 63290 - DNA, 22 bp, Artificial Sequence
  chemically synthesized
actgcagcctcgacctcctgga

SEQ ID NO: 63291 - DNA, 22 bp, Artificial Sequence
  chemically synthesized
cagcctcgacctcctggactca

SEQ ID NO: 63292 - DNA, 22 bp, Artificial Sequence
  chemically synthesized
gacctcctggactcaagcaatc

SEQ ID NO: 63293 - DNA, 22 bp, Artificial Sequence
  chemically synthesized
ctggactcaagcaatcctccca

SEQ ID NO: 63294 - DNA, 22 bp, Artificial Sequence
  chemically synthesized
gactcaagcaatcctcccacct

SEQ ID NO: 63295 - DNA, 22 bp, Artificial Sequence
  chemically synthesized
aagcaatcctcccacctcagcc

SEQ ID NO: 63296 - DNA, 22 bp, Artificial Sequence
  chemically synthesized
ccacctcagccccctgagtagc

SEQ ID NO: 63297 - DNA, 22 bp, Artificial Sequence
  chemically synthesized
agccccctgagtagctgggacc

SEQ ID NO: 63298 - DNA, 22 bp, Artificial Sequence
  chemically synthesized
agtagctgggaccacaggtgca

SEQ ID NO: 63299 - DNA, 22 bp, Artificial Sequence
  chemically synthesized
ggaccacaggtgcacaccacca

SEQ ID NO: 63300 - DNA, 22 bp, Artificial Sequence
  chemically synthesized
tttaaatgtgttttgtttgttt

SEQ ID NO: 63301 - DNA, 22 bp, Artificial Sequence
  chemically synthesized
ttaaatgtgttttgtttgtttg

SEQ ID NO: 63302 - DNA, 22 bp, Artificial Sequence
  chemically synthesized
taaatgtgttttgtttgtttgt

SEQ ID NO: 63303 - DNA, 22 bp, Artificial Sequence
  chemically synthesized
aaatgtgttttgtttgtttgtt

SEQ ID NO: 63304 - DNA, 22 bp, Artificial Sequence
  chemically synthesized
aatgtgttttgtttgtttgttt

SEQ ID NO: 63305 - DNA, 22 bp, Artificial Sequence
  chemically synthesized
tgtttgtttgtttgattgtttt

SEQ ID NO: 63306 - DNA, 22 bp, Artificial Sequence
  chemically synthesized
gtttgtttgtttgattgttttt

SEQ ID NO: 63307 - DNA, 22 bp, Artificial Sequence
  chemically synthesized
tttgtttgtttgattgtttttg

SEQ ID NO: 63308 - DNA, 22 bp, Artificial Sequence
  chemically synthesized
gtttgtttgattgtttttgccc

SEQ ID NO: 63309 - DNA, 22 bp, Artificial Sequence
  chemically synthesized
tttgtttgattgtttttgccca

SEQ ID NO: 63310 - DNA, 22 bp, Artificial Sequence
  chemically synthesized
gtttgattgtttttgcccaggc

SEQ ID NO: 63311 - DNA, 22 bp, Artificial Sequence
  chemically synthesized
tttgattgtttttgcccaggct

SEQ ID NO: 63312 - DNA, 22 bp, Artificial Sequence
  chemically synthesized
gattgtttttgcccaggctggt

SEQ ID NO: 63313 - DNA, 22 bp, Artificial Sequence
  chemically synthesized
attgtttttgcccaggctggtt

SEQ ID NO: 63314 - DNA, 22 bp, Artificial Sequence
  chemically synthesized
tttttgcccaggctggttttga

SEQ ID NO: 63315 - DNA, 22 bp, Artificial Sequence
  chemically synthesized
ttgcccaggctggttttgaact

SEQ ID NO: 63316 - DNA, 22 bp, Artificial Sequence
  chemically synthesized
tgcccaggctggttttgaactc

SEQ ID NO: 63317 - DNA, 22 bp, Artificial Sequence
  chemically synthesized
gcccaggctggttttgaactct

SEQ ID NO: 63318 - DNA, 22 bp, Artificial Sequence
  chemically synthesized
cccaggctggttttgaactctt

SEQ ID NO: 63319 - DNA, 22 bp, Artificial Sequence
  chemically synthesized
gttttgaactcttgggctcaag

SEQ ID NO: 63320 - DNA, 22 bp, Artificial Sequence
  chemically synthesized
tgaactcttgggctcaagcaat

SEQ ID NO: 63321 - DNA, 22 bp, Artificial Sequence
  chemically synthesized
gaactcttgggctcaagcaatc

SEQ ID NO: 63322 - DNA, 22 bp, Artificial Sequence
  chemically synthesized
aactcttgggctcaagcaatcc

SEQ ID NO: 63323 - DNA, 22 bp, Artificial Sequence
  chemically synthesized
ttgggctcaagcaatcctccta

SEQ ID NO: 63324 - DNA, 22 bp, Artificial Sequence
  chemically synthesized
gggctcaagcaatcctcctacc

SEQ ID NO: 63325 - DNA, 22 bp, Artificial Sequence
  chemically synthesized
ggctcaagcaatcctcctaccc

SEQ ID NO: 63326 - DNA, 22 bp, Artificial Sequence
  chemically synthesized
aagcaatcctcctacccttggc

SEQ ID NO: 63327 - DNA, 22 bp, Artificial Sequence
  chemically synthesized
ctacccttggcctcccaaagtg

SEQ ID NO: 63328 - DNA, 22 bp, Artificial Sequence
  chemically synthesized
cccttggcctcccaaagtgttg

SEQ ID NO: 63329 - DNA, 22 bp, Artificial Sequence
  chemically synthesized
ggcctcccaaagtgttgggatt

SEQ ID NO: 63330 - DNA, 22 bp, Artificial Sequence
  chemically synthesized
gcctcccaaagtgttgggatta

SEQ ID NO: 63331 - DNA, 22 bp, Artificial Sequence
  chemically synthesized
ccaaagtgttgggattataggt

SEQ ID NO: 63332 - DNA, 22 bp, Artificial Sequence
  chemically synthesized
ggattataggtgtgagccacca

SEQ ID NO: 63333 - DNA, 22 bp, Artificial Sequence
  chemically synthesized
taggtgtgagccaccatggccc

SEQ ID NO: 63334 - DNA, 22 bp, Artificial Sequence
  chemically synthesized
gttcccatcccattcttaattc

SEQ ID NO: 63335 - DNA, 22 bp, Artificial Sequence
  chemically synthesized
ccatcccattcttaattcctct

SEQ ID NO: 63336 - DNA, 22 bp, Artificial Sequence
  chemically synthesized
ttaattcctctaccctgagaga

SEQ ID NO: 63337 - DNA, 22 bp, Artificial Sequence
  chemically synthesized
aattcctctaccctgagagata

SEQ ID NO: 63338 - DNA, 22 bp, Artificial Sequence
  chemically synthesized
attcctctaccctgagagatag

SEQ ID NO: 63339 - DNA, 22 bp, Artificial Sequence
  chemically synthesized
ctctaccctgagagatagaggg

SEQ ID NO: 63340 - DNA, 22 bp, Artificial Sequence
  chemically synthesized
taccctgagagatagagggtcc

SEQ ID NO: 63341 - DNA, 22 bp, Artificial Sequence
  chemically synthesized
ccctgagagatagagggtcctg

SEQ ID NO: 63342 - DNA, 22 bp, Artificial Sequence
  chemically synthesized
agagatagagggtcctgagatg

SEQ ID NO: 63343 - DNA, 22 bp, Artificial Sequence
  chemically synthesized
agatgtgccgcccagacctccc

SEQ ID NO: 63344 - DNA, 22 bp, Artificial Sequence
  chemically synthesized
cctcctgaactgcaggacttat

SEQ ID NO: 63345 - DNA, 22 bp, Artificial Sequence
  chemically synthesized
ctgaactgcaggacttatttcg

SEQ ID NO: 63346 - DNA, 22 bp, Artificial Sequence
  chemically synthesized
aactgcaggacttatttcgtag

SEQ ID NO: 63347 - DNA, 22 bp, Artificial Sequence
  chemically synthesized
caggacttatttcgtagctgtt

SEQ ID NO: 63348 - DNA, 22 bp, Artificial Sequence
  chemically synthesized
atttcgtagctgttgagagtgt

SEQ ID NO: 63349 - DNA, 22 bp, Artificial Sequence
  chemically synthesized
tttcgtagctgttgagagtgtg

SEQ ID NO: 63350 - DNA, 22 bp, Artificial Sequence
  chemically synthesized
cgtagctgttgagagtgtgatg

SEQ ID NO: 63351 - DNA, 22 bp, Artificial Sequence
  chemically synthesized
gtagctgttgagagtgtgatgg

SEQ ID NO: 63352 - DNA, 22 bp, Artificial Sequence
  chemically synthesized
ttgagagtgtgatggtagatgg

SEQ ID NO: 63353 - DNA, 22 bp, Artificial Sequence
  chemically synthesized
agagtgtgatggtagatggctt

SEQ ID NO: 63354 - DNA, 22 bp, Artificial Sequence
  chemically synthesized
tctgctctcagccttctcctgg

SEQ ID NO: 63355 - DNA, 22 bp, Artificial Sequence
  chemically synthesized
ctgctctcagccttctcctggc

SEQ ID NO: 63356 - DNA, 22 bp, Artificial Sequence
  chemically synthesized
tgctctcagccttctcctggca

SEQ ID NO: 63357 - DNA, 22 bp, Artificial Sequence
  chemically synthesized
ctctcagccttctcctggcatt

SEQ ID NO: 63358 - DNA, 22 bp, Artificial Sequence
  chemically synthesized
tcagccttctcctggcattgcc

SEQ ID NO: 63359 - DNA, 22 bp, Artificial Sequence
  chemically synthesized
agccttctcctggcattgccct

SEQ ID NO: 63360 - DNA, 22 bp, Artificial Sequence
  chemically synthesized
ctcctggcattgccctgggcta

SEQ ID NO: 63361 - DNA, 22 bp, Artificial Sequence
  chemically synthesized
tcctggcattgccctgggctaa

SEQ ID NO: 63362 - DNA, 22 bp, Artificial Sequence
  chemically synthesized
ctggcattgccctgggctaaag

SEQ ID NO: 63363 - DNA, 22 bp, Artificial Sequence
  chemically synthesized
gcattgccctgggctaaagaga

SEQ ID NO: 63364 - DNA, 22 bp, Artificial Sequence
  chemically synthesized
ccctgggctaaagagagtcgcc

SEQ ID NO: 63365 - DNA, 22 bp, Artificial Sequence
  chemically synthesized
ggctaaagagagtcgccttgat

SEQ ID NO: 63366 - DNA, 22 bp, Artificial Sequence
  chemically synthesized
aagagagtcgccttgatcaagg

SEQ ID NO: 63367 - DNA, 22 bp, Artificial Sequence
  chemically synthesized
gatcaaggttacgctctcccca

SEQ ID NO: 63368 - DNA, 22 bp, Artificial Sequence
  chemically synthesized
atcaaggttacgctctccccag

SEQ ID NO: 63369 - DNA, 22 bp, Artificial Sequence
  chemically synthesized
cgctctccccagggtctgattc

SEQ ID NO: 63370 - DNA, 22 bp, Artificial Sequence
  chemically synthesized
tccccagggtctgattcccttg

SEQ ID NO: 63371 - DNA, 22 bp, Artificial Sequence
  chemically synthesized
cccagggtctgattcccttgtc

SEQ ID NO: 63372 - DNA, 22 bp, Artificial Sequence
  chemically synthesized
attcccttgtcccaacttggac

SEQ ID NO: 63373 - DNA, 22 bp, Artificial Sequence
  chemically synthesized
ccttgtcccaacttggaccaac

SEQ ID NO: 63374 - DNA, 22 bp, Artificial Sequence
  chemically synthesized
gtcccaacttggaccaactctg

SEQ ID NO: 63375 - DNA, 22 bp, Artificial Sequence
  chemically synthesized
tcccaacttggaccaactctga

SEQ ID NO: 63376 - DNA, 22 bp, Artificial Sequence
  chemically synthesized
ggaccaactctgaggagccatc

SEQ ID NO: 63377 - DNA, 22 bp, Artificial Sequence
  chemically synthesized
gaccaactctgaggagccatcc

SEQ ID NO: 63378 - DNA, 22 bp, Artificial Sequence
  chemically synthesized
tgaggagccatccccagcttca

SEQ ID NO: 63379 - DNA, 22 bp, Artificial Sequence
  chemically synthesized
aggagccatccccagcttcaga

SEQ ID NO: 63380 - DNA, 22 bp, Artificial Sequence
  chemically synthesized
cagagctcgctgtggggttgga

SEQ ID NO: 63381 - DNA, 22 bp, Artificial Sequence
  chemically synthesized
agagctcgctgtggggttggat

SEQ ID NO: 63382 - DNA, 22 bp, Artificial Sequence
  chemically synthesized
gctgtggggttggatgaggcag

SEQ ID NO: 63383 - DNA, 22 bp, Artificial Sequence
  chemically synthesized
tggggttggatgaggcagaatc

SEQ ID NO: 63384 - DNA, 22 bp, Artificial Sequence
  chemically synthesized
gatgaggcagaatcacaaccgg

SEQ ID NO: 63385 - DNA, 22 bp, Artificial Sequence
  chemically synthesized
tccttctgccctgttcctgttc

SEQ ID NO: 63386 - DNA, 22 bp, Artificial Sequence
  chemically synthesized
cttctgccctgttcctgttcct

SEQ ID NO: 63387 - DNA, 22 bp, Artificial Sequence
  chemically synthesized
ctgccctgttcctgttccttcc

SEQ ID NO: 63388 - DNA, 22 bp, Artificial Sequence
  chemically synthesized
tgccctgttcctgttccttccc

SEQ ID NO: 63389 - DNA, 22 bp, Artificial Sequence
  chemically synthesized
ccctgttcctgttccttccctt

SEQ ID NO: 63390 - DNA, 22 bp, Artificial Sequence
  chemically synthesized
ttcctgttccttcccttctaca

SEQ ID NO: 63391 - DNA, 22 bp, Artificial Sequence
  chemically synthesized
ctgttccttcccttctacaagt

SEQ ID NO: 63392 - DNA, 22 bp, Artificial Sequence
  chemically synthesized
ttccttcccttctacaagtata

SEQ ID NO: 63393 - DNA, 22 bp, Artificial Sequence
  chemically synthesized
cttcccttctacaagtatagtt

SEQ ID NO: 63394 - DNA, 22 bp, Artificial Sequence
  chemically synthesized
cccttctacaagtatagttccc

SEQ ID NO: 63395 - DNA, 22 bp, Artificial Sequence
  chemically synthesized
ccttctacaagtatagttcccc

SEQ ID NO: 63396 - DNA, 22 bp, Artificial Sequence
  chemically synthesized
ctacaagtatagttccccagag

SEQ ID NO: 63397 - DNA, 22 bp, Artificial Sequence
  chemically synthesized
tacaagtatagttccccagagt

SEQ ID NO: 63398 - DNA, 22 bp, Artificial Sequence
  chemically synthesized
caagtatagttccccagagtat

SEQ ID NO: 63399 - DNA, 22 bp, Artificial Sequence
  chemically synthesized
cccagagtatctaaactcctgc

SEQ ID NO: 63400 - DNA, 22 bp, Artificial Sequence
  chemically synthesized
aactcctgcacgtgaatctcca

SEQ ID NO: 63401 - DNA, 22 bp, Artificial Sequence
  chemically synthesized
ctgcacgtgaatctccatttca

SEQ ID NO: 63402 - DNA, 22 bp, Artificial Sequence
  chemically synthesized
cacgtgaatctccatttcagcc

SEQ ID NO: 63403 - DNA, 22 bp, Artificial Sequence
  chemically synthesized
catttcagcctgctttccaggg

SEQ ID NO: 63404 - DNA, 22 bp, Artificial Sequence
  chemically synthesized
cagcctgctttccagggaaccc

SEQ ID NO: 63405 - DNA, 22 bp, Artificial Sequence
  chemically synthesized
agcctgctttccagggaacccc

SEQ ID NO: 63406 - DNA, 22 bp, Artificial Sequence
  chemically synthesized
ctttccagggaaccccatagat

SEQ ID NO: 63407 - DNA, 22 bp, Artificial Sequence
  chemically synthesized
tccagggaaccccatagataaa

SEQ ID NO: 63408 - DNA, 22 bp, Artificial Sequence
  chemically synthesized
ccagggaaccccatagataaat

SEQ ID NO: 63409 - DNA, 22 bp, Artificial Sequence
  chemically synthesized
cagggaaccccatagataaata

SEQ ID NO: 63410 - DNA, 22 bp, Artificial Sequence
  chemically synthesized
tcttccctccctcccttcctcc

SEQ ID NO: 63411 - DNA, 22 bp, Artificial Sequence
  chemically synthesized
cttccctccctcccttcctcct

SEQ ID NO: 63412 - DNA, 22 bp, Artificial Sequence
  chemically synthesized
ttccctccctcccttcctcctt

SEQ ID NO: 63413 - DNA, 22 bp, Artificial Sequence
  chemically synthesized
ccctccctcccttcctccttcc

SEQ ID NO: 63414 - DNA, 22 bp, Artificial Sequence
  chemically synthesized
cctccctcccttcctccttccc

SEQ ID NO: 63415 - DNA, 22 bp, Artificial Sequence
  chemically synthesized
cctcccttcctccttccctttc

SEQ ID NO: 63416 - DNA, 22 bp, Artificial Sequence
  chemically synthesized
ccttcctccttccctttctttc

SEQ ID NO: 63417 - DNA, 22 bp, Artificial Sequence
  chemically synthesized
cctccttccctttctttctccc

SEQ ID NO: 63418 - DNA, 22 bp, Artificial Sequence
  chemically synthesized
ctccttccctttctttctccct

SEQ ID NO: 63419 - DNA, 22 bp, Artificial Sequence
  chemically synthesized
cttccctttctttctcccttcc

SEQ ID NO: 63420 - DNA, 22 bp, Artificial Sequence
  chemically synthesized
ccctttctttctcccttccttc

SEQ ID NO: 63421 - DNA, 22 bp, Artificial Sequence
  chemically synthesized
cctttctttctcccttccttcc

SEQ ID NO: 63422 - DNA, 22 bp, Artificial Sequence
  chemically synthesized
tctttctcccttccttcctccc

SEQ ID NO: 63423 - DNA, 22 bp, Artificial Sequence
  chemically synthesized
ctttctcccttccttcctccct

SEQ ID NO: 63424 - DNA, 22 bp, Artificial Sequence
  chemically synthesized
tttctcccttccttcctccctc

SEQ ID NO: 63425 - DNA, 22 bp, Artificial Sequence
  chemically synthesized
tctcccttccttcctccctccc

SEQ ID NO: 63426 - DNA, 22 bp, Artificial Sequence
  chemically synthesized
ctcccttccttcctccctccct

SEQ ID NO: 63427 - DNA, 22 bp, Artificial Sequence
  chemically synthesized
tcccttccttcctccctccctt

SEQ ID NO: 63428 - DNA, 22 bp, Artificial Sequence
  chemically synthesized
ccttccttcctccctcccttct

SEQ ID NO: 63429 - DNA, 22 bp, Artificial Sequence
  chemically synthesized
ccttcctccctcccttcttctt

SEQ ID NO: 63430 - DNA, 22 bp, Artificial Sequence
  chemically synthesized
cttcctccctcccttcttcttc

SEQ ID NO: 63431 - DNA, 22 bp, Artificial Sequence
  chemically synthesized
cctccctcccttcttcttcctt

SEQ ID NO: 63432 - DNA, 22 bp, Artificial Sequence
  chemically synthesized
ctccctcccttcttcttccttc

SEQ ID NO: 63433 - DNA, 22 bp, Artificial Sequence
  chemically synthesized
cctcccttcttcttccttctaa

SEQ ID NO: 63434 - DNA, 22 bp, Artificial Sequence
  chemically synthesized
ccttcttcttccttctaacact

SEQ ID NO: 63435 - DNA, 22 bp, Artificial Sequence
  chemically synthesized
cttcttccttctaacactaaca

SEQ ID NO: 63436 - DNA, 22 bp, Artificial Sequence
  chemically synthesized
ttcttccttctaacactaacaa

SEQ ID NO: 63437 - DNA, 22 bp, Artificial Sequence
  chemically synthesized
cttccttctaacactaacaatt

SEQ ID NO: 63438 - DNA, 22 bp, Artificial Sequence
  chemically synthesized
ttccttctaacactaacaatta

SEQ ID NO: 63439 - DNA, 22 bp, Artificial Sequence
  chemically synthesized
ccttctaacactaacaattata

SEQ ID NO: 63440 - DNA, 22 bp, Artificial Sequence
  chemically synthesized
cttctaacactaacaattatat

SEQ ID NO: 63441 - DNA, 22 bp, Artificial Sequence
  chemically synthesized
ctaacactaacaattatatacc

SEQ ID NO: 63442 - DNA, 22 bp, Artificial Sequence
  chemically synthesized
taacactaacaattatatacct

SEQ ID NO: 63443 - DNA, 22 bp, Artificial Sequence
  chemically synthesized
acactaacaattatataccttg

SEQ ID NO: 63444 - DNA, 22 bp, Artificial Sequence
  chemically synthesized
acaattatataccttgggtaat

SEQ ID NO: 63445 - DNA, 22 bp, Artificial Sequence
  chemically synthesized
tataccttgggtaattcattta

SEQ ID NO: 63446 - DNA, 22 bp, Artificial Sequence
  chemically synthesized
gggtaattcatttaaacttttt

SEQ ID NO: 63447 - DNA, 22 bp, Artificial Sequence
  chemically synthesized
ggtaattcatttaaactttttt

SEQ ID NO: 63448 - DNA, 22 bp, Artificial Sequence
  chemically synthesized
atttaaactttttttttttttt

SEQ ID NO: 63449 - DNA, 22 bp, Artificial Sequence
  chemically synthesized
aaacttttttttttttttcctg

SEQ ID NO: 63450 - DNA, 22 bp, Artificial Sequence
  chemically synthesized
aacttttttttttttttcctga

SEQ ID NO: 63451 - DNA, 22 bp, Artificial Sequence
  chemically synthesized
ttttttttttttcctgacagaa

SEQ ID NO: 63452 - DNA, 22 bp, Artificial Sequence
  chemically synthesized
tttttttttttcctgacagaat

SEQ ID NO: 63453 - DNA, 22 bp, Artificial Sequence
  chemically synthesized
ttttttttttcctgacagaatc

SEQ ID NO: 63454 - DNA, 22 bp, Artificial Sequence
  chemically synthesized
tttttttttcctgacagaatct

SEQ ID NO: 63455 - DNA, 22 bp, Artificial Sequence
  chemically synthesized
ttttttttcctgacagaatctt

SEQ ID NO: 63456 - DNA, 22 bp, Artificial Sequence
  chemically synthesized
tttttttcctgacagaatcttt

SEQ ID NO: 63457 - DNA, 22 bp, Artificial Sequence
  chemically synthesized
ttttttcctgacagaatctttc

SEQ ID NO: 63458 - DNA, 22 bp, Artificial Sequence
  chemically synthesized
tttttcctgacagaatctttct

SEQ ID NO: 63459 - DNA, 22 bp, Artificial Sequence
  chemically synthesized
ttttcctgacagaatctttctc

SEQ ID NO: 63460 - DNA, 22 bp, Artificial Sequence
  chemically synthesized
tttcctgacagaatctttctct

SEQ ID NO: 63461 - DNA, 22 bp, Artificial Sequence
  chemically synthesized
ttcctgacagaatctttctctg

SEQ ID NO: 63462 - DNA, 22 bp, Artificial Sequence
  chemically synthesized
tcctgacagaatctttctctgt

SEQ ID NO: 63463 - DNA, 22 bp, Artificial Sequence
  chemically synthesized
cctgacagaatctttctctgtc

SEQ ID NO: 63464 - DNA, 22 bp, Artificial Sequence
  chemically synthesized
ctgacagaatctttctctgtca

SEQ ID NO: 63465 - DNA, 22 bp, Artificial Sequence
  chemically synthesized
acagaatctttctctgtcacca

SEQ ID NO: 63466 - DNA, 22 bp, Artificial Sequence
  chemically synthesized
tctctgtcaccaaggctggagt

SEQ ID NO: 63467 - DNA, 22 bp, Artificial Sequence
  chemically synthesized
ctctgtcaccaaggctggagtg

SEQ ID NO: 63468 - DNA, 22 bp, Artificial Sequence
  chemically synthesized
tctgtcaccaaggctggagtgc

SEQ ID NO: 63469 - DNA, 22 bp, Artificial Sequence
  chemically synthesized
tgtcaccaaggctggagtgcag

SEQ ID NO: 63470 - DNA, 22 bp, Artificial Sequence
  chemically synthesized
tcaccaaggctggagtgcagtg

SEQ ID NO: 63471 - DNA, 22 bp, Artificial Sequence
  chemically synthesized
gagtgcagtggtgtgatttcag

SEQ ID NO: 63472 - DNA, 22 bp, Artificial Sequence
  chemically synthesized
cagctcactgcaacctctgcct

SEQ ID NO: 63473 - DNA, 22 bp, Artificial Sequence
  chemically synthesized
agctcactgcaacctctgcctc

SEQ ID NO: 63474 - DNA, 22 bp, Artificial Sequence
  chemically synthesized
actgcaacctctgcctcccggg

SEQ ID NO: 63475 - DNA, 22 bp, Artificial Sequence
  chemically synthesized
caacctctgcctcccgggttga

SEQ ID NO: 63476 - DNA, 22 bp, Artificial Sequence
  chemically synthesized
tgcctcccgggttgaagtgatt

SEQ ID NO: 63477 - DNA, 22 bp, Artificial Sequence
  chemically synthesized
cctcccgggttgaagtgattct

SEQ ID NO: 63478 - DNA, 22 bp, Artificial Sequence
  chemically synthesized
ccgggttgaagtgattctcctg

SEQ ID NO: 63479 - DNA, 22 bp, Artificial Sequence
  chemically synthesized
aagtgattctcctgccgcagcc

SEQ ID NO: 63480 - DNA, 22 bp, Artificial Sequence
  chemically synthesized
tcctgccgcagcctcctgggta

SEQ ID NO: 63481 - DNA, 22 bp, Artificial Sequence
  chemically synthesized
ctgccgcagcctcctgggtagc

SEQ ID NO: 63482 - DNA, 22 bp, Artificial Sequence
  chemically synthesized
ccgcagcctcctgggtagctgg

SEQ ID NO: 63483 - DNA, 22 bp, Artificial Sequence
  chemically synthesized
ctgggtagctgggattacaggc

SEQ ID NO: 63484 - DNA, 22 bp, Artificial Sequence
  chemically synthesized
ggtagctgggattacaggcgcc

SEQ ID NO: 63485 - DNA, 22 bp, Artificial Sequence
  chemically synthesized
ggattacaggcgcccgccacca

SEQ ID NO: 63486 - DNA, 22 bp, Artificial Sequence
  chemically synthesized
caggcgcccgccaccatgcctg

SEQ ID NO: 63487 - DNA, 22 bp, Artificial Sequence
  chemically synthesized
gctaagtttttgtattttttta

SEQ ID NO: 63488 - DNA, 22 bp, Artificial Sequence
  chemically synthesized
agtttttgtatttttttattag

SEQ ID NO: 63489 - DNA, 22 bp, Artificial Sequence
  chemically synthesized
ttgtatttttttattagtgacg

SEQ ID NO: 63490 - DNA, 22 bp, Artificial Sequence
  chemically synthesized
tgtatttttttattagtgacga

SEQ ID NO: 63491 - DNA, 22 bp, Artificial Sequence
  chemically synthesized
gtatttttttattagtgacgag

SEQ ID NO: 63492 - DNA, 22 bp, Artificial Sequence
  chemically synthesized
tatttttttattagtgacgagg

SEQ ID NO: 63493 - DNA, 22 bp, Artificial Sequence
  chemically synthesized
ttttattagtgacgaggtttca

SEQ ID NO: 63494 - DNA, 22 bp, Artificial Sequence
  chemically synthesized
tttattagtgacgaggtttcac

SEQ ID NO: 63495 - DNA, 22 bp, Artificial Sequence
  chemically synthesized
ttattagtgacgaggtttcacc

SEQ ID NO: 63496 - DNA, 22 bp, Artificial Sequence
  chemically synthesized
tattagtgacgaggtttcacca

SEQ ID NO: 63497 - DNA, 22 bp, Artificial Sequence
  chemically synthesized
attagtgacgaggtttcaccat

SEQ ID NO: 63498 - DNA, 22 bp, Artificial Sequence
  chemically synthesized
ttagtgacgaggtttcaccatg

SEQ ID NO: 63499 - DNA, 22 bp, Artificial Sequence
  chemically synthesized
gtgacgaggtttcaccatgttg

SEQ ID NO: 63500 - DNA, 22 bp, Artificial Sequence
  chemically synthesized
caccatgttggccaggctggtc

SEQ ID NO: 63501 - DNA, 22 bp, Artificial Sequence
  chemically synthesized
accatgttggccaggctggtct

SEQ ID NO: 63502 - DNA, 22 bp, Artificial Sequence
  chemically synthesized
gccaggctggtctcaaactcct

SEQ ID NO: 63503 - DNA, 22 bp, Artificial Sequence
  chemically synthesized
gtctcaaactcctgacctcagg

SEQ ID NO: 63504 - DNA, 22 bp, Artificial Sequence
  chemically synthesized
aaactcctgacctcaggtgatc

SEQ ID NO: 63505 - DNA, 22 bp, Artificial Sequence
  chemically synthesized
ctgacctcaggtgatccacctg

SEQ ID NO: 63506 - DNA, 22 bp, Artificial Sequence
  chemically synthesized
acctcaggtgatccacctgcgt

SEQ ID NO: 63507 - DNA, 22 bp, Artificial Sequence
  chemically synthesized
aggtgatccacctgcgttggcc

SEQ ID NO: 63508 - DNA, 22 bp, Artificial Sequence
  chemically synthesized
cgttggcctcccaaagtgctag

SEQ ID NO: 63509 - DNA, 22 bp, Artificial Sequence
  chemically synthesized
gcctcccaaagtgctaggatta

SEQ ID NO: 63510 - DNA, 22 bp, Artificial Sequence
  chemically synthesized
ccaaagtgctaggattacaggc

SEQ ID NO: 63511 - DNA, 22 bp, Artificial Sequence
  chemically synthesized
ggattacaggcgtgagccaccg

SEQ ID NO: 63512 - DNA, 22 bp, Artificial Sequence
  chemically synthesized
caggcgtgagccaccgcgcccg

SEQ ID NO: 63513 - DNA, 22 bp, Artificial Sequence
  chemically synthesized
ctttctgagccttagctactct

SEQ ID NO: 63514 - DNA, 22 bp, Artificial Sequence
  chemically synthesized
tctgagccttagctactctacc

SEQ ID NO: 63515 - DNA, 22 bp, Artificial Sequence
  chemically synthesized
ctgagccttagctactctacct

SEQ ID NO: 63516 - DNA, 22 bp, Artificial Sequence
  chemically synthesized
tgagccttagctactctaccta

SEQ ID NO: 63517 - DNA, 22 bp, Artificial Sequence
  chemically synthesized
agccttagctactctacctaag

SEQ ID NO: 63518 - DNA, 22 bp, Artificial Sequence
  chemically synthesized
agctactctacctaaggagcag

SEQ ID NO: 63519 - DNA, 22 bp, Artificial Sequence
  chemically synthesized
gctactctacctaaggagcaga

SEQ ID NO: 63520 - DNA, 22 bp, Artificial Sequence
  chemically synthesized
ctctacctaaggagcagagata

SEQ ID NO: 63521 - DNA, 22 bp, Artificial Sequence
  chemically synthesized
tacctaaggagcagagataata

SEQ ID NO: 63522 - DNA, 22 bp, Artificial Sequence
  chemically synthesized
cctaaggagcagagataataat

SEQ ID NO: 63523 - DNA, 22 bp, Artificial Sequence
  chemically synthesized
aggagcagagataataatttgc

SEQ ID NO: 63524 - DNA, 22 bp, Artificial Sequence
  chemically synthesized
gcttctattaagacagaggact

SEQ ID NO: 63525 - DNA, 22 bp, Artificial Sequence
  chemically synthesized
cttctattaagacagaggacta

SEQ ID NO: 63526 - DNA, 22 bp, Artificial Sequence
  chemically synthesized
ctattaagacagaggactaaat

SEQ ID NO: 63527 - DNA, 22 bp, Artificial Sequence
  chemically synthesized
tattaagacagaggactaaata

SEQ ID NO: 63528 - DNA, 22 bp, Artificial Sequence
  chemically synthesized
ttaagacagaggactaaataaa

SEQ ID NO: 63529 - DNA, 22 bp, Artificial Sequence
  chemically synthesized
agacagaggactaaataaaata

SEQ ID NO: 63530 - DNA, 22 bp, Artificial Sequence
  chemically synthesized
aataaaataacctcttaaagcc

SEQ ID NO: 63531 - DNA, 22 bp, Artificial Sequence
  chemically synthesized
ttaaagccactttaaactttcc

SEQ ID NO: 63532 - DNA, 22 bp, Artificial Sequence
  chemically synthesized
aaagccactttaaactttccag

SEQ ID NO: 63533 - DNA, 22 bp, Artificial Sequence
  chemically synthesized
aagccactttaaactttccagt

SEQ ID NO: 63534 - DNA, 22 bp, Artificial Sequence
  chemically synthesized
taaactttccagtctgtgcctc

SEQ ID NO: 63535 - DNA, 22 bp, Artificial Sequence
  chemically synthesized
aaactttccagtctgtgcctcc

SEQ ID NO: 63536 - DNA, 22 bp, Artificial Sequence
  chemically synthesized
aactttccagtctgtgcctcca

SEQ ID NO: 63537 - DNA, 22 bp, Artificial Sequence
  chemically synthesized
tccagtctgtgcctccattaat

SEQ ID NO: 63538 - DNA, 22 bp, Artificial Sequence
  chemically synthesized
ccagtctgtgcctccattaatt

SEQ ID NO: 63539 - DNA, 22 bp, Artificial Sequence
  chemically synthesized
cagtctgtgcctccattaattt

SEQ ID NO: 63540 - DNA, 22 bp, Artificial Sequence
  chemically synthesized
tgcctccattaatttcagggag

SEQ ID NO: 63541 - DNA, 22 bp, Artificial Sequence
  chemically synthesized
cattaatttcagggagaaattc

SEQ ID NO: 63542 - DNA, 22 bp, Artificial Sequence
  chemically synthesized
atttcagggagaaattcatcct

SEQ ID NO: 63543 - DNA, 22 bp, Artificial Sequence
  chemically synthesized
cagggagaaattcatccttgat

SEQ ID NO: 63544 - DNA, 22 bp, Artificial Sequence
  chemically synthesized
agggagaaattcatccttgata

SEQ ID NO: 63545 - DNA, 22 bp, Artificial Sequence
  chemically synthesized
atccttgataacaagctgttat

SEQ ID NO: 63546 - DNA, 22 bp, Artificial Sequence
  chemically synthesized
gataacaagctgttatgatgaa

SEQ ID NO: 63547 - DNA, 22 bp, Artificial Sequence
  chemically synthesized
ataacaagctgttatgatgaaa

SEQ ID NO: 63548 - DNA, 22 bp, Artificial Sequence
  chemically synthesized
ttatgatgaaagcaaacatatt

SEQ ID NO: 63549 - DNA, 22 bp, Artificial Sequence
  chemically synthesized
tgatgaaagcaaacatatttct

SEQ ID NO: 63550 - DNA, 22 bp, Artificial Sequence
  chemically synthesized
ctacaaaagatgtttggtcctt

SEQ ID NO: 63551 - DNA, 22 bp, Artificial Sequence
  chemically synthesized
tacaaaagatgtttggtccttc

SEQ ID NO: 63552 - DNA, 22 bp, Artificial Sequence
  chemically synthesized
caaaagatgtttggtccttctt

SEQ ID NO: 63553 - DNA, 22 bp, Artificial Sequence
  chemically synthesized
ggtccttctttccttctccttt

SEQ ID NO: 63554 - DNA, 22 bp, Artificial Sequence
  chemically synthesized
gtccttctttccttctcctttc

SEQ ID NO: 63555 - DNA, 22 bp, Artificial Sequence
  chemically synthesized
ctttccttctcctttccttttc

SEQ ID NO: 63556 - DNA, 22 bp, Artificial Sequence
  chemically synthesized
tttccttctcctttccttttct

SEQ ID NO: 63557 - DNA, 22 bp, Artificial Sequence
  chemically synthesized
tccttctcctttccttttcttc

SEQ ID NO: 63558 - DNA, 22 bp, Artificial Sequence
  chemically synthesized
ccttctcctttccttttcttct

SEQ ID NO: 63559 - DNA, 22 bp, Artificial Sequence
  chemically synthesized
cttctcctttccttttcttctt

SEQ ID NO: 63560 - DNA, 22 bp, Artificial Sequence
  chemically synthesized
ctcctttccttttcttcttctt

SEQ ID NO: 63561 - DNA, 22 bp, Artificial Sequence
  chemically synthesized
tcctttccttttcttcttcttc

SEQ ID NO: 63562 - DNA, 22 bp, Artificial Sequence
  chemically synthesized
ctttccttttcttcttcttctt

SEQ ID NO: 63563 - DNA, 22 bp, Artificial Sequence
  chemically synthesized
tccttttcttcttcttcttctt

SEQ ID NO: 63564 - DNA, 22 bp, Artificial Sequence
  chemically synthesized
ccttttcttcttcttcttcttt

SEQ ID NO: 63565 - DNA, 22 bp, Artificial Sequence
  chemically synthesized
cttttcttcttcttcttctttt

SEQ ID NO: 63566 - DNA, 22 bp, Artificial Sequence
  chemically synthesized
ttcttcttcttcttcttttttt

SEQ ID NO: 63567 - DNA, 22 bp, Artificial Sequence
  chemically synthesized
tcttcttcttcttctttttttt

SEQ ID NO: 63568 - DNA, 22 bp, Artificial Sequence
  chemically synthesized
cttcttcttcttcttttttttt

SEQ ID NO: 63569 - DNA, 22 bp, Artificial Sequence
  chemically synthesized
ttcttcttcttctttttttttt

SEQ ID NO: 63570 - DNA, 22 bp, Artificial Sequence
  chemically synthesized
cttcttcttctttttttttttt

SEQ ID NO: 63571 - DNA, 22 bp, Artificial Sequence
  chemically synthesized
ttcttcttcttttttttttttt

SEQ ID NO: 63572 - DNA, 22 bp, Artificial Sequence
  chemically synthesized
cttcttcttttttttttttttt

SEQ ID NO: 63573 - DNA, 22 bp, Artificial Sequence
  chemically synthesized
ttcttctttttttttttttttg

SEQ ID NO: 63574 - DNA, 22 bp, Artificial Sequence
  chemically synthesized
cttctttttttttttttttgcc

SEQ ID NO: 63575 - DNA, 22 bp, Artificial Sequence
  chemically synthesized
ttctttttttttttttttgcct

SEQ ID NO: 63576 - DNA, 22 bp, Artificial Sequence
  chemically synthesized
ctttttttttttttttgcctat

SEQ ID NO: 63577 - DNA, 22 bp, Artificial Sequence
  chemically synthesized
tttttttttttttttgcctata

SEQ ID NO: 63578 - DNA, 22 bp, Artificial Sequence
  chemically synthesized
tttttttttttttgcctataaa

SEQ ID NO: 63579 - DNA, 22 bp, Artificial Sequence
  chemically synthesized
ttttttttttttgcctataaac

SEQ ID NO: 63580 - DNA, 22 bp, Artificial Sequence
  chemically synthesized
tttttttttttgcctataaaca

SEQ ID NO: 63581 - DNA, 22 bp, Artificial Sequence
  chemically synthesized
ttttttttttgcctataaacaa

SEQ ID NO: 63582 - DNA, 22 bp, Artificial Sequence
  chemically synthesized
tttttttttgcctataaacaat

SEQ ID NO: 63583 - DNA, 22 bp, Artificial Sequence
  chemically synthesized
ttttttttgcctataaacaatc

SEQ ID NO: 63584 - DNA, 22 bp, Artificial Sequence
  chemically synthesized
tttttttgcctataaacaatca

SEQ ID NO: 63585 - DNA, 22 bp, Artificial Sequence
  chemically synthesized
ttttttgcctataaacaatcat

SEQ ID NO: 63586 - DNA, 22 bp, Artificial Sequence
  chemically synthesized
tttttgcctataaacaatcatt

SEQ ID NO: 63587 - DNA, 22 bp, Artificial Sequence
  chemically synthesized
ttttgcctataaacaatcattt

SEQ ID NO: 63588 - DNA, 22 bp, Artificial Sequence
  chemically synthesized
tttgcctataaacaatcatttt

SEQ ID NO: 63589 - DNA, 22 bp, Artificial Sequence
  chemically synthesized
ttgcctataaacaatcattttc

SEQ ID NO: 63590 - DNA, 22 bp, Artificial Sequence
  chemically synthesized
tgcctataaacaatcattttct

SEQ ID NO: 63591 - DNA, 22 bp, Artificial Sequence
  chemically synthesized
gcctataaacaatcattttcta

SEQ ID NO: 63592 - DNA, 22 bp, Artificial Sequence
  chemically synthesized
cctataaacaatcattttctag

SEQ ID NO: 63593 - DNA, 22 bp, Artificial Sequence
  chemically synthesized
taaacaatcattttctagtatt

SEQ ID NO: 63594 - DNA, 22 bp, Artificial Sequence
  chemically synthesized
tctagtattatatgtgtgtgtg

SEQ ID NO: 63595 - DNA, 22 bp, Artificial Sequence
  chemically synthesized
ctagtattatatgtgtgtgtgt

SEQ ID NO: 63596 - DNA, 22 bp, Artificial Sequence
  chemically synthesized
tagtattatatgtgtgtgtgtg

SEQ ID NO: 63597 - DNA, 22 bp, Artificial Sequence
  chemically synthesized
gtattatatgtgtgtgtgtgtg

SEQ ID NO: 63598 - DNA, 22 bp, Artificial Sequence
  chemically synthesized
tatgtgtgtgtgtgtgtgtgtg

SEQ ID NO: 63599 - DNA, 22 bp, Artificial Sequence
  chemically synthesized
ttttttttttttcagatggtgt

SEQ ID NO: 63600 - DNA, 22 bp, Artificial Sequence
  chemically synthesized
tttttttttttcagatggtgtc

SEQ ID NO: 63601 - DNA, 22 bp, Artificial Sequence
  chemically synthesized
ttttttttttcagatggtgtct

SEQ ID NO: 63602 - DNA, 22 bp, Artificial Sequence
  chemically synthesized
tttttttttcagatggtgtctc

SEQ ID NO: 63603 - DNA, 22 bp, Artificial Sequence
  chemically synthesized
ttttttttcagatggtgtctca

SEQ ID NO: 63604 - DNA, 22 bp, Artificial Sequence
  chemically synthesized
tttttttcagatggtgtctcat

SEQ ID NO: 63605 - DNA, 22 bp, Artificial Sequence
  chemically synthesized
ttttttcagatggtgtctcatt

SEQ ID NO: 63606 - DNA, 22 bp, Artificial Sequence
  chemically synthesized
tttttcagatggtgtctcattt

SEQ ID NO: 63607 - DNA, 22 bp, Artificial Sequence
  chemically synthesized
ttttcagatggtgtctcatttt

SEQ ID NO: 63608 - DNA, 22 bp, Artificial Sequence
  chemically synthesized
tttcagatggtgtctcattttg

SEQ ID NO: 63609 - DNA, 22 bp, Artificial Sequence
  chemically synthesized
ttcagatggtgtctcattttgt

SEQ ID NO: 63610 - DNA, 22 bp, Artificial Sequence
  chemically synthesized
tcagatggtgtctcattttgtc

SEQ ID NO: 63611 - DNA, 22 bp, Artificial Sequence
  chemically synthesized
cagatggtgtctcattttgtcg

SEQ ID NO: 63612 - DNA, 22 bp, Artificial Sequence
  chemically synthesized
agatggtgtctcattttgtcgc

SEQ ID NO: 63613 - DNA, 22 bp, Artificial Sequence
  chemically synthesized
attttgtcgcccaggctggagt

SEQ ID NO: 63614 - DNA, 22 bp, Artificial Sequence
  chemically synthesized
tgtcgcccaggctggagtgcaa

SEQ ID NO: 63615 - DNA, 22 bp, Artificial Sequence
  chemically synthesized
gtcgcccaggctggagtgcaat

SEQ ID NO: 63616 - DNA, 22 bp, Artificial Sequence
  chemically synthesized
tcgcccaggctggagtgcaatg

SEQ ID NO: 63617 - DNA, 22 bp, Artificial Sequence
  chemically synthesized
gagtgcaatggcgcaatcttgg

SEQ ID NO: 63618 - DNA, 22 bp, Artificial Sequence
  chemically synthesized
ggctcaccacctcccaggttca

SEQ ID NO: 63619 - DNA, 22 bp, Artificial Sequence
  chemically synthesized
gctcaccacctcccaggttcaa

SEQ ID NO: 63620 - DNA, 22 bp, Artificial Sequence
  chemically synthesized
accacctcccaggttcaagcga

SEQ ID NO: 63621 - DNA, 22 bp, Artificial Sequence
  chemically synthesized
ccaggttcaagcgattctcctg

SEQ ID NO: 63622 - DNA, 22 bp, Artificial Sequence
  chemically synthesized
aagcgattctcctgccttagcc

SEQ ID NO: 63623 - DNA, 22 bp, Artificial Sequence
  chemically synthesized
tcctgccttagcctcctgagta

SEQ ID NO: 63624 - DNA, 22 bp, Artificial Sequence
  chemically synthesized
ctgccttagcctcctgagtagc

SEQ ID NO: 63625 - DNA, 22 bp, Artificial Sequence
  chemically synthesized
ccttagcctcctgagtagctca

SEQ ID NO: 63626 - DNA, 22 bp, Artificial Sequence
  chemically synthesized
agcctcctgagtagctcagatt

SEQ ID NO: 63627 - DNA, 22 bp, Artificial Sequence
  chemically synthesized
gcctcctgagtagctcagatta

SEQ ID NO: 63628 - DNA, 22 bp, Artificial Sequence
  chemically synthesized
ctgagtagctcagattacaggc

SEQ ID NO: 63629 - DNA, 22 bp, Artificial Sequence
  chemically synthesized
agtagctcagattacaggcatg

SEQ ID NO: 63630 - DNA, 22 bp, Artificial Sequence
  chemically synthesized
agattacaggcatgcaccagga

SEQ ID NO: 63631 - DNA, 22 bp, Artificial Sequence
  chemically synthesized
caggcatgcaccaggacaccca

SEQ ID NO: 63632 - DNA, 22 bp, Artificial Sequence
  chemically synthesized
atttttgtatttttagtagaga

SEQ ID NO: 63633 - DNA, 22 bp, Artificial Sequence
  chemically synthesized
ttgtatttttagtagagacagg

SEQ ID NO: 63634 - DNA, 22 bp, Artificial Sequence
  chemically synthesized
tgtatttttagtagagacaggg

SEQ ID NO: 63635 - DNA, 22 bp, Artificial Sequence
  chemically synthesized
gtatttttagtagagacagggt

SEQ ID NO: 63636 - DNA, 22 bp, Artificial Sequence
  chemically synthesized
tatttttagtagagacagggtt

SEQ ID NO: 63637 - DNA, 22 bp, Artificial Sequence
  chemically synthesized
ttagtagagacagggttttgcc

SEQ ID NO: 63638 - DNA, 22 bp, Artificial Sequence
  chemically synthesized
tagtagagacagggttttgcca

SEQ ID NO: 63639 - DNA, 22 bp, Artificial Sequence
  chemically synthesized
agtagagacagggttttgccat

SEQ ID NO: 63640 - DNA, 22 bp, Artificial Sequence
  chemically synthesized
gtagagacagggttttgccatg

SEQ ID NO: 63641 - DNA, 22 bp, Artificial Sequence
  chemically synthesized
tgccatgttggccaggctggtc

SEQ ID NO: 63642 - DNA, 22 bp, Artificial Sequence
  chemically synthesized
gccatgttggccaggctggtct

SEQ ID NO: 63643 - DNA, 22 bp, Artificial Sequence
  chemically synthesized
ccatgttggccaggctggtctt

SEQ ID NO: 63644 - DNA, 22 bp, Artificial Sequence
  chemically synthesized
gccaggctggtcttgaactcct

SEQ ID NO: 63645 - DNA, 22 bp, Artificial Sequence
  chemically synthesized
gtcttgaactcctcacctcagg

SEQ ID NO: 63646 - DNA, 22 bp, Artificial Sequence
  chemically synthesized
gaactcctcacctcaggtgatc

SEQ ID NO: 63647 - DNA, 22 bp, Artificial Sequence
  chemically synthesized
aactcctcacctcaggtgatcc

SEQ ID NO: 63648 - DNA, 22 bp, Artificial Sequence
  chemically synthesized
ctcacctcaggtgatccacccg

SEQ ID NO: 63649 - DNA, 22 bp, Artificial Sequence
  chemically synthesized
acctcaggtgatccacccgcct

SEQ ID NO: 63650 - DNA, 22 bp, Artificial Sequence
  chemically synthesized
aggtgatccacccgcctcagcc

SEQ ID NO: 63651 - DNA, 22 bp, Artificial Sequence
  chemically synthesized
agcctcccaaagtgctgggatt

SEQ ID NO: 63652 - DNA, 22 bp, Artificial Sequence
  chemically synthesized
ccaaagtgctgggattacaggg

SEQ ID NO: 63653 - DNA, 22 bp, Artificial Sequence
  chemically synthesized
ggattacagggtgagccaccgt

SEQ ID NO: 63654 - DNA, 22 bp, Artificial Sequence
  chemically synthesized
cagggtgagccaccgtgcctgg

SEQ ID NO: 63655 - DNA, 22 bp, Artificial Sequence
  chemically synthesized
gcctatcctacatattaatagt

SEQ ID NO: 63656 - DNA, 22 bp, Artificial Sequence
  chemically synthesized
tcctacatattaatagtttact

SEQ ID NO: 63657 - DNA, 22 bp, Artificial Sequence
  chemically synthesized
catattaatagtttactttttt

SEQ ID NO: 63658 - DNA, 22 bp, Artificial Sequence
  chemically synthesized
atagtttactttttttttgaga

SEQ ID NO: 63659 - DNA, 22 bp, Artificial Sequence
  chemically synthesized
actttttttttgagacagagtc

SEQ ID NO: 63660 - DNA, 22 bp, Artificial Sequence
  chemically synthesized
ctttttttttgagacagagtct

SEQ ID NO: 63661 - DNA, 22 bp, Artificial Sequence
  chemically synthesized
tttttttgagacagagtctcgt

SEQ ID NO: 63662 - DNA, 22 bp, Artificial Sequence
  chemically synthesized
ttttttgagacagagtctcgtt

SEQ ID NO: 63663 - DNA, 22 bp, Artificial Sequence
  chemically synthesized
tttttgagacagagtctcgttc

SEQ ID NO: 63664 - DNA, 22 bp, Artificial Sequence
  chemically synthesized
ttttgagacagagtctcgttct

SEQ ID NO: 63665 - DNA, 22 bp, Artificial Sequence
  chemically synthesized
tttgagacagagtctcgttctg

SEQ ID NO: 63666 - DNA, 22 bp, Artificial Sequence
  chemically synthesized
ttgagacagagtctcgttctgt

SEQ ID NO: 63667 - DNA, 22 bp, Artificial Sequence
  chemically synthesized
tgagacagagtctcgttctgtc

SEQ ID NO: 63668 - DNA, 22 bp, Artificial Sequence
  chemically synthesized
gagacagagtctcgttctgtca

SEQ ID NO: 63669 - DNA, 22 bp, Artificial Sequence
  chemically synthesized
agacagagtctcgttctgtcat

SEQ ID NO: 63670 - DNA, 22 bp, Artificial Sequence
  chemically synthesized
gttctgtcattcaggctggagt

SEQ ID NO: 63671 - DNA, 22 bp, Artificial Sequence
  chemically synthesized
tgtcattcaggctggagtgcag

SEQ ID NO: 63672 - DNA, 22 bp, Artificial Sequence
  chemically synthesized
tcattcaggctggagtgcagtg

SEQ ID NO: 63673 - DNA, 22 bp, Artificial Sequence
  chemically synthesized
aggctggagtgcagtggtccga

SEQ ID NO: 63674 - DNA, 22 bp, Artificial Sequence
  chemically synthesized
gagtgcagtggtccgatctcgg

SEQ ID NO: 63675 - DNA, 22 bp, Artificial Sequence
  chemically synthesized
ggttcactgcaacctctgcctc

SEQ ID NO: 63676 - DNA, 22 bp, Artificial Sequence
  chemically synthesized
actgcaacctctgcctcccagg

SEQ ID NO: 63677 - DNA, 22 bp, Artificial Sequence
  chemically synthesized
caacctctgcctcccaggttca

SEQ ID NO: 63678 - DNA, 22 bp, Artificial Sequence
  chemically synthesized
tgcctcccaggttcaagcgatt

SEQ ID NO: 63679 - DNA, 22 bp, Artificial Sequence
  chemically synthesized
cctcccaggttcaagcgattct

SEQ ID NO: 63680 - DNA, 22 bp, Artificial Sequence
  chemically synthesized
ccaggttcaagcgattctcctg

SEQ ID NO: 63681 - DNA, 22 bp, Artificial Sequence
  chemically synthesized
aagcgattctcctgcctcagcc

SEQ ID NO: 63682 - DNA, 22 bp, Artificial Sequence
  chemically synthesized
tcctgcctcagcctcccaggta

SEQ ID NO: 63683 - DNA, 22 bp, Artificial Sequence
  chemically synthesized
ctgcctcagcctcccaggtagc

SEQ ID NO: 63684 - DNA, 22 bp, Artificial Sequence
  chemically synthesized
cctcagcctcccaggtagctga

SEQ ID NO: 63685 - DNA, 22 bp, Artificial Sequence
  chemically synthesized
agcctcccaggtagctgagact

SEQ ID NO: 63686 - DNA, 22 bp, Artificial Sequence
  chemically synthesized
ccaggtagctgagactacaggc

SEQ ID NO: 63687 - DNA, 22 bp, Artificial Sequence
  chemically synthesized
agactacaggcgtgtgccatca

SEQ ID NO: 63688 - DNA, 22 bp, Artificial Sequence
  chemically synthesized
caggcgtgtgccatcacgcctg

SEQ ID NO: 63689 - DNA, 22 bp, Artificial Sequence
  chemically synthesized
accaatttttccatttttagta

SEQ ID NO: 63690 - DNA, 22 bp, Artificial Sequence
  chemically synthesized
ttccatttttagtaaagacagg

SEQ ID NO: 63691 - DNA, 22 bp, Artificial Sequence
  chemically synthesized
tccatttttagtaaagacagga

SEQ ID NO: 63692 - DNA, 22 bp, Artificial Sequence
  chemically synthesized
ccatttttagtaaagacaggat

SEQ ID NO: 63693 - DNA, 22 bp, Artificial Sequence
  chemically synthesized
catttttagtaaagacaggatt

SEQ ID NO: 63694 - DNA, 22 bp, Artificial Sequence
  chemically synthesized
ttagtaaagacaggattttgca

SEQ ID NO: 63695 - DNA, 22 bp, Artificial Sequence
  chemically synthesized
tagtaaagacaggattttgcaa

SEQ ID NO: 63696 - DNA, 22 bp, Artificial Sequence
  chemically synthesized
agtaaagacaggattttgcaat

SEQ ID NO: 63697 - DNA, 22 bp, Artificial Sequence
  chemically synthesized
gtaaagacaggattttgcaatg

SEQ ID NO: 63698 - DNA, 22 bp, Artificial Sequence
  chemically synthesized
tgcaatgttggccaggctggtt

SEQ ID NO: 63699 - DNA, 22 bp, Artificial Sequence
  chemically synthesized
gcaatgttggccaggctggttt

SEQ ID NO: 63700 - DNA, 22 bp, Artificial Sequence
  chemically synthesized
caatgttggccaggctggtttt

SEQ ID NO: 63701 - DNA, 22 bp, Artificial Sequence
  chemically synthesized
gccaggctggttttgaactcct

SEQ ID NO: 63702 - DNA, 22 bp, Artificial Sequence
  chemically synthesized
gttttgaactcctgacctcagg

SEQ ID NO: 63703 - DNA, 22 bp, Artificial Sequence
  chemically synthesized
tgaactcctgacctcaggtgat

SEQ ID NO: 63704 - DNA, 22 bp, Artificial Sequence
  chemically synthesized
gaactcctgacctcaggtgatc

SEQ ID NO: 63705 - DNA, 22 bp, Artificial Sequence
  chemically synthesized
aactcctgacctcaggtgatct

SEQ ID NO: 63706 - DNA, 22 bp, Artificial Sequence
  chemically synthesized
ctgacctcaggtgatctaccta

SEQ ID NO: 63707 - DNA, 22 bp, Artificial Sequence
  chemically synthesized
acctcaggtgatctacctacct

SEQ ID NO: 63708 - DNA, 22 bp, Artificial Sequence
  chemically synthesized
aggtgatctacctaccttggct

SEQ ID NO: 63709 - DNA, 22 bp, Artificial Sequence
  chemically synthesized
cctaccttggcttcccaaagtg

SEQ ID NO: 63710 - DNA, 22 bp, Artificial Sequence
  chemically synthesized
ccttggcttcccaaagtgctgg

SEQ ID NO: 63711 - DNA, 22 bp, Artificial Sequence
  chemically synthesized
ggcttcccaaagtgctgggatt

SEQ ID NO: 63712 - DNA, 22 bp, Artificial Sequence
  chemically synthesized
gcttcccaaagtgctgggatta

SEQ ID NO: 63713 - DNA, 22 bp, Artificial Sequence
  chemically synthesized
cccaaagtgctgggattacagg

SEQ ID NO: 63714 - DNA, 22 bp, Artificial Sequence
  chemically synthesized
ccaaagtgctgggattacaggc

SEQ ID NO: 63715 - DNA, 22 bp, Artificial Sequence
  chemically synthesized
ggattacaggcatgagcaacca

SEQ ID NO: 63716 - DNA, 22 bp, Artificial Sequence
  chemically synthesized
caggcatgagcaaccacaactg

SEQ ID NO: 63717 - DNA, 22 bp, Artificial Sequence
  chemically synthesized
gcctagtttacttatttattat

SEQ ID NO: 63718 - DNA, 22 bp, Artificial Sequence
  chemically synthesized
gtttacttatttattataattt

SEQ ID NO: 63719 - DNA, 22 bp, Artificial Sequence
  chemically synthesized
acttatttattataatttttgt

SEQ ID NO: 63720 - DNA, 22 bp, Artificial Sequence
  chemically synthesized
cttatttattataatttttgta

SEQ ID NO: 63721 - DNA, 22 bp, Artificial Sequence
  chemically synthesized
atttattataatttttgtatat

SEQ ID NO: 63722 - DNA, 22 bp, Artificial Sequence
  chemically synthesized
tttattataatttttgtatatt

SEQ ID NO: 63723 - DNA, 22 bp, Artificial Sequence
  chemically synthesized
attataatttttgtatatttca

SEQ ID NO: 63724 - DNA, 22 bp, Artificial Sequence
  chemically synthesized
ttataatttttgtatatttcac

SEQ ID NO: 63725 - DNA, 22 bp, Artificial Sequence
  chemically synthesized
taatttttgtatatttcacctc

SEQ ID NO: 63726 - DNA, 22 bp, Artificial Sequence
  chemically synthesized
ttgtatatttcacctcctctat

SEQ ID NO: 63727 - DNA, 22 bp, Artificial Sequence
  chemically synthesized
tgtatatttcacctcctctatt

SEQ ID NO: 63728 - DNA, 22 bp, Artificial Sequence
  chemically synthesized
gtatatttcacctcctctattc

SEQ ID NO: 63729 - DNA, 22 bp, Artificial Sequence
  chemically synthesized
tatatttcacctcctctattca

SEQ ID NO: 63730 - DNA, 22 bp, Artificial Sequence
  chemically synthesized
cacctcctctattcagatttca

SEQ ID NO: 63731 - DNA, 22 bp, Artificial Sequence
  chemically synthesized
acctcctctattcagatttcag

SEQ ID NO: 63732 - DNA, 22 bp, Artificial Sequence
  chemically synthesized
ctctattcagatttcagctcca

SEQ ID NO: 63733 - DNA, 22 bp, Artificial Sequence
  chemically synthesized
tattcagatttcagctccacaa

SEQ ID NO: 63734 - DNA, 22 bp, Artificial Sequence
  chemically synthesized
ttcagatttcagctccacaagg

SEQ ID NO: 63735 - DNA, 22 bp, Artificial Sequence
  chemically synthesized
agatttcagctccacaagggca

SEQ ID NO: 63736 - DNA, 22 bp, Artificial Sequence
  chemically synthesized
cagctccacaagggcagggatc

SEQ ID NO: 63737 - DNA, 22 bp, Artificial Sequence
  chemically synthesized
agctccacaagggcagggatct

SEQ ID NO: 63738 - DNA, 22 bp, Artificial Sequence
  chemically synthesized
cacaagggcagggatctttgtg

SEQ ID NO: 63739 - DNA, 22 bp, Artificial Sequence
  chemically synthesized
tgtgtctgtgttgttcactgac

SEQ ID NO: 63740 - DNA, 22 bp, Artificial Sequence
  chemically synthesized
gtgtctgtgttgttcactgaca

SEQ ID NO: 63741 - DNA, 22 bp, Artificial Sequence
  chemically synthesized
tgtctgtgttgttcactgacag

SEQ ID NO: 63742 - DNA, 22 bp, Artificial Sequence
  chemically synthesized
tgttgttcactgacagaggtat

SEQ ID NO: 63743 - DNA, 22 bp, Artificial Sequence
  chemically synthesized
ttcactgacagaggtatcccta

SEQ ID NO: 63744 - DNA, 22 bp, Artificial Sequence
  chemically synthesized
actgacagaggtatccctagca

SEQ ID NO: 63745 - DNA, 22 bp, Artificial Sequence
  chemically synthesized
acagaggtatccctagcacata

SEQ ID NO: 63746 - DNA, 22 bp, Artificial Sequence
  chemically synthesized
gcacatagaacagtgtatagct

SEQ ID NO: 63747 - DNA, 22 bp, Artificial Sequence
  chemically synthesized
ccagtaggtgcttggtaagtaa

SEQ ID NO: 63748 - DNA, 22 bp, Artificial Sequence
  chemically synthesized
ggtaagtaacagctgaatgagt

SEQ ID NO: 63749 - DNA, 22 bp, Artificial Sequence
  chemically synthesized
gtaagtaacagctgaatgagtg

SEQ ID NO: 63750 - DNA, 22 bp, Artificial Sequence
  chemically synthesized
aatgagtgaatatgctctgagg

SEQ ID NO: 63751 - DNA, 22 bp, Artificial Sequence
  chemically synthesized
tgaggtaaatgcgtggtctgtg

SEQ ID NO: 63752 - DNA, 22 bp, Artificial Sequence
  chemically synthesized
aggtaaatgcgtggtctgtgag

SEQ ID NO: 63753 - DNA, 22 bp, Artificial Sequence
  chemically synthesized
tgagagcaaataactaagggac

SEQ ID NO: 63754 - DNA, 22 bp, Artificial Sequence
  chemically synthesized
agggaccttccctagttttggg

SEQ ID NO: 63755 - DNA, 22 bp, Artificial Sequence
  chemically synthesized
ccctagttttggggtcagggaa

SEQ ID NO: 63756 - DNA, 22 bp, Artificial Sequence
  chemically synthesized
cctagttttggggtcagggaaa

SEQ ID NO: 63757 - DNA, 22 bp, Artificial Sequence
  chemically synthesized
gttttggggtcagggaaagggt

SEQ ID NO: 63758 - DNA, 22 bp, Artificial Sequence
  chemically synthesized
tggggtcagggaaagggtctct

SEQ ID NO: 63759 - DNA, 22 bp, Artificial Sequence
  chemically synthesized
ggggtcagggaaagggtctctg

SEQ ID NO: 63760 - DNA, 22 bp, Artificial Sequence
  chemically synthesized
gggtcagggaaagggtctctga

SEQ ID NO: 63761 - DNA, 22 bp, Artificial Sequence
  chemically synthesized
tgaggaagggatactagtacct

SEQ ID NO: 63762 - DNA, 22 bp, Artificial Sequence
  chemically synthesized
aggaagggatactagtacctta

SEQ ID NO: 63763 - DNA, 22 bp, Artificial Sequence
  chemically synthesized
gtaccttagagagtactagtct

SEQ ID NO: 63764 - DNA, 22 bp, Artificial Sequence
  chemically synthesized
agagagtactagtcttagaggg

SEQ ID NO: 63765 - DNA, 22 bp, Artificial Sequence
  chemically synthesized
gagagtactagtcttagagggc

SEQ ID NO: 63766 - DNA, 22 bp, Artificial Sequence
  chemically synthesized
gtcttagagggcagctgagact

SEQ ID NO: 63767 - DNA, 22 bp, Artificial Sequence
  chemically synthesized
agagggcagctgagactttagg

SEQ ID NO: 63768 - DNA, 22 bp, Artificial Sequence
  chemically synthesized
gagggcagctgagactttaggg

SEQ ID NO: 63769 - DNA, 22 bp, Artificial Sequence
  chemically synthesized
agactttagggtgagggagggg

SEQ ID NO: 63770 - DNA, 22 bp, Artificial Sequence
  chemically synthesized
tagggtgagggaggggcttcct

SEQ ID NO: 63771 - DNA, 22 bp, Artificial Sequence
  chemically synthesized
agggtgagggaggggcttccta

SEQ ID NO: 63772 - DNA, 22 bp, Artificial Sequence
  chemically synthesized
gggtgagggaggggcttcctat

SEQ ID NO: 63773 - DNA, 22 bp, Artificial Sequence
  chemically synthesized
cctattacatactgaaaatgaa

SEQ ID NO: 63774 - DNA, 22 bp, Artificial Sequence
  chemically synthesized
ctattacatactgaaaatgaaa

SEQ ID NO: 63775 - DNA, 22 bp, Artificial Sequence
  chemically synthesized
ttacatactgaaaatgaaatct

SEQ ID NO: 63776 - DNA, 22 bp, Artificial Sequence
  chemically synthesized
catactgaaaatgaaatctatc

SEQ ID NO: 63777 - DNA, 22 bp, Artificial Sequence
  chemically synthesized
aaaatgaaatctatcatttgat

SEQ ID NO: 63778 - DNA, 22 bp, Artificial Sequence
  chemically synthesized
tcatttgatttgacagtaacca

SEQ ID NO: 63779 - DNA, 22 bp, Artificial Sequence
  chemically synthesized
gatttgacagtaaccatctggc

SEQ ID NO: 63780 - DNA, 22 bp, Artificial Sequence
  chemically synthesized
atttgacagtaaccatctggct

SEQ ID NO: 63781 - DNA, 22 bp, Artificial Sequence
  chemically synthesized
gacagtaaccatctggctgtaa

SEQ ID NO: 63782 - DNA, 22 bp, Artificial Sequence
  chemically synthesized
acagtaaccatctggctgtaac

SEQ ID NO: 63783 - DNA, 22 bp, Artificial Sequence
  chemically synthesized
gctgtaactaataaaacgtagg

SEQ ID NO: 63784 - DNA, 22 bp, Artificial Sequence
  chemically synthesized
taactaataaaacgtaggcaca

SEQ ID NO: 63785 - DNA, 22 bp, Artificial Sequence
  chemically synthesized
ataaaacgtaggcacagagagg

SEQ ID NO: 63786 - DNA, 22 bp, Artificial Sequence
  chemically synthesized
gacggtcagctcaggagggcac

SEQ ID NO: 63787 - DNA, 22 bp, Artificial Sequence
  chemically synthesized
aggagggcacatccagtgggcc

SEQ ID NO: 63788 - DNA, 22 bp, Artificial Sequence
  chemically synthesized
ggaaggacccccagaagctcag

SEQ ID NO: 63789 - DNA, 22 bp, Artificial Sequence
  chemically synthesized
aggcttctgccccctcctttct

SEQ ID NO: 63790 - DNA, 22 bp, Artificial Sequence
  chemically synthesized
ctgccccctcctttctcaggac

SEQ ID NO: 63791 - DNA, 22 bp, Artificial Sequence
  chemically synthesized
tgccccctcctttctcaggaca

SEQ ID NO: 63792 - DNA, 22 bp, Artificial Sequence
  chemically synthesized
ccccctcctttctcaggacaca

SEQ ID NO: 63793 - DNA, 22 bp, Artificial Sequence
  chemically synthesized
ctttctcaggacacagcgctgc

SEQ ID NO: 63794 - DNA, 22 bp, Artificial Sequence
  chemically synthesized
tctcaggacacagcgctgcagg

SEQ ID NO: 63795 - DNA, 22 bp, Artificial Sequence
  chemically synthesized
ctcaggacacagcgctgcaggg

SEQ ID NO: 63796 - DNA, 22 bp, Artificial Sequence
  chemically synthesized
tcaggacacagcgctgcagggc

SEQ ID NO: 63797 - DNA, 22 bp, Artificial Sequence
  chemically synthesized
aggacacagcgctgcagggcgg

SEQ ID NO: 63798 - DNA, 22 bp, Artificial Sequence
  chemically synthesized
cagggcggtgactctcacgagc

SEQ ID NO: 63799 - DNA, 22 bp, Artificial Sequence
  chemically synthesized
tcacgagccctttgcccatgga

SEQ ID NO: 63800 - DNA, 22 bp, Artificial Sequence
  chemically synthesized
acgagccctttgcccatggatg

SEQ ID NO: 63801 - DNA, 22 bp, Artificial Sequence
  chemically synthesized
tgcccatggatgcccgtgcctc

SEQ ID NO: 63802 - DNA, 22 bp, Artificial Sequence
  chemically synthesized
gcccatggatgcccgtgcctct

SEQ ID NO: 63803 - DNA, 22 bp, Artificial Sequence
  chemically synthesized
cccatggatgcccgtgcctctc

SEQ ID NO: 63804 - DNA, 22 bp, Artificial Sequence
  chemically synthesized
tctggactccatccaggttctg

SEQ ID NO: 63805 - DNA, 22 bp, Artificial Sequence
  chemically synthesized
tggactccatccaggttctgta

SEQ ID NO: 63806 - DNA, 22 bp, Artificial Sequence
  chemically synthesized
gactccatccaggttctgtaat

SEQ ID NO: 63807 - DNA, 22 bp, Artificial Sequence
  chemically synthesized
catccaggttctgtaataggca

SEQ ID NO: 63808 - DNA, 22 bp, Artificial Sequence
  chemically synthesized
tgtaataggcagatttccaata

SEQ ID NO: 63809 - DNA, 22 bp, Artificial Sequence
  chemically synthesized
taataggcagatttccaatact

SEQ ID NO: 63810 - DNA, 22 bp, Artificial Sequence
  chemically synthesized
ccaatactactgtgctattcag

SEQ ID NO: 63811 - DNA, 22 bp, Artificial Sequence
  chemically synthesized
caatactactgtgctattcagg

SEQ ID NO: 63812 - DNA, 22 bp, Artificial Sequence
  chemically synthesized
ctgtgctattcaggaaagtatt

SEQ ID NO: 63813 - DNA, 22 bp, Artificial Sequence
  chemically synthesized
tgctattcaggaaagtattgca

SEQ ID NO: 63814 - DNA, 22 bp, Artificial Sequence
  chemically synthesized
ttcaggaaagtattgcagaagt

SEQ ID NO: 63815 - DNA, 22 bp, Artificial Sequence
  chemically synthesized
aggaaagtattgcagaagtgaa

SEQ ID NO: 63816 - DNA, 22 bp, Artificial Sequence
  chemically synthesized
cagaagtgaattaatttgtgcc

SEQ ID NO: 63817 - DNA, 22 bp, Artificial Sequence
  chemically synthesized
atttgtgccaattgaagagcat

SEQ ID NO: 63818 - DNA, 22 bp, Artificial Sequence
  chemically synthesized
gtgccaattgaagagcatgaca

SEQ ID NO: 63819 - DNA, 22 bp, Artificial Sequence
  chemically synthesized
tgccaattgaagagcatgacaa

SEQ ID NO: 63820 - DNA, 22 bp, Artificial Sequence
  chemically synthesized
aagagcatgacaaaagtacaaa

SEQ ID NO: 63821 - DNA, 22 bp, Artificial Sequence
  chemically synthesized
tcctcatgtcccctcaaggtca

SEQ ID NO: 63822 - DNA, 22 bp, Artificial Sequence
  chemically synthesized
ctcatgtcccctcaaggtcagt

SEQ ID NO: 63823 - DNA, 22 bp, Artificial Sequence
  chemically synthesized
atgtcccctcaaggtcagtttc

SEQ ID NO: 63824 - DNA, 22 bp, Artificial Sequence
  chemically synthesized
aaggtcagtttcatccataaca

SEQ ID NO: 63825 - DNA, 22 bp, Artificial Sequence
  chemically synthesized
catccataacaggtaaacgagg

SEQ ID NO: 63826 - DNA, 22 bp, Artificial Sequence
  chemically synthesized
atccataacaggtaaacgaggt

SEQ ID NO: 63827 - DNA, 22 bp, Artificial Sequence
  chemically synthesized
agcttctgtctgcaggggctgg

SEQ ID NO: 63828 - DNA, 22 bp, Artificial Sequence
  chemically synthesized
ctgtctgcaggggctgggacgc

SEQ ID NO: 63829 - DNA, 22 bp, Artificial Sequence
  chemically synthesized
tgtctgcaggggctgggacgct

SEQ ID NO: 63830 - DNA, 22 bp, Artificial Sequence
  chemically synthesized
tctgcaggggctgggacgctta

SEQ ID NO: 63831 - DNA, 22 bp, Artificial Sequence
  chemically synthesized
caggggctgggacgcttacctg

SEQ ID NO: 63832 - DNA, 22 bp, Artificial Sequence
  chemically synthesized
ggacgcttacctggtccagtct

SEQ ID NO: 63833 - DNA, 22 bp, Artificial Sequence
  chemically synthesized
acctggtccagtctcacaggtt

SEQ ID NO: 63834 - DNA, 22 bp, Artificial Sequence
  chemically synthesized
cctggtccagtctcacaggtta

SEQ ID NO: 63835 - DNA, 22 bp, Artificial Sequence
  chemically synthesized
gtccagtctcacaggttacagg

SEQ ID NO: 63836 - DNA, 22 bp, Artificial Sequence
  chemically synthesized
acaggttacagggaactgcttt

SEQ ID NO: 63837 - DNA, 22 bp, Artificial Sequence
  chemically synthesized
cagggaactgctttatcagggg

SEQ ID NO: 63838 - DNA, 22 bp, Artificial Sequence
  chemically synthesized
ctttatcaggggcacggaagtg

SEQ ID NO: 63839 - DNA, 22 bp, Artificial Sequence
  chemically synthesized
tatcaggggcacggaagtgttg

SEQ ID NO: 63840 - DNA, 22 bp, Artificial Sequence
  chemically synthesized
atcaggggcacggaagtgttgc

SEQ ID NO: 63841 - DNA, 22 bp, Artificial Sequence
  chemically synthesized
tcaggggcacggaagtgttgct

SEQ ID NO: 63842 - DNA, 22 bp, Artificial Sequence
  chemically synthesized
ctgtagtagtcagtatccaaaa

SEQ ID NO: 63843 - DNA, 22 bp, Artificial Sequence
  chemically synthesized
tagtagtcagtatccaaaaccc

SEQ ID NO: 63844 - DNA, 22 bp, Artificial Sequence
  chemically synthesized
tccaaagagaatcctatggaaa

SEQ ID NO: 63845 - DNA, 22 bp, Artificial Sequence
  chemically synthesized
tggaaaaacagaacaagtttct

SEQ ID NO: 63846 - DNA, 22 bp, Artificial Sequence
  chemically synthesized
ctggggttactgaatgaatgct

SEQ ID NO: 63847 - DNA, 22 bp, Artificial Sequence
  chemically synthesized
tggggttactgaatgaatgctt

SEQ ID NO: 63848 - DNA, 22 bp, Artificial Sequence
  chemically synthesized
gggttactgaatgaatgctttt

SEQ ID NO: 63849 - DNA, 22 bp, Artificial Sequence
  chemically synthesized
ctgaatgaatgcttttgcccaa

SEQ ID NO: 63850 - DNA, 22 bp, Artificial Sequence
  chemically synthesized
aatgaatgcttttgcccaaagc

SEQ ID NO: 63851 - DNA, 22 bp, Artificial Sequence
  chemically synthesized
ttgcccaaagcctacaccttca

SEQ ID NO: 63852 - DNA, 22 bp, Artificial Sequence
  chemically synthesized
tgcccaaagcctacaccttcaa

SEQ ID NO: 63853 - DNA, 22 bp, Artificial Sequence
  chemically synthesized
gcccaaagcctacaccttcaag

SEQ ID NO: 63854 - DNA, 22 bp, Artificial Sequence
  chemically synthesized
cccaaagcctacaccttcaaga

SEQ ID NO: 63855 - DNA, 22 bp, Artificial Sequence
  chemically synthesized
caccttcaagaagagtgtagcc

SEQ ID NO: 63856 - DNA, 22 bp, Artificial Sequence
  chemically synthesized
caagaagagtgtagcctgagaa

SEQ ID NO: 63857 - DNA, 22 bp, Artificial Sequence
  chemically synthesized
aagaagagtgtagcctgagaag

SEQ ID NO: 63858 - DNA, 22 bp, Artificial Sequence
  chemically synthesized
agaaggatttcacatgttgcct

SEQ ID NO: 63859 - DNA, 22 bp, Artificial Sequence
  chemically synthesized
cacatgttgcctctagaaggga

SEQ ID NO: 63860 - DNA, 22 bp, Artificial Sequence
  chemically synthesized
acatgttgcctctagaagggag

SEQ ID NO: 63861 - DNA, 22 bp, Artificial Sequence
  chemically synthesized
cctctagaagggagaactgggt

SEQ ID NO: 63862 - DNA, 22 bp, Artificial Sequence
  chemically synthesized
tagaagggagaactgggtggct

SEQ ID NO: 63863 - DNA, 22 bp, Artificial Sequence
  chemically synthesized
gaagggagaactgggtggctgg

SEQ ID NO: 63864 - DNA, 22 bp, Artificial Sequence
  chemically synthesized
ggtggctggggagaagtgtgag

SEQ ID NO: 63865 - DNA, 22 bp, Artificial Sequence
  chemically synthesized
gggagaagtgtgagagggagat

SEQ ID NO: 63866 - DNA, 22 bp, Artificial Sequence
  chemically synthesized
catgacacttccttatgtatgt

SEQ ID NO: 63867 - DNA, 22 bp, Artificial Sequence
  chemically synthesized
atgacacttccttatgtatgta

SEQ ID NO: 63868 - DNA, 22 bp, Artificial Sequence
  chemically synthesized
ccttatgtatgtaacttttgca

SEQ ID NO: 63869 - DNA, 22 bp, Artificial Sequence
  chemically synthesized
cttatgtatgtaacttttgcat

SEQ ID NO: 63870 - DNA, 22 bp, Artificial Sequence
  chemically synthesized
atgtatgtaacttttgcatttt

SEQ ID NO: 63871 - DNA, 22 bp, Artificial Sequence
  chemically synthesized
tgtatgtaacttttgcattttg

SEQ ID NO: 63872 - DNA, 22 bp, Artificial Sequence
  chemically synthesized
ttgcattttgaactgtttgaat

SEQ ID NO: 63873 - DNA, 22 bp, Artificial Sequence
  chemically synthesized
tgcattttgaactgtttgaatg

SEQ ID NO: 63874 - DNA, 22 bp, Artificial Sequence
  chemically synthesized
gcattttgaactgtttgaatgt

SEQ ID NO: 63875 - DNA, 22 bp, Artificial Sequence
  chemically synthesized
cattttgaactgtttgaatgta

SEQ ID NO: 63876 - DNA, 22 bp, Artificial Sequence
  chemically synthesized
tgaactgtttgaatgtattatc

SEQ ID NO: 63877 - DNA, 22 bp, Artificial Sequence
  chemically synthesized
gaactgtttgaatgtattatct

SEQ ID NO: 63878 - DNA, 22 bp, Artificial Sequence
  chemically synthesized
aactgtttgaatgtattatctt

SEQ ID NO: 63879 - DNA, 22 bp, Artificial Sequence
  chemically synthesized
tttgaatgtattatcttttttt

SEQ ID NO: 63880 - DNA, 22 bp, Artificial Sequence
  chemically synthesized
gaatgtattatctttttttttt

SEQ ID NO: 63881 - DNA, 22 bp, Artificial Sequence
  chemically synthesized
aatgtattatcttttttttttt

SEQ ID NO: 63882 - DNA, 22 bp, Artificial Sequence
  chemically synthesized
tcttttttttttttgagacagg

SEQ ID NO: 63883 - DNA, 22 bp, Artificial Sequence
  chemically synthesized
ttttttttttgagacaggatct

SEQ ID NO: 63884 - DNA, 22 bp, Artificial Sequence
  chemically synthesized
tttttttttgagacaggatctg

SEQ ID NO: 63885 - DNA, 22 bp, Artificial Sequence
  chemically synthesized
ttttttttgagacaggatctgg

SEQ ID NO: 63886 - DNA, 22 bp, Artificial Sequence
  chemically synthesized
tttttttgagacaggatctggc

SEQ ID NO: 63887 - DNA, 22 bp, Artificial Sequence
  chemically synthesized
ttttttgagacaggatctggct

SEQ ID NO: 63888 - DNA, 22 bp, Artificial Sequence
  chemically synthesized
tttttgagacaggatctggctc

SEQ ID NO: 63889 - DNA, 22 bp, Artificial Sequence
  chemically synthesized
ttttgagacaggatctggctca

SEQ ID NO: 63890 - DNA, 22 bp, Artificial Sequence
  chemically synthesized
tttgagacaggatctggctcag

SEQ ID NO: 63891 - DNA, 22 bp, Artificial Sequence
  chemically synthesized
ttgagacaggatctggctcagt

SEQ ID NO: 63892 - DNA, 22 bp, Artificial Sequence
  chemically synthesized
tgagacaggatctggctcagta

SEQ ID NO: 63893 - DNA, 22 bp, Artificial Sequence
  chemically synthesized
gagacaggatctggctcagtaa

SEQ ID NO: 63894 - DNA, 22 bp, Artificial Sequence
  chemically synthesized
agacaggatctggctcagtaac

SEQ ID NO: 63895 - DNA, 22 bp, Artificial Sequence
  chemically synthesized
gctcagtaacccagcctggagt

SEQ ID NO: 63896 - DNA, 22 bp, Artificial Sequence
  chemically synthesized
agtaacccagcctggagtgcag

SEQ ID NO: 63897 - DNA, 22 bp, Artificial Sequence
  chemically synthesized
gagtgcagtggcgcaatctcgg

SEQ ID NO: 63898 - DNA, 22 bp, Artificial Sequence
  chemically synthesized
ggctcattgtgacctctacctc

SEQ ID NO: 63899 - DNA, 22 bp, Artificial Sequence
  chemically synthesized
attgtgacctctacctcctggg

SEQ ID NO: 63900 - DNA, 22 bp, Artificial Sequence
  chemically synthesized
tgacctctacctcctgggatcc

SEQ ID NO: 63901 - DNA, 22 bp, Artificial Sequence
  chemically synthesized
tacctcctgggatcctcccacc

SEQ ID NO: 63902 - DNA, 22 bp, Artificial Sequence
  chemically synthesized
cctcctgggatcctcccacctc

SEQ ID NO: 63903 - DNA, 22 bp, Artificial Sequence
  chemically synthesized
ctgggatcctcccacctcagcc

SEQ ID NO: 63904 - DNA, 22 bp, Artificial Sequence
  chemically synthesized
ggatcctcccacctcagcctcc

SEQ ID NO: 63905 - DNA, 22 bp, Artificial Sequence
  chemically synthesized
ccacctcagcctcctgaatagc

SEQ ID NO: 63906 - DNA, 22 bp, Artificial Sequence
  chemically synthesized
agcctcctgaatagctgggact

SEQ ID NO: 63907 - DNA, 22 bp, Artificial Sequence
  chemically synthesized
ctgaatagctgggactacaggt

SEQ ID NO: 63908 - DNA, 22 bp, Artificial Sequence
  chemically synthesized
aatagctgggactacaggtgtg

SEQ ID NO: 63909 - DNA, 22 bp, Artificial Sequence
  chemically synthesized
ggactacaggtgtgtgccacca

SEQ ID NO: 63910 - DNA, 22 bp, Artificial Sequence
  chemically synthesized
caggtgtgtgccaccacatcca

SEQ ID NO: 63911 - DNA, 22 bp, Artificial Sequence
  chemically synthesized
gtttttgtatttttagtagaga

SEQ ID NO: 63912 - DNA, 22 bp, Artificial Sequence
  chemically synthesized
ttgtatttttagtagagacggg

SEQ ID NO: 63913 - DNA, 22 bp, Artificial Sequence
  chemically synthesized
tgtatttttagtagagacgggg

SEQ ID NO: 63914 - DNA, 22 bp, Artificial Sequence
  chemically synthesized
gtatttttagtagagacggggt

SEQ ID NO: 63915 - DNA, 22 bp, Artificial Sequence
  chemically synthesized
tatttttagtagagacggggtt

SEQ ID NO: 63916 - DNA, 22 bp, Artificial Sequence
  chemically synthesized
ttagtagagacggggtttcacc

SEQ ID NO: 63917 - DNA, 22 bp, Artificial Sequence
  chemically synthesized
tagtagagacggggtttcacca

SEQ ID NO: 63918 - DNA, 22 bp, Artificial Sequence
  chemically synthesized
agtagagacggggtttcaccat

SEQ ID NO: 63919 - DNA, 22 bp, Artificial Sequence
  chemically synthesized
gtagagacggggtttcaccatg

SEQ ID NO: 63920 - DNA, 22 bp, Artificial Sequence
  chemically synthesized
caccatgttgcccaggctggtc

SEQ ID NO: 63921 - DNA, 22 bp, Artificial Sequence
  chemically synthesized
accatgttgcccaggctggtct

SEQ ID NO: 63922 - DNA, 22 bp, Artificial Sequence
  chemically synthesized
cccaggctggtctccatctcct

SEQ ID NO: 63923 - DNA, 22 bp, Artificial Sequence
  chemically synthesized
gtctccatctcctgaactcagg

SEQ ID NO: 63924 - DNA, 22 bp, Artificial Sequence
  chemically synthesized
catctcctgaactcaggcaatc

SEQ ID NO: 63925 - DNA, 22 bp, Artificial Sequence
  chemically synthesized
ctgaactcaggcaatcctccca

SEQ ID NO: 63926 - DNA, 22 bp, Artificial Sequence
  chemically synthesized
aactcaggcaatcctcccacct

SEQ ID NO: 63927 - DNA, 22 bp, Artificial Sequence
  chemically synthesized
aggcaatcctcccacctcagcc

SEQ ID NO: 63928 - DNA, 22 bp, Artificial Sequence
  chemically synthesized
ccacctcagcctcccaaagtgc

SEQ ID NO: 63929 - DNA, 22 bp, Artificial Sequence
  chemically synthesized
agcctcccaaagtgctgggatt

SEQ ID NO: 63930 - DNA, 22 bp, Artificial Sequence
  chemically synthesized
ccaaagtgctgggattacaggc

SEQ ID NO: 63931 - DNA, 22 bp, Artificial Sequence
  chemically synthesized
ggattacaggcatgagccaccg

SEQ ID NO: 63932 - DNA, 22 bp, Artificial Sequence
  chemically synthesized
caggcatgagccaccgtgcctg

SEQ ID NO: 63933 - DNA, 22 bp, Artificial Sequence
  chemically synthesized
actgtatgatctatttaaacac

SEQ ID NO: 63934 - DNA, 22 bp, Artificial Sequence
  chemically synthesized
tatgatctatttaaacacaaat

SEQ ID NO: 63935 - DNA, 22 bp, Artificial Sequence
  chemically synthesized
tttaaacacaaataatgaagcc

SEQ ID NO: 63936 - DNA, 22 bp, Artificial Sequence
  chemically synthesized
aaacacaaataatgaagcccaa

SEQ ID NO: 63937 - DNA, 22 bp, Artificial Sequence
  chemically synthesized
aacacaaataatgaagcccaag

SEQ ID NO: 63938 - DNA, 22 bp, Artificial Sequence
  chemically synthesized
tgaactccaggcaggcgcggtg

SEQ ID NO: 63939 - DNA, 22 bp, Artificial Sequence
  chemically synthesized
aactccaggcaggcgcggtggc

SEQ ID NO: 63940 - DNA, 22 bp, Artificial Sequence
  chemically synthesized
caggcaggcgcggtggctcaca

SEQ ID NO: 63941 - DNA, 22 bp, Artificial Sequence
  chemically synthesized
acacctgtaatctcagcacttt

SEQ ID NO: 63942 - DNA, 22 bp, Artificial Sequence
  chemically synthesized
taatctcagcactttgggaggc

SEQ ID NO: 63943 - DNA, 22 bp, Artificial Sequence
  chemically synthesized
agcactttgggaggccaaggca

SEQ ID NO: 63944 - DNA, 22 bp, Artificial Sequence
  chemically synthesized
tgggaggccaaggcaggcagat

SEQ ID NO: 63945 - DNA, 22 bp, Artificial Sequence
  chemically synthesized
gggaggccaaggcaggcagatc

SEQ ID NO: 63946 - DNA, 22 bp, Artificial Sequence
  chemically synthesized
ggaggccaaggcaggcagatca

SEQ ID NO: 63947 - DNA, 22 bp, Artificial Sequence
  chemically synthesized
gagaccagcctggccaacatgg

SEQ ID NO: 63948 - DNA, 22 bp, Artificial Sequence
  chemically synthesized
agaccagcctggccaacatggt

SEQ ID NO: 63949 - DNA, 22 bp, Artificial Sequence
  chemically synthesized
gccaacatggtgaaacaccgtt

SEQ ID NO: 63950 - DNA, 22 bp, Artificial Sequence
  chemically synthesized
ctaccaaaaaatataaagaatt

SEQ ID NO: 63951 - DNA, 22 bp, Artificial Sequence
  chemically synthesized
taccaaaaaatataaagaatta

SEQ ID NO: 63952 - DNA, 22 bp, Artificial Sequence
  chemically synthesized
ccaaaaaatataaagaattagc

SEQ ID NO: 63953 - DNA, 22 bp, Artificial Sequence
  chemically synthesized
gccagatgtggtggtgcgtgac

SEQ ID NO: 63954 - DNA, 22 bp, Artificial Sequence
  chemically synthesized
taatcccagctactcgggaggc

SEQ ID NO: 63955 - DNA, 22 bp, Artificial Sequence
  chemically synthesized
ctcgggaggctaaggcaagaga

SEQ ID NO: 63956 - DNA, 22 bp, Artificial Sequence
  chemically synthesized
gggaggctaaggcaagagaatc

SEQ ID NO: 63957 - DNA, 22 bp, Artificial Sequence
  chemically synthesized
aggcaagagaatcgcttgaacc

SEQ ID NO: 63958 - DNA, 22 bp, Artificial Sequence
  chemically synthesized
gaacctgggaggcggaggttgc

SEQ ID NO: 63959 - DNA, 22 bp, Artificial Sequence
  chemically synthesized
aacctgggaggcggaggttgcc

SEQ ID NO: 63960 - DNA, 22 bp, Artificial Sequence
  chemically synthesized
ggaggcggaggttgccgtgagc

SEQ ID NO: 63961 - DNA, 22 bp, Artificial Sequence
  chemically synthesized
ccgtgagccgagattatgccac

SEQ ID NO: 63962 - DNA, 22 bp, Artificial Sequence
  chemically synthesized
tgccactgcactacaggctggg

SEQ ID NO: 63963 - DNA, 22 bp, Artificial Sequence
  chemically synthesized
cactacaggctgggtgacagag

SEQ ID NO: 63964 - DNA, 22 bp, Artificial Sequence
  chemically synthesized
caggctgggtgacagagcaaga

SEQ ID NO: 63965 - DNA, 22 bp, Artificial Sequence
  chemically synthesized
ggtgacagagcaagactccatc

SEQ ID NO: 63966 - DNA, 22 bp, Artificial Sequence
  chemically synthesized
catctcaaaaaaaaaaaaaaaa

SEQ ID NO: 63967 - DNA, 22 bp, Artificial Sequence
  chemically synthesized
aaaaaaaaaaaaaaaaaaatcc

SEQ ID NO: 63968 - DNA, 22 bp, Artificial Sequence
  chemically synthesized
aaatccataaaatggcagctat

SEQ ID NO: 63969 - DNA, 22 bp, Artificial Sequence
  chemically synthesized
tgtgactttttttttttaacct

SEQ ID NO: 63970 - DNA, 22 bp, Artificial Sequence
  chemically synthesized
tttttttttaacctcaagaagt

SEQ ID NO: 63971 - DNA, 22 bp, Artificial Sequence
  chemically synthesized
ttttttttaacctcaagaagta

SEQ ID NO: 63972 - DNA, 22 bp, Artificial Sequence
  chemically synthesized
tttttttaacctcaagaagtat

SEQ ID NO: 63973 - DNA, 22 bp, Artificial Sequence
  chemically synthesized
ttttttaacctcaagaagtatt

SEQ ID NO: 63974 - DNA, 22 bp, Artificial Sequence
  chemically synthesized
tttttaacctcaagaagtattt

SEQ ID NO: 63975 - DNA, 22 bp, Artificial Sequence
  chemically synthesized
ttttaacctcaagaagtatttg

SEQ ID NO: 63976 - DNA, 22 bp, Artificial Sequence
  chemically synthesized
tttaacctcaagaagtatttgt

SEQ ID NO: 63977 - DNA, 22 bp, Artificial Sequence
  chemically synthesized
ttaacctcaagaagtatttgtc

SEQ ID NO: 63978 - DNA, 22 bp, Artificial Sequence
  chemically synthesized
taacctcaagaagtatttgtcc

SEQ ID NO: 63979 - DNA, 22 bp, Artificial Sequence
  chemically synthesized
aacctcaagaagtatttgtcct

SEQ ID NO: 63980 - DNA, 22 bp, Artificial Sequence
  chemically synthesized
acctcaagaagtatttgtcctg

SEQ ID NO: 63981 - DNA, 22 bp, Artificial Sequence
  chemically synthesized
aagaagtatttgtcctggaaga

SEQ ID NO: 63982 - DNA, 22 bp, Artificial Sequence
  chemically synthesized
gtcctggaagaatgcatatgga

SEQ ID NO: 63983 - DNA, 22 bp, Artificial Sequence
  chemically synthesized
tcctggaagaatgcatatggaa

SEQ ID NO: 63984 - DNA, 22 bp, Artificial Sequence
  chemically synthesized
gaagaatgcatatggaactaca

SEQ ID NO: 63985 - DNA, 22 bp, Artificial Sequence
  chemically synthesized
cagtttgaaacttggacttgca

SEQ ID NO: 63986 - DNA, 22 bp, Artificial Sequence
  chemically synthesized
gaaacttggacttgcatatacc

SEQ ID NO: 63987 - DNA, 22 bp, Artificial Sequence
  chemically synthesized
aaacttggacttgcatatacca

SEQ ID NO: 63988 - DNA, 22 bp, Artificial Sequence
  chemically synthesized
ggacttgcatataccatgggtt

SEQ ID NO: 63989 - DNA, 22 bp, Artificial Sequence
  chemically synthesized
gacttgcatataccatgggttc

SEQ ID NO: 63990 - DNA, 22 bp, Artificial Sequence
  chemically synthesized
gcatataccatgggttccctca

SEQ ID NO: 63991 - DNA, 22 bp, Artificial Sequence
  chemically synthesized
catataccatgggttccctcag

SEQ ID NO: 63992 - DNA, 22 bp, Artificial Sequence
  chemically synthesized
cctcaggcctcagggaatcttg

SEQ ID NO: 63993 - DNA, 22 bp, Artificial Sequence
  chemically synthesized
aggcctcagggaatcttgcatt

SEQ ID NO: 63994 - DNA, 22 bp, Artificial Sequence
  chemically synthesized
agggaatcttgcatttcctctg

SEQ ID NO: 63995 - DNA, 22 bp, Artificial Sequence
  chemically synthesized
gcatttcctctgacatcagaga

SEQ ID NO: 63996 - DNA, 22 bp, Artificial Sequence
  chemically synthesized
catttcctctgacatcagagaa

SEQ ID NO: 63997 - DNA, 22 bp, Artificial Sequence
  chemically synthesized
cctctgacatcagagaatgcac

SEQ ID NO: 63998 - DNA, 22 bp, Artificial Sequence
  chemically synthesized
ctctgacatcagagaatgcact

SEQ ID NO: 63999 - DNA, 22 bp, Artificial Sequence
  chemically synthesized
tgacatcagagaatgcactcca

SEQ ID NO: 64000 - DNA, 22 bp, Artificial Sequence
  chemically synthesized
acatcagagaatgcactccagc

SEQ ID NO: 64001 - DNA, 22 bp, Artificial Sequence
  chemically synthesized
cagcccctaggacgagcccccc

SEQ ID NO: 64002 - DNA, 22 bp, Artificial Sequence
  chemically synthesized
ggacgagccccccccagggaaa

SEQ ID NO: 64003 - DNA, 22 bp, Artificial Sequence
  chemically synthesized
catttccatcagaattgctctc

SEQ ID NO: 64004 - DNA, 22 bp, Artificial Sequence
  chemically synthesized
ccatcagaattgctctctgtaa

SEQ ID NO: 64005 - DNA, 22 bp, Artificial Sequence
  chemically synthesized
catcagaattgctctctgtaag

SEQ ID NO: 64006 - DNA, 22 bp, Artificial Sequence
  chemically synthesized
ctctctgtaaggatgtatatag

SEQ ID NO: 64007 - DNA, 22 bp, Artificial Sequence
  chemically synthesized
tctgtaaggatgtatatagctt

SEQ ID NO: 64008 - DNA, 22 bp, Artificial Sequence
  chemically synthesized
tgtaaggatgtatatagcttca

SEQ ID NO: 64009 - DNA, 22 bp, Artificial Sequence
  chemically synthesized
taaggatgtatatagcttcaga

SEQ ID NO: 64010 - DNA, 22 bp, Artificial Sequence
  chemically synthesized
cagatgcttgttctgtatcctc

SEQ ID NO: 64011 - DNA, 22 bp, Artificial Sequence
  chemically synthesized
agatgcttgttctgtatcctct

SEQ ID NO: 64012 - DNA, 22 bp, Artificial Sequence
  chemically synthesized
gttctgtatcctctctactttg

SEQ ID NO: 64013 - DNA, 22 bp, Artificial Sequence
  chemically synthesized
ttctgtatcctctctactttga

SEQ ID NO: 64014 - DNA, 22 bp, Artificial Sequence
  chemically synthesized
tgtatcctctctactttgaaac

SEQ ID NO: 64015 - DNA, 22 bp, Artificial Sequence
  chemically synthesized
tatcctctctactttgaaacag

SEQ ID NO: 64016 - DNA, 22 bp, Artificial Sequence
  chemically synthesized
tctactttgaaacagagtatct

SEQ ID NO: 64017 - DNA, 22 bp, Artificial Sequence
  chemically synthesized
tactttgaaacagagtatctca

SEQ ID NO: 64018 - DNA, 22 bp, Artificial Sequence
  chemically synthesized
ctttgaaacagagtatctcaga

SEQ ID NO: 64019 - DNA, 22 bp, Artificial Sequence
  chemically synthesized
tgaaacagagtatctcagacaa

SEQ ID NO: 64020 - DNA, 22 bp, Artificial Sequence
  chemically synthesized
gaaacagagtatctcagacaaa

SEQ ID NO: 64021 - DNA, 22 bp, Artificial Sequence
  chemically synthesized
aaacagagtatctcagacaaac

SEQ ID NO: 64022 - DNA, 22 bp, Artificial Sequence
  chemically synthesized
agacaaaccacttcccctttaa

SEQ ID NO: 64023 - DNA, 22 bp, Artificial Sequence
  chemically synthesized
cccctttaaaagtactagatat

SEQ ID NO: 64024 - DNA, 22 bp, Artificial Sequence
  chemically synthesized
ccctttaaaagtactagatata

SEQ ID NO: 64025 - DNA, 22 bp, Artificial Sequence
  chemically synthesized
taaaagtactagatatatcttt

SEQ ID NO: 64026 - DNA, 22 bp, Artificial Sequence
  chemically synthesized
aaaagtactagatatatctttc

SEQ ID NO: 64027 - DNA, 22 bp, Artificial Sequence
  chemically synthesized
aaagtactagatatatctttca

SEQ ID NO: 64028 - DNA, 22 bp, Artificial Sequence
  chemically synthesized
gatatatctttcactgtggaaa

SEQ ID NO: 64029 - DNA, 22 bp, Artificial Sequence
  chemically synthesized
tcactgtggaaataggtgtcaa

SEQ ID NO: 64030 - DNA, 22 bp, Artificial Sequence
  chemically synthesized
cactgtggaaataggtgtcaac

SEQ ID NO: 64031 - DNA, 22 bp, Artificial Sequence
  chemically synthesized
actgtggaaataggtgtcaacc

SEQ ID NO: 64032 - DNA, 22 bp, Artificial Sequence
  chemically synthesized
tggaaataggtgtcaaccgcca

SEQ ID NO: 64033 - DNA, 22 bp, Artificial Sequence
  chemically synthesized
ttatcccgtgatggtggaatag

SEQ ID NO: 64034 - DNA, 22 bp, Artificial Sequence
  chemically synthesized
tatcccgtgatggtggaatagt

SEQ ID NO: 64035 - DNA, 22 bp, Artificial Sequence
  chemically synthesized
atcccgtgatggtggaatagtg

SEQ ID NO: 64036 - DNA, 22 bp, Artificial Sequence
  chemically synthesized
tcccgtgatggtggaatagtga

SEQ ID NO: 64037 - DNA, 22 bp, Artificial Sequence
  chemically synthesized
ctcaccgaaatcagggagagcc

SEQ ID NO: 64038 - DNA, 22 bp, Artificial Sequence
  chemically synthesized
tcaccgaaatcagggagagcca

SEQ ID NO: 64039 - DNA, 22 bp, Artificial Sequence
  chemically synthesized
accgaaatcagggagagccact

SEQ ID NO: 64040 - DNA, 22 bp, Artificial Sequence
  chemically synthesized
actctggcctctatcaacccag

SEQ ID NO: 64041 - DNA, 22 bp, Artificial Sequence
  chemically synthesized
tggcctctatcaacccagagag

SEQ ID NO: 64042 - DNA, 22 bp, Artificial Sequence
  chemically synthesized
gcctctatcaacccagagagat

SEQ ID NO: 64043 - DNA, 22 bp, Artificial Sequence
  chemically synthesized
tatcaacccagagagattgcat

SEQ ID NO: 64044 - DNA, 22 bp, Artificial Sequence
  chemically synthesized
tcaacccagagagattgcatgg

SEQ ID NO: 64045 - DNA, 22 bp, Artificial Sequence
  chemically synthesized
catggttcttcaatggagatca

SEQ ID NO: 64046 - DNA, 22 bp, Artificial Sequence
  chemically synthesized
ttcaatggagatcagatgtttg

SEQ ID NO: 64047 - DNA, 22 bp, Artificial Sequence
  chemically synthesized
caatggagatcagatgtttgga

SEQ ID NO: 64048 - DNA, 22 bp, Artificial Sequence
  chemically synthesized
aatggagatcagatgtttggaa

SEQ ID NO: 64049 - DNA, 22 bp, Artificial Sequence
  chemically synthesized
ggaataacacttcatcttttta

SEQ ID NO: 64050 - DNA, 22 bp, Artificial Sequence
  chemically synthesized
gaataacacttcatctttttat

SEQ ID NO: 64051 - DNA, 22 bp, Artificial Sequence
  chemically synthesized
catctttttattttttagaatc

SEQ ID NO: 64052 - DNA, 22 bp, Artificial Sequence
  chemically synthesized
atctttttattttttagaatca

SEQ ID NO: 64053 - DNA, 22 bp, Artificial Sequence
  chemically synthesized
tttattttttagaatcatgcgg

SEQ ID NO: 64054 - DNA, 22 bp, Artificial Sequence
  chemically synthesized
ttattttttagaatcatgcggc

SEQ ID NO: 64055 - DNA, 22 bp, Artificial Sequence
  chemically synthesized
tattttttagaatcatgcggct

SEQ ID NO: 64056 - DNA, 22 bp, Artificial Sequence
  chemically synthesized
attttttagaatcatgcggctg

SEQ ID NO: 64057 - DNA, 22 bp, Artificial Sequence
  chemically synthesized
ttttttagaatcatgcggctgg

SEQ ID NO: 64058 - DNA, 22 bp, Artificial Sequence
  chemically synthesized
tttagaatcatgcggctgggtg

SEQ ID NO: 64059 - DNA, 22 bp, Artificial Sequence
  chemically synthesized
ttagaatcatgcggctgggtgt

SEQ ID NO: 64060 - DNA, 22 bp, Artificial Sequence
  chemically synthesized
tagaatcatgcggctgggtgta

SEQ ID NO: 64061 - DNA, 22 bp, Artificial Sequence
  chemically synthesized
agaatcatgcggctgggtgtag

SEQ ID NO: 64062 - DNA, 22 bp, Artificial Sequence
  chemically synthesized
gaatcatgcggctgggtgtagt

SEQ ID NO: 64063 - DNA, 22 bp, Artificial Sequence
  chemically synthesized
ggtgtagtggctcacgcctgta

SEQ ID NO: 64064 - DNA, 22 bp, Artificial Sequence
  chemically synthesized
acgcctgtaatcctagcactta

SEQ ID NO: 64065 - DNA, 22 bp, Artificial Sequence
  chemically synthesized
taatcctagcacttagggaggc

SEQ ID NO: 64066 - DNA, 22 bp, Artificial Sequence
  chemically synthesized
gcacttagggaggccaaggcag

SEQ ID NO: 64067 - DNA, 22 bp, Artificial Sequence
  chemically synthesized
agggaggccaaggcaggcagat

SEQ ID NO: 64068 - DNA, 22 bp, Artificial Sequence
  chemically synthesized
gggaggccaaggcaggcagatc

SEQ ID NO: 64069 - DNA, 22 bp, Artificial Sequence
  chemically synthesized
gagaccagcctagtcaacatag

SEQ ID NO: 64070 - DNA, 22 bp, Artificial Sequence
  chemically synthesized
gtcaacatagtgaaaccatgtc

SEQ ID NO: 64071 - DNA, 22 bp, Artificial Sequence
  chemically synthesized
tactaaaaatacaaaaaaaatt

SEQ ID NO: 64072 - DNA, 22 bp, Artificial Sequence
  chemically synthesized
ctaaaaatacaaaaaaaattag

SEQ ID NO: 64073 - DNA, 22 bp, Artificial Sequence
  chemically synthesized
aaaatacaaaaaaaattagctg

SEQ ID NO: 64074 - DNA, 22 bp, Artificial Sequence
  chemically synthesized
gctgggcatggtggcgggcacc

SEQ ID NO: 64075 - DNA, 22 bp, Artificial Sequence
  chemically synthesized
ggcatggtggcgggcacctgta

SEQ ID NO: 64076 - DNA, 22 bp, Artificial Sequence
  chemically synthesized
taatcccagctacttgggaggc

SEQ ID NO: 64077 - DNA, 22 bp, Artificial Sequence
  chemically synthesized
cttgggaggctgaggcaggaga

SEQ ID NO: 64078 - DNA, 22 bp, Artificial Sequence
  chemically synthesized
gggaggctgaggcaggagaatc

SEQ ID NO: 64079 - DNA, 22 bp, Artificial Sequence
  chemically synthesized
ggaggctgaggcaggagaatca

SEQ ID NO: 64080 - DNA, 22 bp, Artificial Sequence
  chemically synthesized
aggcaggagaatcacttgaacc

SEQ ID NO: 64081 - DNA, 22 bp, Artificial Sequence
  chemically synthesized
gaaccggagaggcagaggttgc

SEQ ID NO: 64082 - DNA, 22 bp, Artificial Sequence
  chemically synthesized
aaccggagaggcagaggttgca

SEQ ID NO: 64083 - DNA, 22 bp, Artificial Sequence
  chemically synthesized
cagtgagctgagattgcaccat

SEQ ID NO: 64084 - DNA, 22 bp, Artificial Sequence
  chemically synthesized
agattgcaccattgcactccag

SEQ ID NO: 64085 - DNA, 22 bp, Artificial Sequence
  chemically synthesized
caccattgcactccagccaggc

SEQ ID NO: 64086 - DNA, 22 bp, Artificial Sequence
  chemically synthesized
cactccagccaggcaacagtgc

SEQ ID NO: 64087 - DNA, 22 bp, Artificial Sequence
  chemically synthesized
cagccaggcaacagtgcgagac

SEQ ID NO: 64088 - DNA, 22 bp, Artificial Sequence
  chemically synthesized
catctcaaacaaacaaacaaaa

SEQ ID NO: 64089 - DNA, 22 bp, Artificial Sequence
  chemically synthesized
aaacaaacaaacaaaagaaaga

SEQ ID NO: 64090 - DNA, 22 bp, Artificial Sequence
  chemically synthesized
acgtgatagaaattggcaaatg

SEQ ID NO: 64091 - DNA, 22 bp, Artificial Sequence
  chemically synthesized
cgtgatagaaattggcaaatgc

SEQ ID NO: 64092 - DNA, 22 bp, Artificial Sequence
  chemically synthesized
gcaaatgctaaactcagggctt

SEQ ID NO: 64093 - DNA, 22 bp, Artificial Sequence
  chemically synthesized
aactcagggctttcccctgctc

SEQ ID NO: 64094 - DNA, 22 bp, Artificial Sequence
  chemically synthesized
agggctttcccctgctccccag

SEQ ID NO: 64095 - DNA, 22 bp, Artificial Sequence
  chemically synthesized
tcccctgctccccagagagtca

SEQ ID NO: 64096 - DNA, 22 bp, Artificial Sequence
  chemically synthesized
cccctgctccccagagagtcag

SEQ ID NO: 64097 - DNA, 22 bp, Artificial Sequence
  chemically synthesized
ccctgctccccagagagtcagt

SEQ ID NO: 64098 - DNA, 22 bp, Artificial Sequence
  chemically synthesized
ctccccagagagtcagtttatc

SEQ ID NO: 64099 - DNA, 22 bp, Artificial Sequence
  chemically synthesized
cccagagagtcagtttatcagc

SEQ ID NO: 64100 - DNA, 22 bp, Artificial Sequence
  chemically synthesized
atcagcactggacgtaacatag

SEQ ID NO: 64101 - DNA, 22 bp, Artificial Sequence
  chemically synthesized
tcagcactggacgtaacatagt

SEQ ID NO: 64102 - DNA, 22 bp, Artificial Sequence
  chemically synthesized
gacgtaacatagttcataagag

SEQ ID NO: 64103 - DNA, 22 bp, Artificial Sequence
  chemically synthesized
ataagagcattgccgcggaagc

SEQ ID NO: 64104 - DNA, 22 bp, Artificial Sequence
  chemically synthesized
ccgcggaagccagcctgcctac

SEQ ID NO: 64105 - DNA, 22 bp, Artificial Sequence
  chemically synthesized
cctacctgggcttccatcctgg

SEQ ID NO: 64106 - DNA, 22 bp, Artificial Sequence
  chemically synthesized
cctgggcttccatcctggctcg

SEQ ID NO: 64107 - DNA, 22 bp, Artificial Sequence
  chemically synthesized
ggcttccatcctggctcggcat

SEQ ID NO: 64108 - DNA, 22 bp, Artificial Sequence
  chemically synthesized
ccatcctggctcggcatgtact

SEQ ID NO: 64109 - DNA, 22 bp, Artificial Sequence
  chemically synthesized
catcctggctcggcatgtacta

SEQ ID NO: 64110 - DNA, 22 bp, Artificial Sequence
  chemically synthesized
gctcggcatgtactaaccttgt

SEQ ID NO: 64111 - DNA, 22 bp, Artificial Sequence
  chemically synthesized
ggcatgtactaaccttgttggc

SEQ ID NO: 64112 - DNA, 22 bp, Artificial Sequence
  chemically synthesized
accttgttggcctaatcattta

SEQ ID NO: 64113 - DNA, 22 bp, Artificial Sequence
  chemically synthesized
gttggcctaatcatttaactca

SEQ ID NO: 64114 - DNA, 22 bp, Artificial Sequence
  chemically synthesized
ttggcctaatcatttaactcag

SEQ ID NO: 64115 - DNA, 22 bp, Artificial Sequence
  chemically synthesized
gcctaatcatttaactcagcac

SEQ ID NO: 64116 - DNA, 22 bp, Artificial Sequence
  chemically synthesized
atcatttaactcagcaccttgg

SEQ ID NO: 64117 - DNA, 22 bp, Artificial Sequence
  chemically synthesized
aactcagcaccttggtctctgc

SEQ ID NO: 64118 - DNA, 22 bp, Artificial Sequence
  chemically synthesized
actcagcaccttggtctctgca

SEQ ID NO: 64119 - DNA, 22 bp, Artificial Sequence
  chemically synthesized
agcaccttggtctctgcatcta

SEQ ID NO: 64120 - DNA, 22 bp, Artificial Sequence
  chemically synthesized
ggtctctgcatctactgtttct

SEQ ID NO: 64121 - DNA, 22 bp, Artificial Sequence
  chemically synthesized
gtctctgcatctactgtttctg

SEQ ID NO: 64122 - DNA, 22 bp, Artificial Sequence
  chemically synthesized
tgcatctactgtttctgtaaat

SEQ ID NO: 64123 - DNA, 22 bp, Artificial Sequence
  chemically synthesized
catctactgtttctgtaaatag

SEQ ID NO: 64124 - DNA, 22 bp, Artificial Sequence
  chemically synthesized
ctgtttctgtaaatagcagtaa

SEQ ID NO: 64125 - DNA, 22 bp, Artificial Sequence
  chemically synthesized
tttctgtaaatagcagtaacta

SEQ ID NO: 64126 - DNA, 22 bp, Artificial Sequence
  chemically synthesized
ctgtaaatagcagtaactacct

SEQ ID NO: 64127 - DNA, 22 bp, Artificial Sequence
  chemically synthesized
tgtaaatagcagtaactacctc

SEQ ID NO: 64128 - DNA, 22 bp, Artificial Sequence
  chemically synthesized
taaatagcagtaactacctcac

SEQ ID NO: 64129 - DNA, 22 bp, Artificial Sequence
  chemically synthesized
cctcacagaaaagcacatagca

SEQ ID NO: 64130 - DNA, 22 bp, Artificial Sequence
  chemically synthesized
acagaaaagcacatagcacatg

SEQ ID NO: 64131 - DNA, 22 bp, Artificial Sequence
  chemically synthesized
gcacacactgtttaataaatgt

SEQ ID NO: 64132 - DNA, 22 bp, Artificial Sequence
  chemically synthesized
tttaataaatgttaaccctgat

SEQ ID NO: 64133 - DNA, 22 bp, Artificial Sequence
  chemically synthesized
aataaatgttaaccctgattat

SEQ ID NO: 64134 - DNA, 22 bp, Artificial Sequence
  chemically synthesized
ataaatgttaaccctgattatt

SEQ ID NO: 64135 - DNA, 22 bp, Artificial Sequence
  chemically synthesized
accctgattattattaagctgc

SEQ ID NO: 64136 - DNA, 22 bp, Artificial Sequence
  chemically synthesized
attattattaagctgccagaga

SEQ ID NO: 64137 - DNA, 22 bp, Artificial Sequence
  chemically synthesized
ttattaagctgccagagataac

SEQ ID NO: 64138 - DNA, 22 bp, Artificial Sequence
  chemically synthesized
ttaagctgccagagataaccta

SEQ ID NO: 64139 - DNA, 22 bp, Artificial Sequence
  chemically synthesized
agctgccagagataacctattt

SEQ ID NO: 64140 - DNA, 22 bp, Artificial Sequence
  chemically synthesized
ccagagataacctatttgtaga

SEQ ID NO: 64141 - DNA, 22 bp, Artificial Sequence
  chemically synthesized
tttgtagattataaaacagaaa

SEQ ID NO: 64142 - DNA, 22 bp, Artificial Sequence
  chemically synthesized
gtagattataaaacagaaactc

SEQ ID NO: 64143 - DNA, 22 bp, Artificial Sequence
  chemically synthesized
tagattataaaacagaaactca

SEQ ID NO: 64144 - DNA, 22 bp, Artificial Sequence
  chemically synthesized
taaaacagaaactcagataatt

SEQ ID NO: 64145 - DNA, 22 bp, Artificial Sequence
  chemically synthesized
agataattgatatgacttgcca

SEQ ID NO: 64146 - DNA, 22 bp, Artificial Sequence
  chemically synthesized
atatgacttgccaaggacatgt

SEQ ID NO: 64147 - DNA, 22 bp, Artificial Sequence
  chemically synthesized
gccaaggacatgtagttggtgg

SEQ ID NO: 64148 - DNA, 22 bp, Artificial Sequence
  chemically synthesized
ccaaggacatgtagttggtggg

SEQ ID NO: 64149 - DNA, 22 bp, Artificial Sequence
  chemically synthesized
gtgggtggcagaacgagggctg

SEQ ID NO: 64150 - DNA, 22 bp, Artificial Sequence
  chemically synthesized
gagcccagttcccagggtgact

SEQ ID NO: 64151 - DNA, 22 bp, Artificial Sequence
  chemically synthesized
ccagggtgacttttcattaccc

SEQ ID NO: 64152 - DNA, 22 bp, Artificial Sequence
  chemically synthesized
ttcattaccccacaaaacaggc

SEQ ID NO: 64153 - DNA, 22 bp, Artificial Sequence
  chemically synthesized
tcattaccccacaaaacaggct

SEQ ID NO: 64154 - DNA, 22 bp, Artificial Sequence
  chemically synthesized
cattaccccacaaaacaggctg

SEQ ID NO: 64155 - DNA, 22 bp, Artificial Sequence
  chemically synthesized
attaccccacaaaacaggctgt

SEQ ID NO: 64156 - DNA, 22 bp, Artificial Sequence
  chemically synthesized
ccccacaaaacaggctgttgaa

SEQ ID NO: 64157 - DNA, 22 bp, Artificial Sequence
  chemically synthesized
ttgaatcatctgtgtgtttcct

SEQ ID NO: 64158 - DNA, 22 bp, Artificial Sequence
  chemically synthesized
aatcatctgtgtgtttcctttt

SEQ ID NO: 64159 - DNA, 22 bp, Artificial Sequence
  chemically synthesized
tgtgtttccttttttcatacag

SEQ ID NO: 64160 - DNA, 22 bp, Artificial Sequence
  chemically synthesized
ccttttttcatacagcatacat

SEQ ID NO: 64161 - DNA, 22 bp, Artificial Sequence
  chemically synthesized
cttttttcatacagcatacatc

SEQ ID NO: 64162 - DNA, 22 bp, Artificial Sequence
  chemically synthesized
ttttcatacagcatacatcatc

SEQ ID NO: 64163 - DNA, 22 bp, Artificial Sequence
  chemically synthesized
tttcatacagcatacatcatct

SEQ ID NO: 64164 - DNA, 22 bp, Artificial Sequence
  chemically synthesized
ttcatacagcatacatcatcta

SEQ ID NO: 64165 - DNA, 22 bp, Artificial Sequence
  chemically synthesized
tcatacagcatacatcatctat

SEQ ID NO: 64166 - DNA, 22 bp, Artificial Sequence
  chemically synthesized
catacagcatacatcatctatc

SEQ ID NO: 64167 - DNA, 22 bp, Artificial Sequence
  chemically synthesized
atacagcatacatcatctatct

SEQ ID NO: 64168 - DNA, 22 bp, Artificial Sequence
  chemically synthesized
tcttttttttttttttgagaca

SEQ ID NO: 64169 - DNA, 22 bp, Artificial Sequence
  chemically synthesized
ttttttttttttgagacagggt

SEQ ID NO: 64170 - DNA, 22 bp, Artificial Sequence
  chemically synthesized
tttttttttttgagacagggtc

SEQ ID NO: 64171 - DNA, 22 bp, Artificial Sequence
  chemically synthesized
ttttttttttgagacagggtct

SEQ ID NO: 64172 - DNA, 22 bp, Artificial Sequence
  chemically synthesized
tttttttttgagacagggtctt

SEQ ID NO: 64173 - DNA, 22 bp, Artificial Sequence
  chemically synthesized
ttttttttgagacagggtctta

SEQ ID NO: 64174 - DNA, 22 bp, Artificial Sequence
  chemically synthesized
tttttttgagacagggtcttac

SEQ ID NO: 64175 - DNA, 22 bp, Artificial Sequence
  chemically synthesized
ttttttgagacagggtcttact

SEQ ID NO: 64176 - DNA, 22 bp, Artificial Sequence
  chemically synthesized
tttttgagacagggtcttactc

SEQ ID NO: 64177 - DNA, 22 bp, Artificial Sequence
  chemically synthesized
ttttgagacagggtcttactct

SEQ ID NO: 64178 - DNA, 22 bp, Artificial Sequence
  chemically synthesized
tttgagacagggtcttactctg

SEQ ID NO: 64179 - DNA, 22 bp, Artificial Sequence
  chemically synthesized
ttgagacagggtcttactctgt

SEQ ID NO: 64180 - DNA, 22 bp, Artificial Sequence
  chemically synthesized
tgagacagggtcttactctgtt

SEQ ID NO: 64181 - DNA, 22 bp, Artificial Sequence
  chemically synthesized
gagacagggtcttactctgttg

SEQ ID NO: 64182 - DNA, 22 bp, Artificial Sequence
  chemically synthesized
agacagggtcttactctgttgc

SEQ ID NO: 64183 - DNA, 22 bp, Artificial Sequence
  chemically synthesized
actctgttgcccaggctggagt

SEQ ID NO: 64184 - DNA, 22 bp, Artificial Sequence
  chemically synthesized
ctctgttgcccaggctggagtg

SEQ ID NO: 64185 - DNA, 22 bp, Artificial Sequence
  chemically synthesized
tgttgcccaggctggagtgcag

SEQ ID NO: 64186 - DNA, 22 bp, Artificial Sequence
  chemically synthesized
ttgcccaggctggagtgcagtg

SEQ ID NO: 64187 - DNA, 22 bp, Artificial Sequence
  chemically synthesized
cccaggctggagtgcagtggca

SEQ ID NO: 64188 - DNA, 22 bp, Artificial Sequence
  chemically synthesized
gagtgcagtggcatgatcttga

SEQ ID NO: 64189 - DNA, 22 bp, Artificial Sequence
  chemically synthesized
gactcactgcaacctcctccgc

SEQ ID NO: 64190 - DNA, 22 bp, Artificial Sequence
  chemically synthesized
actcactgcaacctcctccgcc

SEQ ID NO: 64191 - DNA, 22 bp, Artificial Sequence
  chemically synthesized
actgcaacctcctccgcctctc

SEQ ID NO: 64192 - DNA, 22 bp, Artificial Sequence
  chemically synthesized
caacctcctccgcctctcacct

SEQ ID NO: 64193 - DNA, 22 bp, Artificial Sequence
  chemically synthesized
ctccgcctctcacctcagcctc

SEQ ID NO: 64194 - DNA, 22 bp, Artificial Sequence
  chemically synthesized
cgcctctcacctcagcctcctg

SEQ ID NO: 64195 - DNA, 22 bp, Artificial Sequence
  chemically synthesized
tcacctcagcctcctgagtagc

SEQ ID NO: 64196 - DNA, 22 bp, Artificial Sequence
  chemically synthesized
acctcagcctcctgagtagctg

SEQ ID NO: 64197 - DNA, 22 bp, Artificial Sequence
  chemically synthesized
agcctcctgagtagctgggact

SEQ ID NO: 64198 - DNA, 22 bp, Artificial Sequence
  chemically synthesized
ctgagtagctgggactacagca

SEQ ID NO: 64199 - DNA, 22 bp, Artificial Sequence
  chemically synthesized
agtagctgggactacagcacca

SEQ ID NO: 64200 - DNA, 22 bp, Artificial Sequence
  chemically synthesized
ggactacagcaccaacacgccc

SEQ ID NO: 64201 - DNA, 22 bp, Artificial Sequence
  chemically synthesized
cagcaccaacacgcccagctaa

SEQ ID NO: 64202 - DNA, 22 bp, Artificial Sequence
  chemically synthesized
attttcgtaatgtttttgtaga

SEQ ID NO: 64203 - DNA, 22 bp, Artificial Sequence
  chemically synthesized
tcgtaatgtttttgtagagatg

SEQ ID NO: 64204 - DNA, 22 bp, Artificial Sequence
  chemically synthesized
cgtaatgtttttgtagagatgg

SEQ ID NO: 64205 - DNA, 22 bp, Artificial Sequence
  chemically synthesized
gtaatgtttttgtagagatgga

SEQ ID NO: 64206 - DNA, 22 bp, Artificial Sequence
  chemically synthesized
ttgtagagatggagtttcgcca

SEQ ID NO: 64207 - DNA, 22 bp, Artificial Sequence
  chemically synthesized
tgtagagatggagtttcgccat

SEQ ID NO: 64208 - DNA, 22 bp, Artificial Sequence
  chemically synthesized
gtagagatggagtttcgccatg

SEQ ID NO: 64209 - DNA, 22 bp, Artificial Sequence
  chemically synthesized
tagagatggagtttcgccatgt

SEQ ID NO: 64210 - DNA, 22 bp, Artificial Sequence
  chemically synthesized
cgccatgttgcccaggctggtc

SEQ ID NO: 64211 - DNA, 22 bp, Artificial Sequence
  chemically synthesized
gccatgttgcccaggctggtct

SEQ ID NO: 64212 - DNA, 22 bp, Artificial Sequence
  chemically synthesized
cccaggctggtcttgaactcct

SEQ ID NO: 64213 - DNA, 22 bp, Artificial Sequence
  chemically synthesized
gtcttgaactcctgagttcacc

SEQ ID NO: 64214 - DNA, 22 bp, Artificial Sequence
  chemically synthesized
gaactcctgagttcacccagga

SEQ ID NO: 64215 - DNA, 22 bp, Artificial Sequence
  chemically synthesized
aactcctgagttcacccaggag

SEQ ID NO: 64216 - DNA, 22 bp, Artificial Sequence
  chemically synthesized
ctgagttcacccaggagtgatt

SEQ ID NO: 64217 - DNA, 22 bp, Artificial Sequence
  chemically synthesized
agttcacccaggagtgattcgc

SEQ ID NO: 64218 - DNA, 22 bp, Artificial Sequence
  chemically synthesized
acccaggagtgattcgcccacc

SEQ ID NO: 64219 - DNA, 22 bp, Artificial Sequence
  chemically synthesized
gcccacctcggcctcccaaagt

SEQ ID NO: 64220 - DNA, 22 bp, Artificial Sequence
  chemically synthesized
ggcctcccaaagtgctgggatt

SEQ ID NO: 64221 - DNA, 22 bp, Artificial Sequence
  chemically synthesized
ccaaagtgctgggattacaggt

SEQ ID NO: 64222 - DNA, 22 bp, Artificial Sequence
  chemically synthesized
ggattacaggtgtgagccacca

SEQ ID NO: 64223 - DNA, 22 bp, Artificial Sequence
  chemically synthesized
caggtgtgagccaccatgcctg

SEQ ID NO: 64224 - DNA, 22 bp, Artificial Sequence
  chemically synthesized
gccccatacatctttctttatg

SEQ ID NO: 64225 - DNA, 22 bp, Artificial Sequence
  chemically synthesized
tctttatgttacctcttctgct

SEQ ID NO: 64226 - DNA, 22 bp, Artificial Sequence
  chemically synthesized
ctttatgttacctcttctgctt

SEQ ID NO: 64227 - DNA, 22 bp, Artificial Sequence
  chemically synthesized
tttatgttacctcttctgcttc

SEQ ID NO: 64228 - DNA, 22 bp, Artificial Sequence
  chemically synthesized
tatgttacctcttctgcttcat

SEQ ID NO: 64229 - DNA, 22 bp, Artificial Sequence
  chemically synthesized
atgttacctcttctgcttcata

SEQ ID NO: 64230 - DNA, 22 bp, Artificial Sequence
  chemically synthesized
tgttacctcttctgcttcatac

SEQ ID NO: 64231 - DNA, 22 bp, Artificial Sequence
  chemically synthesized
cctcttctgcttcatactaata

SEQ ID NO: 64232 - DNA, 22 bp, Artificial Sequence
  chemically synthesized
ttctgcttcatactaataaaac

SEQ ID NO: 64233 - DNA, 22 bp, Artificial Sequence
  chemically synthesized
ctgcttcatactaataaaactc

SEQ ID NO: 64234 - DNA, 22 bp, Artificial Sequence
  chemically synthesized
tgcttcatactaataaaactct

SEQ ID NO: 64235 - DNA, 22 bp, Artificial Sequence
  chemically synthesized
cttcatactaataaaactcttt

SEQ ID NO: 64236 - DNA, 22 bp, Artificial Sequence
  chemically synthesized
catactaataaaactctttgct

SEQ ID NO: 64237 - DNA, 22 bp, Artificial Sequence
  chemically synthesized
atactaataaaactctttgctc

SEQ ID NO: 64238 - DNA, 22 bp, Artificial Sequence
  chemically synthesized
ataaaactctttgctcaaagcc

SEQ ID NO: 64239 - DNA, 22 bp, Artificial Sequence
  chemically synthesized
tttgctcaaagcctatataact

SEQ ID NO: 64240 - DNA, 22 bp, Artificial Sequence
  chemically synthesized
tgctcaaagcctatataactca

SEQ ID NO: 64241 - DNA, 22 bp, Artificial Sequence
  chemically synthesized
gctcaaagcctatataactcag

SEQ ID NO: 64242 - DNA, 22 bp, Artificial Sequence
  chemically synthesized
ctcaaagcctatataactcaga

SEQ ID NO: 64243 - DNA, 22 bp, Artificial Sequence
  chemically synthesized
aaagcctatataactcagactt

SEQ ID NO: 64244 - DNA, 22 bp, Artificial Sequence
  chemically synthesized
tataactcagacttttcacgaa

SEQ ID NO: 64245 - DNA, 22 bp, Artificial Sequence
  chemically synthesized
agacttttcacgaaattcaact

SEQ ID NO: 64246 - DNA, 22 bp, Artificial Sequence
  chemically synthesized
ttcacgaaattcaactgtccta

SEQ ID NO: 64247 - DNA, 22 bp, Artificial Sequence
  chemically synthesized
tcacgaaattcaactgtcctac

SEQ ID NO: 64248 - DNA, 22 bp, Artificial Sequence
  chemically synthesized
cacgaaattcaactgtcctacc

SEQ ID NO: 64249 - DNA, 22 bp, Artificial Sequence
  chemically synthesized
acgaaattcaactgtcctaccc

SEQ ID NO: 64250 - DNA, 22 bp, Artificial Sequence
  chemically synthesized
aactgtcctaccctttaaccca

SEQ ID NO: 64251 - DNA, 22 bp, Artificial Sequence
  chemically synthesized
tcctaccctttaacccatatga

SEQ ID NO: 64252 - DNA, 22 bp, Artificial Sequence
  chemically synthesized
ccctttaacccatatgaaatag

SEQ ID NO: 64253 - DNA, 22 bp, Artificial Sequence
  chemically synthesized
taacccatatgaaataggcttt

SEQ ID NO: 64254 - DNA, 22 bp, Artificial Sequence
  chemically synthesized
aacccatatgaaataggctttc

SEQ ID NO: 64255 - DNA, 22 bp, Artificial Sequence
  chemically synthesized
acccatatgaaataggctttcc

SEQ ID NO: 64256 - DNA, 22 bp, Artificial Sequence
  chemically synthesized
tcctgtattttcaactcactgg

SEQ ID NO: 64257 - DNA, 22 bp, Artificial Sequence
  chemically synthesized
cctgtattttcaactcactggt

SEQ ID NO: 64258 - DNA, 22 bp, Artificial Sequence
  chemically synthesized
ctgtattttcaactcactggta

SEQ ID NO: 64259 - DNA, 22 bp, Artificial Sequence
  chemically synthesized
tattttcaactcactggtagga

SEQ ID NO: 64260 - DNA, 22 bp, Artificial Sequence
  chemically synthesized
tcaactcactggtaggattttt

SEQ ID NO: 64261 - DNA, 22 bp, Artificial Sequence
  chemically synthesized
caactcactggtaggatttttt

SEQ ID NO: 64262 - DNA, 22 bp, Artificial Sequence
  chemically synthesized
aactcactggtaggattttttc

SEQ ID NO: 64263 - DNA, 22 bp, Artificial Sequence
  chemically synthesized
actggtaggattttttctgtct

SEQ ID NO: 64264 - DNA, 22 bp, Artificial Sequence
  chemically synthesized
gtaggattttttctgtcttccc

SEQ ID NO: 64265 - DNA, 22 bp, Artificial Sequence
  chemically synthesized
tttctgtcttccccctttatgt

SEQ ID NO: 64266 - DNA, 22 bp, Artificial Sequence
  chemically synthesized
ttctgtcttccccctttatgta

SEQ ID NO: 64267 - DNA, 22 bp, Artificial Sequence
  chemically synthesized
tctgtcttccccctttatgtag

SEQ ID NO: 64268 - DNA, 22 bp, Artificial Sequence
  chemically synthesized
ctgtcttccccctttatgtaga

SEQ ID NO: 64269 - DNA, 22 bp, Artificial Sequence
  chemically synthesized
tgtcttccccctttatgtagat

SEQ ID NO: 64270 - DNA, 22 bp, Artificial Sequence
  chemically synthesized
tcttccccctttatgtagatga

SEQ ID NO: 64271 - DNA, 22 bp, Artificial Sequence
  chemically synthesized
ccccctttatgtagatgatcca

SEQ ID NO: 64272 - DNA, 22 bp, Artificial Sequence
  chemically synthesized
cccctttatgtagatgatccaa

SEQ ID NO: 64273 - DNA, 22 bp, Artificial Sequence
  chemically synthesized
tatgtagatgatccaaagtcag

SEQ ID NO: 64274 - DNA, 22 bp, Artificial Sequence
  chemically synthesized
atgtagatgatccaaagtcaga

SEQ ID NO: 64275 - DNA, 22 bp, Artificial Sequence
  chemically synthesized
tgtagatgatccaaagtcagag

SEQ ID NO: 64276 - DNA, 22 bp, Artificial Sequence
  chemically synthesized
gaagcatgagtagcccgtggct

SEQ ID NO: 64277 - DNA, 22 bp, Artificial Sequence
  chemically synthesized
cctgaatagcctggggaaagca

SEQ ID NO: 64278 - DNA, 22 bp, Artificial Sequence
  chemically synthesized
ctgaatagcctggggaaagcaa

SEQ ID NO: 64279 - DNA, 22 bp, Artificial Sequence
  chemically synthesized
aatagcctggggaaagcaactt

SEQ ID NO: 64280 - DNA, 22 bp, Artificial Sequence
  chemically synthesized
gggaaagcaacttctgatggac

SEQ ID NO: 64281 - DNA, 22 bp, Artificial Sequence
  chemically synthesized
ctgatggacagacattgcgaga

SEQ ID NO: 64282 - DNA, 22 bp, Artificial Sequence
  chemically synthesized
tgatggacagacattgcgagag

SEQ ID NO: 64283 - DNA, 22 bp, Artificial Sequence
  chemically synthesized
atggacagacattgcgagagcg

SEQ ID NO: 64284 - DNA, 22 bp, Artificial Sequence
  chemically synthesized
cgagagcgaatgccagcctctt

SEQ ID NO: 64285 - DNA, 22 bp, Artificial Sequence
  chemically synthesized
ttttcttgctgatctcctctct

SEQ ID NO: 64286 - DNA, 22 bp, Artificial Sequence
  chemically synthesized
ttcttgctgatctcctctctat

SEQ ID NO: 64287 - DNA, 22 bp, Artificial Sequence
  chemically synthesized
tcttgctgatctcctctctata

SEQ ID NO: 64288 - DNA, 22 bp, Artificial Sequence
  chemically synthesized
cttgctgatctcctctctatat

SEQ ID NO: 64289 - DNA, 22 bp, Artificial Sequence
  chemically synthesized
ttgctgatctcctctctatatg

SEQ ID NO: 64290 - DNA, 22 bp, Artificial Sequence
  chemically synthesized
gctgatctcctctctatatggt

SEQ ID NO: 64291 - DNA, 22 bp, Artificial Sequence
  chemically synthesized
ctgatctcctctctatatggtt

SEQ ID NO: 64292 - DNA, 22 bp, Artificial Sequence
  chemically synthesized
atctcctctctatatggttctt

SEQ ID NO: 64293 - DNA, 22 bp, Artificial Sequence
  chemically synthesized
ctctctatatggttcttaccac

SEQ ID NO: 64294 - DNA, 22 bp, Artificial Sequence
  chemically synthesized
tctatatggttcttaccactta

SEQ ID NO: 64295 - DNA, 22 bp, Artificial Sequence
  chemically synthesized
tatatggttcttaccacttaaa

SEQ ID NO: 64296 - DNA, 22 bp, Artificial Sequence
  chemically synthesized
tatggttcttaccacttaaaga

SEQ ID NO: 64297 - DNA, 22 bp, Artificial Sequence
  chemically synthesized
ttaccacttaaagacgaggttg

SEQ ID NO: 64298 - DNA, 22 bp, Artificial Sequence
  chemically synthesized
accacttaaagacgaggttgag

SEQ ID NO: 64299 - DNA, 22 bp, Artificial Sequence
  chemically synthesized
ccacttaaagacgaggttgagc

SEQ ID NO: 64300 - DNA, 22 bp, Artificial Sequence
  chemically synthesized
aaagacgaggttgagccagtct

SEQ ID NO: 64301 - DNA, 22 bp, Artificial Sequence
  chemically synthesized
aagacgaggttgagccagtctc

SEQ ID NO: 64302 - DNA, 22 bp, Artificial Sequence
  chemically synthesized
agccagtctccaatcacagcta

SEQ ID NO: 64303 - DNA, 22 bp, Artificial Sequence
  chemically synthesized
caatcacagctacccaaaggag

SEQ ID NO: 64304 - DNA, 22 bp, Artificial Sequence
  chemically synthesized
cccaaaggagtttaatgcccac

SEQ ID NO: 64305 - DNA, 22 bp, Artificial Sequence
  chemically synthesized
aatgcccacagcttcctgaaga

SEQ ID NO: 64306 - DNA, 22 bp, Artificial Sequence
  chemically synthesized
atgcccacagcttcctgaagat

SEQ ID NO: 64307 - DNA, 22 bp, Artificial Sequence
  chemically synthesized
cctgaagatggaaccagatggg

SEQ ID NO: 64308 - DNA, 22 bp, Artificial Sequence
  chemically synthesized
ctgaagatggaaccagatgggg

SEQ ID NO: 64309 - DNA, 22 bp, Artificial Sequence
  chemically synthesized
aagatggaaccagatggggaag

SEQ ID NO: 64310 - DNA, 22 bp, Artificial Sequence
  chemically synthesized
ctgaggtctgcgatcacggaca

SEQ ID NO: 64311 - DNA, 22 bp, Artificial Sequence
  chemically synthesized
aggtctgcgatcacggacacca

SEQ ID NO: 64312 - DNA, 22 bp, Artificial Sequence
  chemically synthesized
cgatcacggacaccaagatgaa

SEQ ID NO: 64313 - DNA, 22 bp, Artificial Sequence
  chemically synthesized
ggagtcttggtaattcacctgg

SEQ ID NO: 64314 - DNA, 22 bp, Artificial Sequence
  chemically synthesized
ggtaattcacctggaggtaatg

SEQ ID NO: 64315 - DNA, 22 bp, Artificial Sequence
  chemically synthesized
gtaattcacctggaggtaatgt

SEQ ID NO: 64316 - DNA, 22 bp, Artificial Sequence
  chemically synthesized
acctggaggtaatgtgttgact

SEQ ID NO: 64317 - DNA, 22 bp, Artificial Sequence
  chemically synthesized
gaggtaatgtgttgactggatc

SEQ ID NO: 64318 - DNA, 22 bp, Artificial Sequence
  chemically synthesized
actggatcccaaagtcatggag

SEQ ID NO: 64319 - DNA, 22 bp, Artificial Sequence
  chemically synthesized
gatcccaaagtcatggagaaca

SEQ ID NO: 64320 - DNA, 22 bp, Artificial Sequence
  chemically synthesized
attccttcctccatcctcattt

SEQ ID NO: 64321 - DNA, 22 bp, Artificial Sequence
  chemically synthesized
cttcctccatcctcatttcctt

SEQ ID NO: 64322 - DNA, 22 bp, Artificial Sequence
  chemically synthesized
cctccatcctcatttccttggc

SEQ ID NO: 64323 - DNA, 22 bp, Artificial Sequence
  chemically synthesized
ctccatcctcatttccttggca

SEQ ID NO: 64324 - DNA, 22 bp, Artificial Sequence
  chemically synthesized
catcctcatttccttggcacct

SEQ ID NO: 64325 - DNA, 22 bp, Artificial Sequence
  chemically synthesized
atttccttggcacctcaggaag

SEQ ID NO: 64326 - DNA, 22 bp, Artificial Sequence
  chemically synthesized
ccttggcacctcaggaagatgt

SEQ ID NO: 64327 - DNA, 22 bp, Artificial Sequence
  chemically synthesized
cttggcacctcaggaagatgtc

SEQ ID NO: 64328 - DNA, 22 bp, Artificial Sequence
  chemically synthesized
ggcacctcaggaagatgtcagc

SEQ ID NO: 64329 - DNA, 22 bp, Artificial Sequence
  chemically synthesized
gcacctcaggaagatgtcagca

SEQ ID NO: 64330 - DNA, 22 bp, Artificial Sequence
  chemically synthesized
aggaagatgtcagcagagccct

SEQ ID NO: 64331 - DNA, 22 bp, Artificial Sequence
  chemically synthesized
gcagttattccaggcttggtgg

SEQ ID NO: 64332 - DNA, 22 bp, Artificial Sequence
  chemically synthesized
cagttattccaggcttggtggt

SEQ ID NO: 64333 - DNA, 22 bp, Artificial Sequence
  chemically synthesized
ttccaggcttggtggtgattgc

SEQ ID NO: 64334 - DNA, 22 bp, Artificial Sequence
  chemically synthesized
caggcttggtggtgattgctct

SEQ ID NO: 64335 - DNA, 22 bp, Artificial Sequence
  chemically synthesized
ggtggtgattgctctgctatga

SEQ ID NO: 64336 - DNA, 22 bp, Artificial Sequence
  chemically synthesized
gtggtgattgctctgctatgag

SEQ ID NO: 64337 - DNA, 22 bp, Artificial Sequence
  chemically synthesized
ctctgctatgagtctgtgcctt

SEQ ID NO: 64338 - DNA, 22 bp, Artificial Sequence
  chemically synthesized
tgctatgagtctgtgccttgcc

SEQ ID NO: 64339 - DNA, 22 bp, Artificial Sequence
  chemically synthesized
ctatgagtctgtgccttgcccc

SEQ ID NO: 64340 - DNA, 22 bp, Artificial Sequence
  chemically synthesized
tgagtctgtgccttgcccctgt

SEQ ID NO: 64341 - DNA, 22 bp, Artificial Sequence
  chemically synthesized
tgccttgcccctgttttatatg

SEQ ID NO: 64342 - DNA, 22 bp, Artificial Sequence
  chemically synthesized
gcccctgttttatatgccctgt

SEQ ID NO: 64343 - DNA, 22 bp, Artificial Sequence
  chemically synthesized
cccctgttttatatgccctgta

SEQ ID NO: 64344 - DNA, 22 bp, Artificial Sequence
  chemically synthesized
ttttatatgccctgtatccagt

SEQ ID NO: 64345 - DNA, 22 bp, Artificial Sequence
  chemically synthesized
tatatgccctgtatccagtatt

SEQ ID NO: 64346 - DNA, 22 bp, Artificial Sequence
  chemically synthesized
atatgccctgtatccagtattc

SEQ ID NO: 64347 - DNA, 22 bp, Artificial Sequence
  chemically synthesized
tatgccctgtatccagtattca

SEQ ID NO: 64348 - DNA, 22 bp, Artificial Sequence
  chemically synthesized
tatccagtattcaggtcaaccc

SEQ ID NO: 64349 - DNA, 22 bp, Artificial Sequence
  chemically synthesized
aggtcaacccagccctgatctt

SEQ ID NO: 64350 - DNA, 22 bp, Artificial Sequence
  chemically synthesized
atctttggactcaaaaaccacg

SEQ ID NO: 64351 - DNA, 22 bp, Artificial Sequence
  chemically synthesized
tggactcaaaaaccacgtttgt

SEQ ID NO: 64352 - DNA, 22 bp, Artificial Sequence
  chemically synthesized
ggactcaaaaaccacgtttgtc

SEQ ID NO: 64353 - DNA, 22 bp, Artificial Sequence
  chemically synthesized
gactcaaaaaccacgtttgtct

SEQ ID NO: 64354 - DNA, 22 bp, Artificial Sequence
  chemically synthesized
aaaaaccacgtttgtctaaaat

SEQ ID NO: 64355 - DNA, 22 bp, Artificial Sequence
  chemically synthesized
gtctaaaatgtattgatcaaag

SEQ ID NO: 64356 - DNA, 22 bp, Artificial Sequence
  chemically synthesized
tctaaaatgtattgatcaaagg

SEQ ID NO: 64357 - DNA, 22 bp, Artificial Sequence
  chemically synthesized
aaatgtattgatcaaaggtgca

SEQ ID NO: 64358 - DNA, 22 bp, Artificial Sequence
  chemically synthesized
atcaaaggtgcatcaccagtag

SEQ ID NO: 64359 - DNA, 22 bp, Artificial Sequence
  chemically synthesized
atgcaaacatgttcagggtgat

SEQ ID NO: 64360 - DNA, 22 bp, Artificial Sequence
  chemically synthesized
agggtgatttacgtaaaataga

SEQ ID NO: 64361 - DNA, 22 bp, Artificial Sequence
  chemically synthesized
acgtaaaatagaaaaacaggca

SEQ ID NO: 64362 - DNA, 22 bp, Artificial Sequence
  chemically synthesized
cgtaaaatagaaaaacaggcac

SEQ ID NO: 64363 - DNA, 22 bp, Artificial Sequence
  chemically synthesized
atcggccatgtactcagcaggg

SEQ ID NO: 64364 - DNA, 22 bp, Artificial Sequence
  chemically synthesized
agcagggccaatgattaacttt

SEQ ID NO: 64365 - DNA, 22 bp, Artificial Sequence
  chemically synthesized
actttggcatgcttcttggcag

SEQ ID NO: 64366 - DNA, 22 bp, Artificial Sequence
  chemically synthesized
tggcatgcttcttggcagtgca

SEQ ID NO: 64367 - DNA, 22 bp, Artificial Sequence
  chemically synthesized
ggcatgcttcttggcagtgcaa

SEQ ID NO: 64368 - DNA, 22 bp, Artificial Sequence
  chemically synthesized
gcatgcttcttggcagtgcaag

SEQ ID NO: 64369 - DNA, 22 bp, Artificial Sequence
  chemically synthesized
cttggcagtgcaagggtctgcc

SEQ ID NO: 64370 - DNA, 22 bp, Artificial Sequence
  chemically synthesized
ttggcagtgcaagggtctgccc

SEQ ID NO: 64371 - DNA, 22 bp, Artificial Sequence
  chemically synthesized
ggcagtgcaagggtctgccctc

SEQ ID NO: 64372 - DNA, 22 bp, Artificial Sequence
  chemically synthesized
gcagtgcaagggtctgccctcc

SEQ ID NO: 64373 - DNA, 22 bp, Artificial Sequence
  chemically synthesized
ccctcctggtccccgaaaccag

SEQ ID NO: 64374 - DNA, 22 bp, Artificial Sequence
  chemically synthesized
ctggtccccgaaaccaggccag

SEQ ID NO: 64375 - DNA, 22 bp, Artificial Sequence
  chemically synthesized
gtccccgaaaccaggccagaga

SEQ ID NO: 64376 - DNA, 22 bp, Artificial Sequence
  chemically synthesized
catccacgatgattcttgcaaa

SEQ ID NO: 64377 - DNA, 22 bp, Artificial Sequence
  chemically synthesized
ttgcaaagatgtcagattttct

SEQ ID NO: 64378 - DNA, 22 bp, Artificial Sequence
  chemically synthesized
gcaaagatgtcagattttctat

SEQ ID NO: 64379 - DNA, 22 bp, Artificial Sequence
  chemically synthesized
caaagatgtcagattttctatg

SEQ ID NO: 64380 - DNA, 22 bp, Artificial Sequence
  chemically synthesized
tctatgcctgcaactgcactta

SEQ ID NO: 64381 - DNA, 22 bp, Artificial Sequence
  chemically synthesized
ctatgcctgcaactgcacttat

SEQ ID NO: 64382 - DNA, 22 bp, Artificial Sequence
  chemically synthesized
tatgcctgcaactgcacttatt

SEQ ID NO: 64383 - DNA, 22 bp, Artificial Sequence
  chemically synthesized
tgcctgcaactgcacttatttg

SEQ ID NO: 64384 - DNA, 22 bp, Artificial Sequence
  chemically synthesized
caactgcacttatttggggaca

SEQ ID NO: 64385 - DNA, 22 bp, Artificial Sequence
  chemically synthesized
cacttatttggggacaaagaaa

SEQ ID NO: 64386 - DNA, 22 bp, Artificial Sequence
  chemically synthesized
atttggggacaaagaaaaatct

SEQ ID NO: 64387 - DNA, 22 bp, Artificial Sequence
  chemically synthesized
tttggggacaaagaaaaatctt

SEQ ID NO: 64388 - DNA, 22 bp, Artificial Sequence
  chemically synthesized
ggggacaaagaaaaatcttggt

SEQ ID NO: 64389 - DNA, 22 bp, Artificial Sequence
  chemically synthesized
gggacaaagaaaaatcttggtg

SEQ ID NO: 64390 - DNA, 22 bp, Artificial Sequence
  chemically synthesized
ggtgctctagctattcaagttt

SEQ ID NO: 64391 - DNA, 22 bp, Artificial Sequence
  chemically synthesized
gtgctctagctattcaagtttt

SEQ ID NO: 64392 - DNA, 22 bp, Artificial Sequence
  chemically synthesized
tagctattcaagttttaagttc

SEQ ID NO: 64393 - DNA, 22 bp, Artificial Sequence
  chemically synthesized
gctattcaagttttaagttctt

SEQ ID NO: 64394 - DNA, 22 bp, Artificial Sequence
  chemically synthesized
ttcaagttttaagttcttaatt

SEQ ID NO: 64395 - DNA, 22 bp, Artificial Sequence
  chemically synthesized
aagttttaagttcttaatttta

SEQ ID NO: 64396 - DNA, 22 bp, Artificial Sequence
  chemically synthesized
taagttcttaattttaaaatta

SEQ ID NO: 64397 - DNA, 22 bp, Artificial Sequence
  chemically synthesized
aagttcttaattttaaaattag

SEQ ID NO: 64398 - DNA, 22 bp, Artificial Sequence
  chemically synthesized
agttcttaattttaaaattagt

SEQ ID NO: 64399 - DNA, 22 bp, Artificial Sequence
  chemically synthesized
ttaattttaaaattagtaaagt

SEQ ID NO: 64400 - DNA, 22 bp, Artificial Sequence
  chemically synthesized
aattttaaaattagtaaagttc

SEQ ID NO: 64401 - DNA, 22 bp, Artificial Sequence
  chemically synthesized
attttaaaattagtaaagttct

SEQ ID NO: 64402 - DNA, 22 bp, Artificial Sequence
  chemically synthesized
taaaattagtaaagttctggct

SEQ ID NO: 64403 - DNA, 22 bp, Artificial Sequence
  chemically synthesized
aaaattagtaaagttctggctg

SEQ ID NO: 64404 - DNA, 22 bp, Artificial Sequence
  chemically synthesized
aaattagtaaagttctggctgg

SEQ ID NO: 64405 - DNA, 22 bp, Artificial Sequence
  chemically synthesized
gtaaagttctggctggttgtgg

SEQ ID NO: 64406 - DNA, 22 bp, Artificial Sequence
  chemically synthesized
tggctggttgtggtggctcaca

SEQ ID NO: 64407 - DNA, 22 bp, Artificial Sequence
  chemically synthesized
gctggttgtggtggctcacacc

SEQ ID NO: 64408 - DNA, 22 bp, Artificial Sequence
  chemically synthesized
gttgtggtggctcacacctgta

SEQ ID NO: 64409 - DNA, 22 bp, Artificial Sequence
  chemically synthesized
tggtggctcacacctgtaatcc

SEQ ID NO: 64410 - DNA, 22 bp, Artificial Sequence
  chemically synthesized
acacctgtaatcccagcaattt

SEQ ID NO: 64411 - DNA, 22 bp, Artificial Sequence
  chemically synthesized
taatcccagcaatttgggaggc

SEQ ID NO: 64412 - DNA, 22 bp, Artificial Sequence
  chemically synthesized
gggaggctgaggtgggaggatc

SEQ ID NO: 64413 - DNA, 22 bp, Artificial Sequence
  chemically synthesized
ggaggctgaggtgggaggatcc

SEQ ID NO: 64414 - DNA, 22 bp, Artificial Sequence
  chemically synthesized
aggtgggaggatcccttgaagc

SEQ ID NO: 64415 - DNA, 22 bp, Artificial Sequence
  chemically synthesized
gaagccaggagttggagaccag

SEQ ID NO: 64416 - DNA, 22 bp, Artificial Sequence
  chemically synthesized
aagccaggagttggagaccagc

SEQ ID NO: 64417 - DNA, 22 bp, Artificial Sequence
  chemically synthesized
gagaccagcctgggcaacaaag

SEQ ID NO: 64418 - DNA, 22 bp, Artificial Sequence
  chemically synthesized
ggcaacaaagcaagaccctcgt

SEQ ID NO: 64419 - DNA, 22 bp, Artificial Sequence
  chemically synthesized
gtttctacacaaaaatttaaaa

SEQ ID NO: 64420 - DNA, 22 bp, Artificial Sequence
  chemically synthesized
ctacacaaaaatttaaaaaatt

SEQ ID NO: 64421 - DNA, 22 bp, Artificial Sequence
  chemically synthesized
tacacaaaaatttaaaaaattg

SEQ ID NO: 64422 - DNA, 22 bp, Artificial Sequence
  chemically synthesized
cacaaaaatttaaaaaattgtt

SEQ ID NO: 64423 - DNA, 22 bp, Artificial Sequence
  chemically synthesized
aaaaaattgttttggtgtgtgt

SEQ ID NO: 64424 - DNA, 22 bp, Artificial Sequence
  chemically synthesized
aaaaattgttttggtgtgtgtg

SEQ ID NO: 64425 - DNA, 22 bp, Artificial Sequence
  chemically synthesized
ttttggtgtgtgtgatggtgta

SEQ ID NO: 64426 - DNA, 22 bp, Artificial Sequence
  chemically synthesized
tggtgtgtgtgatggtgtaccc

SEQ ID NO: 64427 - DNA, 22 bp, Artificial Sequence
  chemically synthesized
ggtgtgtgtgatggtgtaccct

SEQ ID NO: 64428 - DNA, 22 bp, Artificial Sequence
  chemically synthesized
gtgtgtgtgatggtgtaccctt

SEQ ID NO: 64429 - DNA, 22 bp, Artificial Sequence
  chemically synthesized
gtagtcccagctattcaggagg

SEQ ID NO: 64430 - DNA, 22 bp, Artificial Sequence
  chemically synthesized
tagtcccagctattcaggaggc

SEQ ID NO: 64431 - DNA, 22 bp, Artificial Sequence
  chemically synthesized
ttcaggaggctgaggcaggagg

SEQ ID NO: 64432 - DNA, 22 bp, Artificial Sequence
  chemically synthesized
aggaggctgaggcaggaggatt

SEQ ID NO: 64433 - DNA, 22 bp, Artificial Sequence
  chemically synthesized
aggcaggaggattgcttgagcc

SEQ ID NO: 64434 - DNA, 22 bp, Artificial Sequence
  chemically synthesized
cttgagcccaggagttggagtc

SEQ ID NO: 64435 - DNA, 22 bp, Artificial Sequence
  chemically synthesized
gagcccaggagttggagtctgc

SEQ ID NO: 64436 - DNA, 22 bp, Artificial Sequence
  chemically synthesized
agcccaggagttggagtctgca

SEQ ID NO: 64437 - DNA, 22 bp, Artificial Sequence
  chemically synthesized
gagtctgcagtgagctattgtc

SEQ ID NO: 64438 - DNA, 22 bp, Artificial Sequence
  chemically synthesized
cagtgagctattgtcccaccgc

SEQ ID NO: 64439 - DNA, 22 bp, Artificial Sequence
  chemically synthesized
ttgtcccaccgctgcactacag

SEQ ID NO: 64440 - DNA, 22 bp, Artificial Sequence
  chemically synthesized
tcccaccgctgcactacagcct

SEQ ID NO: 64441 - DNA, 22 bp, Artificial Sequence
  chemically synthesized
cactacagcctgggcaatcgag

SEQ ID NO: 64442 - DNA, 22 bp, Artificial Sequence
  chemically synthesized
cagcctgggcaatcgagcaaga

SEQ ID NO: 64443 - DNA, 22 bp, Artificial Sequence
  chemically synthesized
ggcaatcgagcaagaccccagt

SEQ ID NO: 64444 - DNA, 22 bp, Artificial Sequence
  chemically synthesized
taaaacaaaacaaaacaaaaca

SEQ ID NO: 64445 - DNA, 22 bp, Artificial Sequence
  chemically synthesized
aaacaaaacaaaacaaaacaaa

SEQ ID NO: 64446 - DNA, 22 bp, Artificial Sequence
  chemically synthesized
ctattgtattggggactatcat

SEQ ID NO: 64447 - DNA, 22 bp, Artificial Sequence
  chemically synthesized
tattgtattggggactatcatc

SEQ ID NO: 64448 - DNA, 22 bp, Artificial Sequence
  chemically synthesized
ttgtattggggactatcatctt

SEQ ID NO: 64449 - DNA, 22 bp, Artificial Sequence
  chemically synthesized
tattggggactatcatcttgct

SEQ ID NO: 64450 - DNA, 22 bp, Artificial Sequence
  chemically synthesized
gggactatcatcttgctggtct

SEQ ID NO: 64451 - DNA, 22 bp, Artificial Sequence
  chemically synthesized
tcatcttgctggtctttcctta

SEQ ID NO: 64452 - DNA, 22 bp, Artificial Sequence
  chemically synthesized
gctggtctttccttaactgtat

SEQ ID NO: 64453 - DNA, 22 bp, Artificial Sequence
  chemically synthesized
ctggtctttccttaactgtatt

SEQ ID NO: 64454 - DNA, 22 bp, Artificial Sequence
  chemically synthesized
gtctttccttaactgtattaga

SEQ ID NO: 64455 - DNA, 22 bp, Artificial Sequence
  chemically synthesized
tccttaactgtattagagtcta

SEQ ID NO: 64456 - DNA, 22 bp, Artificial Sequence
  chemically synthesized
ccttaactgtattagagtctag

SEQ ID NO: 64457 - DNA, 22 bp, Artificial Sequence
  chemically synthesized
cttaactgtattagagtctagg

SEQ ID NO: 64458 - DNA, 22 bp, Artificial Sequence
  chemically synthesized
aactgtattagagtctagggtc

SEQ ID NO: 64459 - DNA, 22 bp, Artificial Sequence
  chemically synthesized
actgtattagagtctagggtct

SEQ ID NO: 64460 - DNA, 22 bp, Artificial Sequence
  chemically synthesized
tattagagtctagggtctgcct

SEQ ID NO: 64461 - DNA, 22 bp, Artificial Sequence
  chemically synthesized
gagtctagggtctgcctctggt

SEQ ID NO: 64462 - DNA, 22 bp, Artificial Sequence
  chemically synthesized
gggtctgcctctggtttgggag

SEQ ID NO: 64463 - DNA, 22 bp, Artificial Sequence
  chemically synthesized
cctctggtttgggagatcaacc

SEQ ID NO: 64464 - DNA, 22 bp, Artificial Sequence
  chemically synthesized
tggtttgggagatcaaccccct

SEQ ID NO: 64465 - DNA, 22 bp, Artificial Sequence
  chemically synthesized
gtttgggagatcaacccccttc

SEQ ID NO: 64466 - DNA, 22 bp, Artificial Sequence
  chemically synthesized
gggagatcaacccccttcctgg

SEQ ID NO: 64467 - DNA, 22 bp, Artificial Sequence
  chemically synthesized
ggagatcaacccccttcctggt

SEQ ID NO: 64468 - DNA, 22 bp, Artificial Sequence
  chemically synthesized
cctggtattggcctcatgtctc

SEQ ID NO: 64469 - DNA, 22 bp, Artificial Sequence
  chemically synthesized
ctggtattggcctcatgtctct

SEQ ID NO: 64470 - DNA, 22 bp, Artificial Sequence
  chemically synthesized
gtattggcctcatgtctcttag

SEQ ID NO: 64471 - DNA, 22 bp, Artificial Sequence
  chemically synthesized
gcctcatgtctcttagggccag

SEQ ID NO: 64472 - DNA, 22 bp, Artificial Sequence
  chemically synthesized
atgtctcttagggccagaaagt

SEQ ID NO: 64473 - DNA, 22 bp, Artificial Sequence
  chemically synthesized
ttagggccagaaagtaatcgtt

SEQ ID NO: 64474 - DNA, 22 bp, Artificial Sequence
  chemically synthesized
agggccagaaagtaatcgtttt

SEQ ID NO: 64475 - DNA, 22 bp, Artificial Sequence
  chemically synthesized
gggccagaaagtaatcgttttt

SEQ ID NO: 64476 - DNA, 22 bp, Artificial Sequence
  chemically synthesized
ttgaatgcagtgattaattcat

SEQ ID NO: 64477 - DNA, 22 bp, Artificial Sequence
  chemically synthesized
tgaatgcagtgattaattcatt

SEQ ID NO: 64478 - DNA, 22 bp, Artificial Sequence
  chemically synthesized
gaatgcagtgattaattcattt

SEQ ID NO: 64479 - DNA, 22 bp, Artificial Sequence
  chemically synthesized
aatgcagtgattaattcattta

SEQ ID NO: 64480 - DNA, 22 bp, Artificial Sequence
  chemically synthesized
attcatttaatgaccttaaagt

SEQ ID NO: 64481 - DNA, 22 bp, Artificial Sequence
  chemically synthesized
atttaatgaccttaaagttaca

SEQ ID NO: 64482 - DNA, 22 bp, Artificial Sequence
  chemically synthesized
aatgaccttaaagttacagccc

SEQ ID NO: 64483 - DNA, 22 bp, Artificial Sequence
  chemically synthesized
atgaccttaaagttacagccct

SEQ ID NO: 64484 - DNA, 22 bp, Artificial Sequence
  chemically synthesized
aaagttacagcccttggtgttg

SEQ ID NO: 64485 - DNA, 22 bp, Artificial Sequence
  chemically synthesized
aagttacagcccttggtgttgt

SEQ ID NO: 64486 - DNA, 22 bp, Artificial Sequence
  chemically synthesized
cagcccttggtgttgttttctt

SEQ ID NO: 64487 - DNA, 22 bp, Artificial Sequence
  chemically synthesized
ggtgttgttttcttttttaaat

SEQ ID NO: 64488 - DNA, 22 bp, Artificial Sequence
  chemically synthesized
gtgttgttttcttttttaaatt

SEQ ID NO: 64489 - DNA, 22 bp, Artificial Sequence
  chemically synthesized
ttttcttttttaaattttctct

SEQ ID NO: 64490 - DNA, 22 bp, Artificial Sequence
  chemically synthesized
tcttttttaaattttctctctc

SEQ ID NO: 64491 - DNA, 22 bp, Artificial Sequence
  chemically synthesized
cttttttaaattttctctctct

SEQ ID NO: 64492 - DNA, 22 bp, Artificial Sequence
  chemically synthesized
ttttttaaattttctctctctt

SEQ ID NO: 64493 - DNA, 22 bp, Artificial Sequence
  chemically synthesized
ttttaaattttctctctctttt

SEQ ID NO: 64494 - DNA, 22 bp, Artificial Sequence
  chemically synthesized
tttaaattttctctctcttttt

SEQ ID NO: 64495 - DNA, 22 bp, Artificial Sequence
  chemically synthesized
ttaaattttctctctctttttt

SEQ ID NO: 64496 - DNA, 22 bp, Artificial Sequence
  chemically synthesized
taaattttctctctcttttttt

SEQ ID NO: 64497 - DNA, 22 bp, Artificial Sequence
  chemically synthesized
aaattttctctctctttttttt

SEQ ID NO: 64498 - DNA, 22 bp, Artificial Sequence
  chemically synthesized
aattttctctctcttttttttg

SEQ ID NO: 64499 - DNA, 22 bp, Artificial Sequence
  chemically synthesized
tctctctcttttttttgaaaca

SEQ ID NO: 64500 - DNA, 22 bp, Artificial Sequence
  chemically synthesized
ctctctcttttttttgaaacag

SEQ ID NO: 64501 - DNA, 22 bp, Artificial Sequence
  chemically synthesized
tctctcttttttttgaaacagg

SEQ ID NO: 64502 - DNA, 22 bp, Artificial Sequence
  chemically synthesized
tctcttttttttgaaacagggt

SEQ ID NO: 64503 - DNA, 22 bp, Artificial Sequence
  chemically synthesized
tcttttttttgaaacagggtct

SEQ ID NO: 64504 - DNA, 22 bp, Artificial Sequence
  chemically synthesized
ttttttttgaaacagggtctca

SEQ ID NO: 64505 - DNA, 22 bp, Artificial Sequence
  chemically synthesized
ttttttgaaacagggtctcact

SEQ ID NO: 64506 - DNA, 22 bp, Artificial Sequence
  chemically synthesized
tttttgaaacagggtctcactc

SEQ ID NO: 64507 - DNA, 22 bp, Artificial Sequence
  chemically synthesized
ttttgaaacagggtctcactct

SEQ ID NO: 64508 - DNA, 22 bp, Artificial Sequence
  chemically synthesized
tttgaaacagggtctcactctg

SEQ ID NO: 64509 - DNA, 22 bp, Artificial Sequence
  chemically synthesized
ttgaaacagggtctcactctgt

SEQ ID NO: 64510 - DNA, 22 bp, Artificial Sequence
  chemically synthesized
tgaaacagggtctcactctgtc

SEQ ID NO: 64511 - DNA, 22 bp, Artificial Sequence
  chemically synthesized
gaaacagggtctcactctgtct

SEQ ID NO: 64512 - DNA, 22 bp, Artificial Sequence
  chemically synthesized
aaacagggtctcactctgtctc

SEQ ID NO: 64513 - DNA, 22 bp, Artificial Sequence
  chemically synthesized
actctgtctcccaggctggagt

SEQ ID NO: 64514 - DNA, 22 bp, Artificial Sequence
  chemically synthesized
tgtctcccaggctggagtgcag

SEQ ID NO: 64515 - DNA, 22 bp, Artificial Sequence
  chemically synthesized
tctcccaggctggagtgcagtg

SEQ ID NO: 64516 - DNA, 22 bp, Artificial Sequence
  chemically synthesized
ccaggctggagtgcagtggcat

SEQ ID NO: 64517 - DNA, 22 bp, Artificial Sequence
  chemically synthesized
gagtgcagtggcataatcacgg

SEQ ID NO: 64518 - DNA, 22 bp, Artificial Sequence
  chemically synthesized
actgcagcctcaacctcctggg

SEQ ID NO: 64519 - DNA, 22 bp, Artificial Sequence
  chemically synthesized
cagcctcaacctcctgggctaa

SEQ ID NO: 64520 - DNA, 22 bp, Artificial Sequence
  chemically synthesized
aacctcctgggctaatgtgatc

SEQ ID NO: 64521 - DNA, 22 bp, Artificial Sequence
  chemically synthesized
ctgggctaatgtgatcctccca

SEQ ID NO: 64522 - DNA, 22 bp, Artificial Sequence
  chemically synthesized
ggctaatgtgatcctcccacct

SEQ ID NO: 64523 - DNA, 22 bp, Artificial Sequence
  chemically synthesized
atgtgatcctcccacctcagcc

SEQ ID NO: 64524 - DNA, 22 bp, Artificial Sequence
  chemically synthesized
ccacctcagcctcctgagtagc

SEQ ID NO: 64525 - DNA, 22 bp, Artificial Sequence
  chemically synthesized
agcctcctgagtagctgggacc

SEQ ID NO: 64526 - DNA, 22 bp, Artificial Sequence
  chemically synthesized
ctgagtagctgggaccacaggc

SEQ ID NO: 64527 - DNA, 22 bp, Artificial Sequence
  chemically synthesized
agtagctgggaccacaggcaca

SEQ ID NO: 64528 - DNA, 22 bp, Artificial Sequence
  chemically synthesized
ggaccacaggcacacgccacca

SEQ ID NO: 64529 - DNA, 22 bp, Artificial Sequence
  chemically synthesized
gctaatttttctatcttttgta

SEQ ID NO: 64530 - DNA, 22 bp, Artificial Sequence
  chemically synthesized
atttttctatcttttgtagaga

SEQ ID NO: 64531 - DNA, 22 bp, Artificial Sequence
  chemically synthesized
ttctatcttttgtagagatggg

SEQ ID NO: 64532 - DNA, 22 bp, Artificial Sequence
  chemically synthesized
tctatcttttgtagagatgggg

SEQ ID NO: 64533 - DNA, 22 bp, Artificial Sequence
  chemically synthesized
ctatcttttgtagagatggggt

SEQ ID NO: 64534 - DNA, 22 bp, Artificial Sequence
  chemically synthesized
tatcttttgtagagatggggtt

SEQ ID NO: 64535 - DNA, 22 bp, Artificial Sequence
  chemically synthesized
tcttttgtagagatggggtttt

SEQ ID NO: 64536 - DNA, 22 bp, Artificial Sequence
  chemically synthesized
ttgtagagatggggtttttcca

SEQ ID NO: 64537 - DNA, 22 bp, Artificial Sequence
  chemically synthesized
tgtagagatggggtttttccat

SEQ ID NO: 64538 - DNA, 22 bp, Artificial Sequence
  chemically synthesized
gtagagatggggtttttccatg

SEQ ID NO: 64539 - DNA, 22 bp, Artificial Sequence
  chemically synthesized
tagagatggggtttttccatgt

SEQ ID NO: 64540 - DNA, 22 bp, Artificial Sequence
  chemically synthesized
ttccatgttgcccaggctggtc

SEQ ID NO: 64541 - DNA, 22 bp, Artificial Sequence
  chemically synthesized
tccatgttgcccaggctggtct

SEQ ID NO: 64542 - DNA, 22 bp, Artificial Sequence
  chemically synthesized
ccatgttgcccaggctggtctt

SEQ ID NO: 64543 - DNA, 22 bp, Artificial Sequence
  chemically synthesized
catgttgcccaggctggtcttg

SEQ ID NO: 64544 - DNA, 22 bp, Artificial Sequence
  chemically synthesized
cccaggctggtcttgaattcct

SEQ ID NO: 64545 - DNA, 22 bp, Artificial Sequence
  chemically synthesized
gtcttgaattcctgagctcaag

SEQ ID NO: 64546 - DNA, 22 bp, Artificial Sequence
  chemically synthesized
gaattcctgagctcaagagatc

SEQ ID NO: 64547 - DNA, 22 bp, Artificial Sequence
  chemically synthesized
aattcctgagctcaagagatct

SEQ ID NO: 64548 - DNA, 22 bp, Artificial Sequence
  chemically synthesized
ctgagctcaagagatctgccag

SEQ ID NO: 64549 - DNA, 22 bp, Artificial Sequence
  chemically synthesized
agctcaagagatctgccagtct

SEQ ID NO: 64550 - DNA, 22 bp, Artificial Sequence
  chemically synthesized
aagagatctgccagtcttggct

SEQ ID NO: 64551 - DNA, 22 bp, Artificial Sequence
  chemically synthesized
ccagtcttggcttcccaaagct

SEQ ID NO: 64552 - DNA, 22 bp, Artificial Sequence
  chemically synthesized
ggcttcccaaagctctgggatt

SEQ ID NO: 64553 - DNA, 22 bp, Artificial Sequence
  chemically synthesized
gcttcccaaagctctgggatta

SEQ ID NO: 64554 - DNA, 22 bp, Artificial Sequence
  chemically synthesized
cccaaagctctgggattacagg

SEQ ID NO: 64555 - DNA, 22 bp, Artificial Sequence
  chemically synthesized
ccaaagctctgggattacaggt

SEQ ID NO: 64556 - DNA, 22 bp, Artificial Sequence
  chemically synthesized
tgggattacaggtgtgaaccac

SEQ ID NO: 64557 - DNA, 22 bp, Artificial Sequence
  chemically synthesized
ggattacaggtgtgaaccacca

SEQ ID NO: 64558 - DNA, 22 bp, Artificial Sequence
  chemically synthesized
caggtgtgaaccaccatgcctg

SEQ ID NO: 64559 - DNA, 22 bp, Artificial Sequence
  chemically synthesized
gccaagtgttttaactcatacg

SEQ ID NO: 64560 - DNA, 22 bp, Artificial Sequence
  chemically synthesized
taactcatacgtttaagcaaaa

SEQ ID NO: 64561 - DNA, 22 bp, Artificial Sequence
  chemically synthesized
aactcatacgtttaagcaaaat

SEQ ID NO: 64562 - DNA, 22 bp, Artificial Sequence
  chemically synthesized
actcatacgtttaagcaaaata

SEQ ID NO: 64563 - DNA, 22 bp, Artificial Sequence
  chemically synthesized
atacgtttaagcaaaataatga

SEQ ID NO: 64564 - DNA, 22 bp, Artificial Sequence
  chemically synthesized
aagcaaaataatgaatgtatag

SEQ ID NO: 64565 - DNA, 22 bp, Artificial Sequence
  chemically synthesized
agcaaaataatgaatgtatagt

SEQ ID NO: 64566 - DNA, 22 bp, Artificial Sequence
  chemically synthesized
actgtgcaacaatatgatgaat

SEQ ID NO: 64567 - DNA, 22 bp, Artificial Sequence
  chemically synthesized
ctgtgcaacaatatgatgaatg

SEQ ID NO: 64568 - DNA, 22 bp, Artificial Sequence
  chemically synthesized
tgcaacaatatgatgaatgtat

SEQ ID NO: 64569 - DNA, 22 bp, Artificial Sequence
  chemically synthesized
caaataagaataccagcaaaat

SEQ ID NO: 64570 - DNA, 22 bp, Artificial Sequence
  chemically synthesized
gagacttaaagagtttgaaact

SEQ ID NO: 64571 - DNA, 22 bp, Artificial Sequence
  chemically synthesized
aaagagtttgaaactttcagtt

SEQ ID NO: 64572 - DNA, 22 bp, Artificial Sequence
  chemically synthesized
aagagtttgaaactttcagtta

SEQ ID NO: 64573 - DNA, 22 bp, Artificial Sequence
  chemically synthesized
gaaactttcagttatttttgaa

SEQ ID NO: 64574 - DNA, 22 bp, Artificial Sequence
  chemically synthesized
aaactttcagttatttttgaaa

SEQ ID NO: 64575 - DNA, 22 bp, Artificial Sequence
  chemically synthesized
tcagttatttttgaaaaagggc

SEQ ID NO: 64576 - DNA, 22 bp, Artificial Sequence
  chemically synthesized
cagttatttttgaaaaagggct

SEQ ID NO: 64577 - DNA, 22 bp, Artificial Sequence
  chemically synthesized
agttatttttgaaaaagggctt

SEQ ID NO: 64578 - DNA, 22 bp, Artificial Sequence
  chemically synthesized
tttttgaaaaagggcttctata

SEQ ID NO: 64579 - DNA, 22 bp, Artificial Sequence
  chemically synthesized
ttgaaaaagggcttctatatct

SEQ ID NO: 64580 - DNA, 22 bp, Artificial Sequence
  chemically synthesized
tgaaaaagggcttctatatctt

SEQ ID NO: 64581 - DNA, 22 bp, Artificial Sequence
  chemically synthesized
gaaaaagggcttctatatcttg

SEQ ID NO: 64582 - DNA, 22 bp, Artificial Sequence
  chemically synthesized
aaaaagggcttctatatcttga

SEQ ID NO: 64583 - DNA, 22 bp, Artificial Sequence
  chemically synthesized
ctatatcttgagctttcttata

SEQ ID NO: 64584 - DNA, 22 bp, Artificial Sequence
  chemically synthesized
tatatcttgagctttcttatac

SEQ ID NO: 64585 - DNA, 22 bp, Artificial Sequence
  chemically synthesized
tatcttgagctttcttatacat

SEQ ID NO: 64586 - DNA, 22 bp, Artificial Sequence
  chemically synthesized
gagctttcttatacatatgtgt

SEQ ID NO: 64587 - DNA, 22 bp, Artificial Sequence
  chemically synthesized
agctttcttatacatatgtgtg

SEQ ID NO: 64588 - DNA, 22 bp, Artificial Sequence
  chemically synthesized
tcttatacatatgtgtgtagat

SEQ ID NO: 64589 - DNA, 22 bp, Artificial Sequence
  chemically synthesized
cttatacatatgtgtgtagata

SEQ ID NO: 64590 - DNA, 22 bp, Artificial Sequence
  chemically synthesized
ttatacatatgtgtgtagatat

SEQ ID NO: 64591 - DNA, 22 bp, Artificial Sequence
  chemically synthesized
atacatatgtgtgtagatatac

SEQ ID NO: 64592 - DNA, 22 bp, Artificial Sequence
  chemically synthesized
tacatatgtgtgtagatataca

SEQ ID NO: 64593 - DNA, 22 bp, Artificial Sequence
  chemically synthesized
aagatacactgtgtgtgtgtat

SEQ ID NO: 64594 - DNA, 22 bp, Artificial Sequence
  chemically synthesized
tgtgtgtgtatatgtgtgtgtg

SEQ ID NO: 64595 - DNA, 22 bp, Artificial Sequence
  chemically synthesized
tatatcagcctacaaatagtag

SEQ ID NO: 64596 - DNA, 22 bp, Artificial Sequence
  chemically synthesized
caaatagtagagagaccaaaac

SEQ ID NO: 64597 - DNA, 22 bp, Artificial Sequence
  chemically synthesized
acacttgggtcacggaggactg

SEQ ID NO: 64598 - DNA, 22 bp, Artificial Sequence
  chemically synthesized
gggtcacggaggactgtgaaag

SEQ ID NO: 64599 - DNA, 22 bp, Artificial Sequence
  chemically synthesized
ggtcacggaggactgtgaaagg

SEQ ID NO: 64600 - DNA, 22 bp, Artificial Sequence
  chemically synthesized
tgaaaggaaccagggaatgaat

SEQ ID NO: 64601 - DNA, 22 bp, Artificial Sequence
  chemically synthesized
atgcattttaaaaaatagggct

SEQ ID NO: 64602 - DNA, 22 bp, Artificial Sequence
  chemically synthesized
taaaaaatagggctatttaatc

SEQ ID NO: 64603 - DNA, 22 bp, Artificial Sequence
  chemically synthesized
aaaaaatagggctatttaatca

SEQ ID NO: 64604 - DNA, 22 bp, Artificial Sequence
  chemically synthesized
aaaaatagggctatttaatcat

SEQ ID NO: 64605 - DNA, 22 bp, Artificial Sequence
  chemically synthesized
tttaatcatgcttcatatcact

SEQ ID NO: 64606 - DNA, 22 bp, Artificial Sequence
  chemically synthesized
aatcatgcttcatatcactatt

SEQ ID NO: 64607 - DNA, 22 bp, Artificial Sequence
  chemically synthesized
atcatgcttcatatcactatta

SEQ ID NO: 64608 - DNA, 22 bp, Artificial Sequence
  chemically synthesized
catatcactattatttattatt

SEQ ID NO: 64609 - DNA, 22 bp, Artificial Sequence
  chemically synthesized
atatcactattatttattattt

SEQ ID NO: 64610 - DNA, 22 bp, Artificial Sequence
  chemically synthesized
ttatttattatttatttattta

SEQ ID NO: 64611 - DNA, 22 bp, Artificial Sequence
  chemically synthesized
tttattatttatttatttattt

SEQ ID NO: 64612 - DNA, 22 bp, Artificial Sequence
  chemically synthesized
attatttatttatttatttttg

SEQ ID NO: 64613 - DNA, 22 bp, Artificial Sequence
  chemically synthesized
ttatttatttatttatttttgt

SEQ ID NO: 64614 - DNA, 22 bp, Artificial Sequence
  chemically synthesized
tttatttatttatttttgtaga

SEQ ID NO: 64615 - DNA, 22 bp, Artificial Sequence
  chemically synthesized
atttatttatttttgtagaaac

SEQ ID NO: 64616 - DNA, 22 bp, Artificial Sequence
  chemically synthesized
tttatttatttttgtagaaacg

SEQ ID NO: 64617 - DNA, 22 bp, Artificial Sequence
  chemically synthesized
atttatttttgtagaaacgggg

SEQ ID NO: 64618 - DNA, 22 bp, Artificial Sequence
  chemically synthesized
tttatttttgtagaaacggggt

SEQ ID NO: 64619 - DNA, 22 bp, Artificial Sequence
  chemically synthesized
atttttgtagaaacggggtctc

SEQ ID NO: 64620 - DNA, 22 bp, Artificial Sequence
  chemically synthesized
tttttgtagaaacggggtctca

SEQ ID NO: 64621 - DNA, 22 bp, Artificial Sequence
  chemically synthesized
ttgtagaaacggggtctcacta

SEQ ID NO: 64622 - DNA, 22 bp, Artificial Sequence
  chemically synthesized
tgtagaaacggggtctcactat

SEQ ID NO: 64623 - DNA, 22 bp, Artificial Sequence
  chemically synthesized
gtagaaacggggtctcactatg

SEQ ID NO: 64624 - DNA, 22 bp, Artificial Sequence
  chemically synthesized
tagaaacggggtctcactatgc

SEQ ID NO: 64625 - DNA, 22 bp, Artificial Sequence
  chemically synthesized
actatgcggcccaggctggtct

SEQ ID NO: 64626 - DNA, 22 bp, Artificial Sequence
  chemically synthesized
tgcggcccaggctggtctcaaa

SEQ ID NO: 64627 - DNA, 22 bp, Artificial Sequence
  chemically synthesized
gtctcaaattcctggcttcaag

SEQ ID NO: 64628 - DNA, 22 bp, Artificial Sequence
  chemically synthesized
aaattcctggcttcaagtgatc

SEQ ID NO: 64629 - DNA, 22 bp, Artificial Sequence
  chemically synthesized
ctggcttcaagtgatcctcccg

SEQ ID NO: 64630 - DNA, 22 bp, Artificial Sequence
  chemically synthesized
gcttcaagtgatcctcccgcct

SEQ ID NO: 64631 - DNA, 22 bp, Artificial Sequence
  chemically synthesized
caagtgatcctcccgcctcaac

SEQ ID NO: 64632 - DNA, 22 bp, Artificial Sequence
  chemically synthesized
aagtgatcctcccgcctcaacc

SEQ ID NO: 64633 - DNA, 22 bp, Artificial Sequence
  chemically synthesized
ccgcctcaacctagcaaagcat

SEQ ID NO: 64634 - DNA, 22 bp, Artificial Sequence
  chemically synthesized
aacctagcaaagcattgggatt

SEQ ID NO: 64635 - DNA, 22 bp, Artificial Sequence
  chemically synthesized
gcaaagcattgggattacaggc

SEQ ID NO: 64636 - DNA, 22 bp, Artificial Sequence
  chemically synthesized
ggattacaggcatgagccactg

SEQ ID NO: 64637 - DNA, 22 bp, Artificial Sequence
  chemically synthesized
caggcatgagccactgcctcca

SEQ ID NO: 64638 - DNA, 22 bp, Artificial Sequence
  chemically synthesized
cctccaaattcatgcatttttt

SEQ ID NO: 64639 - DNA, 22 bp, Artificial Sequence
  chemically synthesized
caaattcatgcattttttgagg

SEQ ID NO: 64640 - DNA, 22 bp, Artificial Sequence
  chemically synthesized
atgcattttttgaggataagag

SEQ ID NO: 64641 - DNA, 22 bp, Artificial Sequence
  chemically synthesized
tttgaggataagagccaggggg

SEQ ID NO: 64642 - DNA, 22 bp, Artificial Sequence
  chemically synthesized
ttgaggataagagccaggggga

SEQ ID NO: 64643 - DNA, 22 bp, Artificial Sequence
  chemically synthesized
tgaggataagagccagggggaa

SEQ ID NO: 64644 - DNA, 22 bp, Artificial Sequence
  chemically synthesized
gaggataagagccagggggaat

SEQ ID NO: 64645 - DNA, 22 bp, Artificial Sequence
  chemically synthesized
aggataagagccagggggaata

SEQ ID NO: 64646 - DNA, 22 bp, Artificial Sequence
  chemically synthesized
aaaaacttgcctgaatttccca

SEQ ID NO: 64647 - DNA, 22 bp, Artificial Sequence
  chemically synthesized
aaaacttgcctgaatttcccat

SEQ ID NO: 64648 - DNA, 22 bp, Artificial Sequence
  chemically synthesized
gcctgaatttcccatcattaag

SEQ ID NO: 64649 - DNA, 22 bp, Artificial Sequence
  chemically synthesized
cctgaatttcccatcattaagt

SEQ ID NO: 64650 - DNA, 22 bp, Artificial Sequence
  chemically synthesized
aatttcccatcattaagtccat

SEQ ID NO: 64651 - DNA, 22 bp, Artificial Sequence
  chemically synthesized
cccatcattaagtccatattga

SEQ ID NO: 64652 - DNA, 22 bp, Artificial Sequence
  chemically synthesized
ccatcattaagtccatattgac

SEQ ID NO: 64653 - DNA, 22 bp, Artificial Sequence
  chemically synthesized
agtccatattgacatgtaaggg

SEQ ID NO: 64654 - DNA, 22 bp, Artificial Sequence
  chemically synthesized
acatgtaaggggtagctgggga

SEQ ID NO: 64655 - DNA, 22 bp, Artificial Sequence
  chemically synthesized
gggacagaaaaaagaaactcag

SEQ ID NO: 64656 - DNA, 22 bp, Artificial Sequence
  chemically synthesized
agagctaatgaatctgtggcaa

SEQ ID NO: 64657 - DNA, 22 bp, Artificial Sequence
  chemically synthesized
atgaatctgtggcaaaagttga

SEQ ID NO: 64658 - DNA, 22 bp, Artificial Sequence
  chemically synthesized
tggcaaaagttgacagcattcc

SEQ ID NO: 64659 - DNA, 22 bp, Artificial Sequence
  chemically synthesized
acagcattccatgctggaaatg

SEQ ID NO: 64660 - DNA, 22 bp, Artificial Sequence
  chemically synthesized
catgctggaaatgattaaaaca

SEQ ID NO: 64661 - DNA, 22 bp, Artificial Sequence
  chemically synthesized
gaaatgattaaaacatcctcca

SEQ ID NO: 64662 - DNA, 22 bp, Artificial Sequence
  chemically synthesized
aaacatcctccaggaggtatga

SEQ ID NO: 64663 - DNA, 22 bp, Artificial Sequence
  chemically synthesized
caggaggtatgacctggagtct

SEQ ID NO: 64664 - DNA, 22 bp, Artificial Sequence
  chemically synthesized
gagtctcctccccaccccacca

SEQ ID NO: 64665 - DNA, 22 bp, Artificial Sequence
  chemically synthesized
ctccccaccccaccaagggctc

SEQ ID NO: 64666 - DNA, 22 bp, Artificial Sequence
  chemically synthesized
cccaccccaccaagggctcgca

SEQ ID NO: 64667 - DNA, 22 bp, Artificial Sequence
  chemically synthesized
gcacccagcccatgctgactcc

SEQ ID NO: 64668 - DNA, 22 bp, Artificial Sequence
  chemically synthesized
actccagttgtccttgactgca

SEQ ID NO: 64669 - DNA, 22 bp, Artificial Sequence
  chemically synthesized
cagttgtccttgactgcatggt

SEQ ID NO: 64670 - DNA, 22 bp, Artificial Sequence
  chemically synthesized
tccttgactgcatggtttctgc

SEQ ID NO: 64671 - DNA, 22 bp, Artificial Sequence
  chemically synthesized
gactgcatggtttctgctggtc

SEQ ID NO: 64672 - DNA, 22 bp, Artificial Sequence
  chemically synthesized
actgcatggtttctgctggtcc

SEQ ID NO: 64673 - DNA, 22 bp, Artificial Sequence
  chemically synthesized
catggtttctgctggtccaagc

SEQ ID NO: 64674 - DNA, 22 bp, Artificial Sequence
  chemically synthesized
ctgctggtccaagcaaacttct

SEQ ID NO: 64675 - DNA, 22 bp, Artificial Sequence
  chemically synthesized
tgctggtccaagcaaacttctc

SEQ ID NO: 64676 - DNA, 22 bp, Artificial Sequence
  chemically synthesized
ctggtccaagcaaacttctcct

SEQ ID NO: 64677 - DNA, 22 bp, Artificial Sequence
  chemically synthesized
gtccaagcaaacttctcctgcc

SEQ ID NO: 64678 - DNA, 22 bp, Artificial Sequence
  chemically synthesized
ctcctgccacgcctaaccttgg

SEQ ID NO: 64679 - DNA, 22 bp, Artificial Sequence
  chemically synthesized
tcctgccacgcctaaccttgga

SEQ ID NO: 64680 - DNA, 22 bp, Artificial Sequence
  chemically synthesized
ctgccacgcctaaccttggaga

SEQ ID NO: 64681 - DNA, 22 bp, Artificial Sequence
  chemically synthesized
ccacgcctaaccttggagagca

SEQ ID NO: 64682 - DNA, 22 bp, Artificial Sequence
  chemically synthesized
accttggagagcaggtaatgtg

SEQ ID NO: 64683 - DNA, 22 bp, Artificial Sequence
  chemically synthesized
ggagagcaggtaatgtgttggt

SEQ ID NO: 64684 - DNA, 22 bp, Artificial Sequence
  chemically synthesized
gagagcaggtaatgtgttggtg

SEQ ID NO: 64685 - DNA, 22 bp, Artificial Sequence
  chemically synthesized
gtgactgtgggtgggtgtaaag

SEQ ID NO: 64686 - DNA, 22 bp, Artificial Sequence
  chemically synthesized
tgggtgggtgtaaagtaagccc

SEQ ID NO: 64687 - DNA, 22 bp, Artificial Sequence
  chemically synthesized
gggcgtggggtatatgtgatct

SEQ ID NO: 64688 - DNA, 22 bp, Artificial Sequence
  chemically synthesized
cactgtcagggctgctgggcca

SEQ ID NO: 64689 - DNA, 22 bp, Artificial Sequence
  chemically synthesized
tcagggctgctgggccataggt

SEQ ID NO: 64690 - DNA, 22 bp, Artificial Sequence
  chemically synthesized
ctgggccataggtagggagcct

SEQ ID NO: 64691 - DNA, 22 bp, Artificial Sequence
  chemically synthesized
ggccataggtagggagcctccc

SEQ ID NO: 64692 - DNA, 22 bp, Artificial Sequence
  chemically synthesized
cctctacccagataagcctctg

SEQ ID NO: 64693 - DNA, 22 bp, Artificial Sequence
  chemically synthesized
tacccagataagcctctgttgt

SEQ ID NO: 64694 - DNA, 22 bp, Artificial Sequence
  chemically synthesized
cccagataagcctctgttgtgg

SEQ ID NO: 64695 - DNA, 22 bp, Artificial Sequence
  chemically synthesized
tgttgtggagtaactattgcag

SEQ ID NO: 64696 - DNA, 22 bp, Artificial Sequence
  chemically synthesized
ttgtggagtaactattgcagtg

SEQ ID NO: 64697 - DNA, 22 bp, Artificial Sequence
  chemically synthesized
tggagtaactattgcagtgacc

SEQ ID NO: 64698 - DNA, 22 bp, Artificial Sequence
  chemically synthesized
ttgcagtgacctctgggatgag

SEQ ID NO: 64699 - DNA, 22 bp, Artificial Sequence
  chemically synthesized
cagtgacctctgggatgagagt

SEQ ID NO: 64700 - DNA, 22 bp, Artificial Sequence
  chemically synthesized
tgggatgagagtttctatggtc

SEQ ID NO: 64701 - DNA, 22 bp, Artificial Sequence
  chemically synthesized
ggatgagagtttctatggtcag

SEQ ID NO: 64702 - DNA, 22 bp, Artificial Sequence
  chemically synthesized
ctatggtcagaggtgagtcaag

SEQ ID NO: 64703 - DNA, 22 bp, Artificial Sequence
  chemically synthesized
tatggtcagaggtgagtcaagg

SEQ ID NO: 64704 - DNA, 22 bp, Artificial Sequence
  chemically synthesized
tggtcagaggtgagtcaaggtg

SEQ ID NO: 64705 - DNA, 22 bp, Artificial Sequence
  chemically synthesized
aaaacatatacaaaggccactg

SEQ ID NO: 64706 - DNA, 22 bp, Artificial Sequence
  chemically synthesized
tctgggtcatgccagggcagct

SEQ ID NO: 64707 - DNA, 22 bp, Artificial Sequence
  chemically synthesized
ggtcatgccagggcagctagca

SEQ ID NO: 64708 - DNA, 22 bp, Artificial Sequence
  chemically synthesized
gcagccagggtctctgagttgg

SEQ ID NO: 64709 - DNA, 22 bp, Artificial Sequence
  chemically synthesized
tgagttgggaggggttctatta

SEQ ID NO: 64710 - DNA, 22 bp, Artificial Sequence
  chemically synthesized
agttgggaggggttctattatg

SEQ ID NO: 64711 - DNA, 22 bp, Artificial Sequence
  chemically synthesized
ggaggggttctattatgtggtc

SEQ ID NO: 64712 - DNA, 22 bp, Artificial Sequence
  chemically synthesized
tattatgtggtcagcatatggg

SEQ ID NO: 64713 - DNA, 22 bp, Artificial Sequence
  chemically synthesized
ttatgtggtcagcatatgggga

SEQ ID NO: 64714 - DNA, 22 bp, Artificial Sequence
  chemically synthesized
tgtggtcagcatatggggaggg

SEQ ID NO: 64715 - DNA, 22 bp, Artificial Sequence
  chemically synthesized
ttttctgagacgcctcaggaag

SEQ ID NO: 64716 - DNA, 22 bp, Artificial Sequence
  chemically synthesized
tctgagacgcctcaggaagaat

SEQ ID NO: 64717 - DNA, 22 bp, Artificial Sequence
  chemically synthesized
ctgagacgcctcaggaagaata

SEQ ID NO: 64718 - DNA, 22 bp, Artificial Sequence
  chemically synthesized
tgagacgcctcaggaagaatac

SEQ ID NO: 64719 - DNA, 22 bp, Artificial Sequence
  chemically synthesized
agacgcctcaggaagaataccc

SEQ ID NO: 64720 - DNA, 22 bp, Artificial Sequence
  chemically synthesized
aggaagaatacccctatggata

SEQ ID NO: 64721 - DNA, 22 bp, Artificial Sequence
  chemically synthesized
tggataaggagttgataagtga

SEQ ID NO: 64722 - DNA, 22 bp, Artificial Sequence
  chemically synthesized
ataagtgatggagttgacatcc

SEQ ID NO: 64723 - DNA, 22 bp, Artificial Sequence
  chemically synthesized
acatcccactctgggcatccag

SEQ ID NO: 64724 - DNA, 22 bp, Artificial Sequence
  chemically synthesized
tgggcatccagggacagtggga

SEQ ID NO: 64725 - DNA, 22 bp, Artificial Sequence
  chemically synthesized
ggcatccagggacagtgggagt

SEQ ID NO: 64726 - DNA, 22 bp, Artificial Sequence
  chemically synthesized
cctggcggtgggccaccaggca

SEQ ID NO: 64727 - DNA, 22 bp, Artificial Sequence
  chemically synthesized
ctggcggtgggccaccaggcag

SEQ ID NO: 64728 - DNA, 22 bp, Artificial Sequence
  chemically synthesized
gcggtgggccaccaggcagggg

SEQ ID NO: 64729 - DNA, 22 bp, Artificial Sequence
  chemically synthesized
tggatcagagcaacctcatagt

SEQ ID NO: 64730 - DNA, 22 bp, Artificial Sequence
  chemically synthesized
gatcagagcaacctcatagtca

SEQ ID NO: 64731 - DNA, 22 bp, Artificial Sequence
  chemically synthesized
atagtcatgagacgatgagctg

SEQ ID NO: 64732 - DNA, 22 bp, Artificial Sequence
  chemically synthesized
gtcctcatctttccacctgcca

SEQ ID NO: 64733 - DNA, 22 bp, Artificial Sequence
  chemically synthesized
atctttccacctgccagcccct

SEQ ID NO: 64734 - DNA, 22 bp, Artificial Sequence
  chemically synthesized
tccacctgccagcccctttctg

SEQ ID NO: 64735 - DNA, 22 bp, Artificial Sequence
  chemically synthesized
ccacctgccagcccctttctgc

SEQ ID NO: 64736 - DNA, 22 bp, Artificial Sequence
  chemically synthesized
cacctgccagcccctttctgct

SEQ ID NO: 64737 - DNA, 22 bp, Artificial Sequence
  chemically synthesized
ccagcccctttctgcttcctcc

SEQ ID NO: 64738 - DNA, 22 bp, Artificial Sequence
  chemically synthesized
tctgcttcctccagcacgtttt

SEQ ID NO: 64739 - DNA, 22 bp, Artificial Sequence
  chemically synthesized
ctgcttcctccagcacgttttt

SEQ ID NO: 64740 - DNA, 22 bp, Artificial Sequence
  chemically synthesized
tgcttcctccagcacgttttta

SEQ ID NO: 64741 - DNA, 22 bp, Artificial Sequence
  chemically synthesized
cttcctccagcacgtttttatc

SEQ ID NO: 64742 - DNA, 22 bp, Artificial Sequence
  chemically synthesized
cctccagcacgtttttatccgt

SEQ ID NO: 64743 - DNA, 22 bp, Artificial Sequence
  chemically synthesized
ctccagcacgtttttatccgtg

SEQ ID NO: 64744 - DNA, 22 bp, Artificial Sequence
  chemically synthesized
cagcacgtttttatccgtggga

SEQ ID NO: 64745 - DNA, 22 bp, Artificial Sequence
  chemically synthesized
ttatccgtgggaaaacaggtga

SEQ ID NO: 64746 - DNA, 22 bp, Artificial Sequence
  chemically synthesized
tatccgtgggaaaacaggtgag

SEQ ID NO: 64747 - DNA, 22 bp, Artificial Sequence
  chemically synthesized
atccgtgggaaaacaggtgagg

SEQ ID NO: 64748 - DNA, 22 bp, Artificial Sequence
  chemically synthesized
tccgtgggaaaacaggtgaggc

SEQ ID NO: 64749 - DNA, 22 bp, Artificial Sequence
  chemically synthesized
gttagaaagctgactgcatcga

SEQ ID NO: 64750 - DNA, 22 bp, Artificial Sequence
  chemically synthesized
ttagaaagctgactgcatcgag

SEQ ID NO: 64751 - DNA, 22 bp, Artificial Sequence
  chemically synthesized
gaaagctgactgcatcgagaca

SEQ ID NO: 64752 - DNA, 22 bp, Artificial Sequence
  chemically synthesized
actgcatcgagacaccgtggat

SEQ ID NO: 64753 - DNA, 22 bp, Artificial Sequence
  chemically synthesized
catcgagacaccgtggattctc

SEQ ID NO: 64754 - DNA, 22 bp, Artificial Sequence
  chemically synthesized
tcaaaggtcttgtggatatatg

SEQ ID NO: 64755 - DNA, 22 bp, Artificial Sequence
  chemically synthesized
aaaggtcttgtggatatatgag

SEQ ID NO: 64756 - DNA, 22 bp, Artificial Sequence
  chemically synthesized
gtggatatatgaggcgagtggc

SEQ ID NO: 64757 - DNA, 22 bp, Artificial Sequence
  chemically synthesized
tggatatatgaggcgagtggct

SEQ ID NO: 64758 - DNA, 22 bp, Artificial Sequence
  chemically synthesized
gaagttttgctgagaatccact

SEQ ID NO: 64759 - DNA, 22 bp, Artificial Sequence
  chemically synthesized
tgctgagaatccactcatttat

SEQ ID NO: 64760 - DNA, 22 bp, Artificial Sequence
  chemically synthesized
gctgagaatccactcatttatc

SEQ ID NO: 64761 - DNA, 22 bp, Artificial Sequence
  chemically synthesized
ctgagaatccactcatttatct

SEQ ID NO: 64762 - DNA, 22 bp, Artificial Sequence
  chemically synthesized
agaatccactcatttatctgtt

SEQ ID NO: 64763 - DNA, 22 bp, Artificial Sequence
  chemically synthesized
atttatctgtttatttgagacg

SEQ ID NO: 64764 - DNA, 22 bp, Artificial Sequence
  chemically synthesized
atctgtttatttgagacggggt

SEQ ID NO: 64765 - DNA, 22 bp, Artificial Sequence
  chemically synthesized
tctgtttatttgagacggggtc

SEQ ID NO: 64766 - DNA, 22 bp, Artificial Sequence
  chemically synthesized
tttatttgagacggggtctcac

SEQ ID NO: 64767 - DNA, 22 bp, Artificial Sequence
  chemically synthesized
atttgagacggggtctcactct

SEQ ID NO: 64768 - DNA, 22 bp, Artificial Sequence
  chemically synthesized
tttgagacggggtctcactctg

SEQ ID NO: 64769 - DNA, 22 bp, Artificial Sequence
  chemically synthesized
gagacggggtctcactctgtta

SEQ ID NO: 64770 - DNA, 22 bp, Artificial Sequence
  chemically synthesized
agacggggtctcactctgttac

SEQ ID NO: 64771 - DNA, 22 bp, Artificial Sequence
  chemically synthesized
actctgttacccaggctggagt

SEQ ID NO: 64772 - DNA, 22 bp, Artificial Sequence
  chemically synthesized
tgttacccaggctggagtgcgg

SEQ ID NO: 64773 - DNA, 22 bp, Artificial Sequence
  chemically synthesized
ttacccaggctggagtgcggtg

SEQ ID NO: 64774 - DNA, 22 bp, Artificial Sequence
  chemically synthesized
cccaggctggagtgcggtggca

SEQ ID NO: 64775 - DNA, 22 bp, Artificial Sequence
  chemically synthesized
gagtgcggtggcaccatcacag

SEQ ID NO: 64776 - DNA, 22 bp, Artificial Sequence
  chemically synthesized
actgcagcctcagtctcctggg

SEQ ID NO: 64777 - DNA, 22 bp, Artificial Sequence
  chemically synthesized
cagcctcagtctcctgggctta

SEQ ID NO: 64778 - DNA, 22 bp, Artificial Sequence
  chemically synthesized
agtctcctgggcttaagggatc

SEQ ID NO: 64779 - DNA, 22 bp, Artificial Sequence
  chemically synthesized
ctgggcttaagggatcgttttg

SEQ ID NO: 64780 - DNA, 22 bp, Artificial Sequence
  chemically synthesized
ggcttaagggatcgttttgcat

SEQ ID NO: 64781 - DNA, 22 bp, Artificial Sequence
  chemically synthesized
aagggatcgttttgcatcagtc

SEQ ID NO: 64782 - DNA, 22 bp, Artificial Sequence
  chemically synthesized
agggatcgttttgcatcagtct

SEQ ID NO: 64783 - DNA, 22 bp, Artificial Sequence
  chemically synthesized
tgcatcagtctctgggtagctg

SEQ ID NO: 64784 - DNA, 22 bp, Artificial Sequence
  chemically synthesized
gcatcagtctctgggtagctgg

SEQ ID NO: 64785 - DNA, 22 bp, Artificial Sequence
  chemically synthesized
catcagtctctgggtagctggg

SEQ ID NO: 64786 - DNA, 22 bp, Artificial Sequence
  chemically synthesized
tgggtagctgggcctacaggcg

SEQ ID NO: 64787 - DNA, 22 bp, Artificial Sequence
  chemically synthesized
ggtagctgggcctacaggcgca

SEQ ID NO: 64788 - DNA, 22 bp, Artificial Sequence
  chemically synthesized
ggcctacaggcgcacaccacca

SEQ ID NO: 64789 - DNA, 22 bp, Artificial Sequence
  chemically synthesized
caggcgcacaccaccaaaccca

SEQ ID NO: 64790 - DNA, 23 bp, Artificial Sequence
  chemically synthesized
  misc_feature (1)..(21): n is a, c, g, or t
nnnnnnnnnnnnnnnnnnnnnrg

SEQ ID NO: 64791 - protein, 9 aa, Artificial Sequence
  chemically synthesized
LAGLIDADG

SEQ ID NO: 64792 - DNA, 20 bp, Artificial Sequence
  Synthetic
attggccctgctgagtacat

SEQ ID NO: 64793 - DNA, 24 bp, Artificial Sequence
  Synthetic
cccaggaggtagaggtcacaatga

SEQ ID NO: 64794 - DNA, 18 bp, Artificial Sequence
  Synthetic
aacctgggcacgctcttt

SEQ ID NO: 64795 - DNA, 20 bp, Artificial Sequence
  Synthetic
atagcctggggaaagcaact

SEQ ID NO: 64796 - DNA, 20 bp, Artificial Sequence
  Synthetic
agaggaccacctgagctgac

SEQ ID NO: 64797 - DNA, 22 bp, Artificial Sequence
  Synthetic
tgtaaaagaggaccacctgagc

SEQ ID NO: 64798 - DNA, 20 bp, Artificial Sequence
  Synthetic
actgtccaaagagaatccta

SEQ ID NO: 64799 - DNA, 20 bp, Artificial Sequence
  Synthetic
tctttggacagtgtccatac

SEQ ID NO: 64800 - DNA, 20 bp, Artificial Sequence
  Synthetic
ttggacagtgtccatactgg

SEQ ID NO: 64801 - DNA, 20 bp, Artificial Sequence
  Synthetic
tggacagtgtccatactggt

SEQ ID NO: 64802 - DNA, 20 bp, Artificial Sequence
  Synthetic
ctactgcctcgcctaggtcc

SEQ ID NO: 64803 - DNA, 20 bp, Artificial Sequence
  Synthetic
catcccctactgcctcgcct

SEQ ID NO: 64804 - DNA, 20 bp, Artificial Sequence
  Synthetic
tactgcctcgcctaggtcct

SEQ ID NO: 64805 - DNA, 20 bp, Artificial Sequence
  Synthetic
aggacctaggcgaggcagta

SEQ ID NO: 64806 - DNA, 20 bp, Artificial Sequence
  Synthetic
gctggcccaggacctaggcg

SEQ ID NO: 64807 - DNA, 20 bp, Artificial Sequence
  Synthetic
caggacctaggcgaggcagt

SEQ ID NO: 64808 - DNA, 20 bp, Artificial Sequence
  Synthetic
ggtgtccaaagagaatccta

SEQ ID NO: 64809 - DNA, 19 bp, Artificial Sequence
  Synthetic
ctgtccaaagagaatccta

SEQ ID NO: 64810 - DNA, 19 bp, Artificial Sequence
  Synthetic
gtgtccaaagagaatccta

SEQ ID NO: 64811 - DNA, 18 bp, Artificial Sequence
  Synthetic
tgtccaaagagaatccta

SEQ ID NO: 64812 - DNA, 18 bp, Artificial Sequence
  Synthetic
ggtccaaagagaatccta

SEQ ID NO: 64813 - DNA, 17 bp, Artificial Sequence
  Synthetic
gtccaaagagaatccta

SEQ ID NO: 64814 - DNA, 20 bp, Artificial Sequence
  Synthetic
gctttggacagcgtccatac

SEQ ID NO: 64815 - DNA, 20 bp, Artificial Sequence
  Synthetic
ggtttggacagcgtccatac

SEQ ID NO: 64816 - DNA, 19 bp, Artificial Sequence
  Synthetic
ctttggacagcgtccatac

SEQ ID NO: 64817 - DNA, 19 bp, Artificial Sequence
  Synthetic
gtttggacagcgtccatac

SEQ ID NO: 64818 - DNA, 18 bp, Artificial Sequence
  Synthetic
tttggacagcgtccatac

SEQ ID NO: 64819 - DNA, 18 bp, Artificial Sequence
  Synthetic
gttggacagcgtccatac

SEQ ID NO: 64820 - DNA, 17 bp, Artificial Sequence
  Synthetic
ttggacagcgtccatac

SEQ ID NO: 64821 - RNA, 100 nt, Artificial Sequence
  Synthetic
  misc_feature (1)..(2): linked by phosphorothioate linkage
  modified_base (1)..(1): gm
  modified_base (2)..(2): cm
  misc_feature (2)..(3): linked by phosphorothioate linkage
  modified_base (3)..(4): um
  misc_feature (3)..(4): linked by phosphorothioate linkage
  misc_feature (97)..(98): linked by phosphorothioate linkage
  misc_feature (98)..(99): linked by phosphorothioate linkage
  misc_feature (99)..(100): linked by phosphorothioate linkage
  modified_base (99)..(100): um
gcuguccaaagagaauccuaguuuuagagcuagaaauagcaaguuaaaauaaggcuaguccguuaucaacuugaaaaaguggcaccgagucggugcuuuu

SEQ ID NO: 64822 - RNA, 36 nt, Artificial Sequence
  Synthetic
  misc_feature (1)..(2): linked by phosphorothioate linkage
  modified_base (1)..(1): gm
  misc_feature (2)..(3): linked by phosphorothioate linkage
  modified_base (2)..(2): cm
  misc_feature (3)..(4): linked by phosphorothioate linkage
  modified_base (3)..(3): um
  modified_base (28)..(28): gm
  modified_base (29)..(29): cm
  modified_base (30)..(30): um
  modified_base (31)..(31): 2'-O-methyl a
gcuguccaaagagaauccuaguuuuagagcuagaaa

SEQ ID NO: 64823 - RNA, 36 nt, Artificial Sequence; identical to SEQ ID NO: 64822
  Synthetic
  misc_feature (1)..(2): linked by phosphorothioate linkage
  modified_base (1)..(1): gm
  misc_feature (2)..(3): linked by phosphorothioate linkage
  modified_base (2)..(2): cm
  misc_feature (3)..(4): linked by phosphorothioate linkage
  modified_base (3)..(3): um
  modified_base (21)..(21): gm
  modified_base (22)..(25): um
  modified_base (26)..(26): 2'-O-methyl a
  modified_base (27)..(27): gm
  modified_base (28)..(28): 2'-O-methyl a
  modified_base (29)..(29): gm
  modified_base (30)..(30): cm
  modified_base (31)..(31): um
  modified_base (32)..(32): 2'-O-methyl a
  modified_base (33)..(33): gm
  modified_base (34)..(36): 2'-O-methyl a

SEQ ID NO: 64824 - RNA, 36 nt, Artificial Sequence
  Synthetic
  misc_feature (1)..(2): linked by phosphorothioate linkage
  misc_feature (2)..(3): linked by phosphorothioate linkage
  misc_feature (3)..(4): linked by phosphorothioate linkage
gcuguccaaagagaauccuaguuuuagagcuaugcu

SEQ ID NO: 64825 - DNA, 56 bp, Artificial Sequence
  Synthetic
gtctcgtgggctcggagatgtgtataagagacagggcacggaagtgttgctgtagt

SEQ ID NO: 64826 - DNA, 55 bp, Artificial Sequence
  Synthetic
tcgtcggcagcgtcagatgtgtataagagacagcccttctagaggcaacatgtga

SEQ ID NO: 64827 - protein, 357 aa, Artificial Sequence
  Synthetic
  misc_feature (347)..(347): Xaa can be any naturally occurring amino acid
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRCLNVILWLGFWAVQLNVCLSRIYLAAHFPHQVVAGVLSGIAVAETFSHIHSIYNASLKKYFLITFFLFSFAIGFYLLLKGLGVDLLWTLEKAQRWCEQPEWVHIDTTPFASLLKNLGTLFGLGLALNSSMYRESCKGKLSKWLPFRLSSIVASLVLLHVFDSLKPPSQVELVFYVLSFCKSAVVPLASVSVIPYCLAXVLGQPHKKSL

SEQ ID NO: 64828 - protein, 355 aa, Artificial Sequence
  Synthetic
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRCLNVILWLGFWAVQLNVCLSRIYLAAHFPHQVVAGVLSGIAVAETFSHIHSIYNASLKKYFLITFFLFSFAIGFYLLLKGLGVDLLWTLEKAQRWCEQPEWVHIDTTPFASLLKNLGTLFGLGLALNSSMYRESCKGKLSKWLPFRLSSIVASLVLLHVFDSLKPPSQVELVFYVLSFCKSAVVPLASVSVIPYCLVLGQPHKKSL

SEQ ID NO: 64829 - protein, 355 aa, Artificial Sequence
  Synthetic
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRCLNVILWLGFWAVQLNVCLSRIYLAAHFPHQVVAGVLSGIAVAETFSHIHSIYNASLKKYFLITFFLFSFAIGFYLLLKGLGVDLLWTLEKAQRWCEQPEWVHIDTTPFASLLKNLGTLFGLGLALNSSMYRESCKGKLSKWLPFRLSSIVASLVLLHVFDSLKPPSQVELVFYVLSFCKSAVVPLASVSVIPYCLALGQPHKKSL

SEQ ID NO: 64830 - DNA, 94 bp, Artificial Sequence
  Synthetic
agctgccttctgcggggcttgccttctggccatgcccttcttctctcccttgcacctgtacctcttggtctttgaataaagcctgagtaggaag

SEQ ID NO: 64831 - DNA, 110 bp, Artificial Sequence
  Synthetic
gctggagcctcggtggccatgcttcttgccccttgggcctccccccagcccctcctccccttcctgcacccgtacccccgtggtctttgaataaagtctgagtgggcggc

SEQ ID NO: 64832 - DNA, 121 bp, Artificial Sequence
  Synthetic
gagatgtggagtcttcggtgtttaaagtcaacaaccatgccagggattgaggaggactactatttgaagcaatgggcaccaagtgaaataaagtcttgttaattactatattttagatgca

SEQ ID NO: 64833 - DNA, 56 bp, Artificial Sequence
  Synthetic
aataaaggaaatttattttcattgcaatagtgtgttggaattttttgtgtctctca

SEQ ID NO: 64834 - DNA, 120 bp, Artificial Sequence
  Synthetic
ttgtttattgcagcttataatggttacaaataaagcaatagcatcacaaatttcacaaataaagcatttttttcactgcattctagttgtggtttgtccaaactcatcaatgtatcttat

SEQ ID NO: 64835 - DNA, 22 bp, Artificial Sequence
  Synthetic
agagagggcaagggattggacg

SEQ ID NO: 64836 - RNA, 64 nt, Artificial Sequence
  Synthetic
  modified_base (1)..(1): um
  modified_base (2)..(2): 2'-O-methyl a
  modified_base (3)..(3): gm
  modified_base (4)..(4): cm
  modified_base (32)..(33): 2'-O-methyl a
  modified_base (34)..(34): cm
  modified_base (35)..(36): um
  modified_base (41)..(42): 2'-O-methyl a
  modified_base (43)..(43): gm
  modified_base (44)..(44): um
  modified_base (44)..(45): gm
  modified_base (47)..(47): cm
  modified_base (48)..(48): 2'-O-methyl a
  modified_base (49)..(50): cm
  modified_base (51)..(51): gm
  modified_base (52)..(52): 2'-O-methyl a
  modified_base (53)..(53): gm
  modified_base (54)..(54): um
  modified_base (55)..(55): cm
  modified_base (56)..(57): gm
  modified_base (58)..(58): um
  modified_base (59)..(59): gm
  modified_base (60)..(60): cm
  misc_feature (61)..(61): linked by phosphorothioate linkage
  modified_base (61)..(63): um
  misc_feature (62)..(63): linked by phosphorothioate linkage
  misc_feature (63)..(64): linked by phosphorothioate linkage
uagcaaguuaaaauaaggcuaguccguuaucaacuugaaaaaguggcaccgagucggugcuuuu

SEQ ID NO: 64837 - RNA, 68 nt, Artificial Sequence
  chemically synthesized
  modified_base (36)..(37): 2'-O-methyl a
  modified_base (38)..(38): cm
  modified_base (39)..(40): um
  modified_base (44)..(45): 2'-O-methyl a
  modified_base (47)..(47): gm
  modified_base (48)..(48): um
  modified_base (49)..(50): gm
  modified_base (51)..(51): cm
  modified_base (52)..(52): 2'-O-methyl a
  modified_base (53)..(54): cm
  modified_base (55)..(55): gm
  modified_base (57)..(57): gm
  modified_base (58)..(58): um
  modified_base (59)..(59): cm
  modified_base (60)..(61): gm
  modified_base (62)..(62): um
  modified_base (63)..(63): gm
  modified_base (64)..(64): cm
  misc_feature (65)..(66): linked by phosphorothioate linkage
  modified_base (65)..(67): um
  misc_feature (66)..(67): linked by phosphorothioate linkage
  misc_feature (67)..(68): linked by phosphorothioate linkage
agcauagcaaguuaaaauaaggcuaguccguuaucaacuugaaaaaguggcaccgagucggugcuuuu
